United States Patent 6,812,339 (POLYMORPHISMS IN KNOWN GENES ASSOCIATED WITH HUMAN DISEASE, METHODS OF DETECTION AND USES THEREOF) - sequence listing, part 8

SEQ ID NO: 11811 - DNA, 7707 bp, Human
cctgtccttcttttttttctccggtcgcatcccggggctgggtaaagactttaagagcccccacctcaactattactggctgcccatcatggtgagtgactcccctctctgctgctccacccccaactccccagaggaacccaataaccccaacgggtcatgtcttccagacctccatcctgggggcctatgtcatcgccagcggcttcttcagcgttttcggcatgtgtgtggacacgctcttcctctgcttccgtgagtgacacccccagccacctgtccccaaccttaaagtactgagccgttcaagcatttttttttttttttggagatttggtgcttctagaaacaatgcctttgtgagctaaacgaaccagagggagcttcttgtgacatcctgaggccaggcgtttagggaagaaggaagagagtgagcccccaggccggtaggctctccaaagaaggagcattctgatggagaggtctctgctatcttccctaagaaatctcgggtagaagttagccattagaggccaggcatggtggctcacgcctgtcatgccagcactttgggggaccgaggtgggcagatcaccctgaggtcaggagttcgagaccagcctggcccacatggtgaaacccctctctactaaaaatacaaaaaattagctgggcgcggtggcgggcgcctgtaatcccagccacttgggaggctgaagcaggagaatcgcttgaactcaggaggcggaggttgcagcgagccgagattgcgctactgcacttcagcttgggcgacagcaagactccgtctcaaaacaaagaaaaaagattaaaaaaaaaaaagagccattagagagacttcccagcaggtggctgtagcggcaggggattttcttactctacagcatgcatccattcagggtttgccagtctcctcctaagcgactgacatgcattttttccgctaattcttatcatcgctctatgcaacataatattcccgaccccacttcacaggaggaaactgagattacataacctgcccgggggtaagggtggtggtgcagcttggattccaaatcccgcaggcagcttgcctcccagtccccgatttcctggccccagggtccgctctaaccggtctctgttgcggctcagtggaagacctggagcggaacaacggctccctggaccggccctactacatgtccaagagccttctaaagattctgggcaagaagaacgaggcgcccccggacaacaagaagaggaagaagtgacagctccggccctgatccaggactgcaccccacccccaccgtccagccatccaacctcacttcgccttacaggtctccattttgtggtaaaaaaaggttttaggccaggcgccgtggctcacgcctgtaatccaacactttgagaggctgaggcgggcggatcacctgagtcaggagttcgagaccagcctggccaacatggtgaaacctccgtctctattaaaaatacaaaaattagccgagagtggtggcatgcacctgtcatcccagctactcgggaggctgaggcaggagaatcgcttgaacccgggaggcagaggttgcagtgagccgagatcgcgccactgcactccaacctgggtgacagactctgtctccaaaacaaaacaaacaaacaaaaagattttattaaagatattttgttaactcagtaaatctgtgactcattctctccacgacgacaggcggcctttttttttccgcgcccggctctttaaaatcggccccgcccctgtgacgtgtcctggtgccgcggccaatcaaaaagcccaataaggatggtgccagtcccttcttcaccccagccagtccgcttcccgttcgggtcacgcgctccgggcctccaagagggcctccaagagggccaatcggaagggcaagcttcgagatgctgcgtgatcacgtgggaggagatgagctacttgaagaccaattagagtccgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcgatcttcctgctgctgtctctggcagcctcctggtccaaggctgagaacgacttcggtctggtgagtcaccctttgcatagccccatccccgacccgcgcaggtgatcgacacctagtgtcccccggaacgcgggcggctgagccgactttccgcgacaggacccttttctttctcccagaccccgtttcctcctaccgctcccagcccctctccctctccgggtccccgtccttctcctcattcgagccccttcctcttttggggtccccttccctccctgaaggcgccttctcctttcgtagaccctcccctgctccgagcctccagcttcgctccaaactccccttcgtgttcctctttcttgttctgggaccccatcccctactcgggatccccattagatcctccctctcccatcggaacgtgggttcctaaaacccccaagacaagtttgtctttgttgacccttcctcctcccatgacaggtgcagccgctggtgaccatggagcaactgctgtgggtgagcgggagacagatcggctcagtggacaccttccgcatcccgctcatcacagccactccgcggggcactcttctcgcctttgctgaggcgaggaaaatgtcctcatccgatgagggggccaagttcatcgccctgcggaggtccatggaccagggtataaagatgtctgggtgaaagagccggtgctaggttggatgggtgggcagcccaatgagcccaagggccctgaggataggggaacttagagggttggttgcctgagtccctgaggggtagagggaacccgagaagggcaagtgtctaggacagtgatctggaaattgggatcaccaaggagttggacattcacttagcaaacatttattgggtactatatacctataccaggcactattttaggtttcatgaatatagccacgaacaaaacagatcaaaaatctctgccctcaggatttaaattgtactggaaggagacagacaagcataataaacaagtaaacttttttgtctgttgcaaggtgataaatgcaatggagaaaaataaaacaggacaagaggtatagatagtgcaagtgttggattgcaccctgggaccatcggaaggcctgaggtccctagcagaaggtgggaaattaacgggaagtggtagaaagggtacctgcagagtgctcactctgggtttcttcctccaatttttttcaggcagcacatggtctcctacagcgttcattgtcaatgatggggatgtccccgatgggctgaaccttggggcagtagtgagcgatgttgagacaggagtagtatttcttttctactccctttgtgctcacaaggccggctgccaggtggcctctaccatgttggtatggagcaaggatgatggtgtttcctggagcacaccccggaatctctccctggatattggcactgaagtgtttgcccctggaccgggctctggtattcaggtctctgtcctaggagataggtggagggggctgccttgtggagagtctgagggatacccccaaatggactcctttccaaggggaagattctctgaagtcagattttctggcttgggtgggattccttgaaagacagggcatcctggtaggaacacattatcaggagaagagggaactctgccattggcttcccatttggcattgtcaacaggactgcgttagtccatgcaataccctcatgcaaagtagaaaaaggcactgcctctttggacagacacaagcctgtgccagggtgcacagcttggcgagtgagcacaggttgggtttaagctctcatgcaccctgtggctgggcccctggtgcacatgtccagctgtacaccctgggagagcttcttaattcaaacagggtgtgtatttatgggatctgactggaaccctcagtgagcaagggctgaactcaaggggaccatacatgtgattgcatttgggaagtggtgggttctctgtccctgcctctgagcccctagagtctccttctgtgacacccagttccctttcccacagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccaggtcaggagtccatgagatgttccctacccatttgaccctccctgccctccagaacatcatttcacgcacagacccagggtctgactgctccactcagtgccacacacccttgctcccctcggggacagggcattttccctgttccctccctgaggtcctgtcctctcccctcagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgtgagtgcctcatgggtggggtcagcagggagagccctgtgtctagacaaggcctgggcagagaccctctctccctgactctcctgctctccccaggagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaatcctcttttccttttgacatgccctctttttttgttgttgctttttttgagacagggctcgctctgtcacccaggctggagtgcagttgcacaatcacggctcactgaagcctcaacctcctgggctcaagtgatcctcacgtctcagcctccggagtagttgggactacaggtcagtgacaccatgcctggttaatttttttaatttttattttcagtagagacaaggttgcgctatgttgcccaggctggtatggaactcctgtgcttaagcaatcctcatgcctcagcttcccaaagtgctgaggttacagctatgagccaccgcacccagcctacattccttcttatcaccgagaaacaggttgatcttcacaggtgtaatgagtatgaagggagtgccataagatattttttattttttatttatttattttttaatttaatttttttttttttgagatggagtcttgctctggcacccaggctagagtgcagtggtgcgatctcggctcactgcaacctctgcctcccaggttcaagcgattcttctgcctcagcttcccgaatagctgggattacaggtgcccaccaccacacccggctaatttttgtatttttagtagagacggagtttcaccatgttggccaggctggtctcaaactcctggcctcaggtgatccacccgcctcggcctcccaaagtgttgtgattacaagcatgagccatggtgccggcgggctgatttttttaatttttagtagagacaaagtctcactatattgcctaggttggtctcaaactgctgagctcaagcaatctgccggccatgttctctcaaagtgctgggattacaggcttgagcccctgcacccagcctgtaagatattttaaaatccacacttggccaagcgtggtggctcacacatataatcccagcactttgggaggccaaggtgggcggatcacaaggtcaggagttcgagaccagcctggccaatatggtgaaatcccatctctactaaaaatacaaaaactagccaggcgtgttggcttacacttatagtcccagctactcaggtggctgaggcaggagaatcacttgaaccaggaggcggagtttgcagtgagctgagatcacagcactgcacaccagcctcggcaacagagtgagactccgtctgaaaaaaaaaaaatccacgctgttttatatttctaacatggggtaggataccatcctccatgaaatagggtgcaagtgtgtgaaatgcagatgggaatcctgtcccagctagcctgacagagaagtgagcacttcctatggcaaattatgtaagaaaatattccccaggcagatgcttatgaaaagaatctgttcagcctgcaggtaagtgggagagcccttgctcaaaaaaaaaaagaaaaagaaatagtggaagacaaaaaggaaaggacactatgaatgtctgacccatgaactactacctgttagaaacagaagtgctgggaggcttgagagacagacactaccttcctggctaggtgtggtggctcagatctgtaatgctagcacttcgggagaccaaggcaggatgatcaaattaaagggcatcctgggcaacatggcaataccccatgtctaaaaaatttaaaaattagccaagcatggtaacgcacacctatagtcctagctacatgggaggatggcttgatctctttgaccccaggagttcgaggcagtagtgagctatgattgcaccactgcacaccaacctaggtgacagagtgagacctcatctccaaaaaaccaaaccaaaacaaaaaaccttcaagaaagaaaaaaagcttgaccttccctccctcactct

SEQ ID NO: 11812 - DNA, 28843 bp, Human
gatcaagaccagcctggccaacatggggaaaccccatctctactaaaaatacaaaaattagccagatgtggtggcacacacctgtaactccagctactcaggaggccgaggcaagataattgctcgaacctgggaggcagaggttgcagtgagccaagattgcggccactgcactctaggctgggcaacagagcaaggctctgtctcaaaaaaaaaaaaaaattgaattaccatgcgatccaacaattcaacccctatgtatgtaccctccccaaataaaaatgggctctcaaacaaatacatgtacatgcatgttcatggtagcattattcacaaagccaaaagatgcaaacagccccaatgtccatagatgaataaactgtggcatacatgatacacacacacacacgcacacacatatacatatacacacacaaacactattcagtcataaaaaggaataaagtctgttacatgctacctgaggatgaacctcgaaaacatgctaagtgaaagacacaaaagtccacacactgtgattccgtttatatgaagtatctaaagtaagtaaatatagagacagaagtagactggtaattgccaggggctgggggggaagagggcattgggaagaaacttctcaatgggtatggggtttttctttcggaatgaggaaaatgttttggaactagacagaggtggtggttgcacagcattgtgaattcactaaatgccactgaaatgcccactttaaaatggtaaattttatgttatgtgaatttcaccttaagttaaaaaaaaaaaagtaaaactactcagacaacgccaaattattgacaatctcaacctaccccacagaccccaaatcctggaaccacaaccccctaggccaattctcaggtcaggcagcaatttattcctgttcaattttatgcagagctcctggtggctctgaagcgccctagggaacagaccaggaacattctcatggtgttagctcacattgggccattagtgctcctttaatgtgagaacaaccgggaggaggaggggatgtggacccaaaactacaagaaagagtgtcctcgaagcctatgtcctaccgccccacgctgctgccaggcccgcaggaagatgacaggcccggcctccactccttctaaggtcgtcgcttagttccgacgtcgggatgaccctgtcatccacgcggcgtgaaggccaccctccccgcgcgcccgggactccaggtggggccccagtggacgagggaacgcggcgtcgcccaccgggcgtggcctgggcgggcgtggggcggggcctgggccggcgccgggtccggccgggcgctcagccagctgcgtaaactccgctggagcgcggcggcagagcaggtgagcgggcggtgccggggggtgcccaggccagggccctgtcgcctgcggcgctgagggcccggggtggggctgcgccctgagggccctgccctgccctccgcacgcctctggccacggtcccttccccggctgtgggtctgcggcccctgcgtgcgcagcgctcctggcctctgcggccagcgcgggggcggagagaggagagtgcccggcaggcggcggctgggccggcccggaactgggtcgtggaaggatcgcggggagcggccctcaggccttcggcctcactgcgtccccacttccctgcgcccgcctgccgccgagccccggctgggggtgggcgcggcgcgagcggttaaagggccggtgcatttaaaggagcggtgcacgtgggtctctgaggcgtgtagcaggcgggggcgttttgttcttcttctctctcgccggagacctccgttgcgccgagtccattcggcctctagcaccgggtcctgggcatgctttccccgggaaggaggcgcgcgggggctctgcccgcacgtgaggggcagggccgcaggctcaagcctagagccggtttctgttagcagcggtgtttggctgttttatcaggcatttccagcagtgaggagacagccagaagcaagcttttggagctgaaggaacctgagacagaagctagtcccccctctgaattttactgatgaagaaactgaggccacagagctaaagtgacttttcccaaggtcgcccaggtacgatatagcagagccaggcttcgaccccagtgtcctggcttctagatctgctgtccatccctccgagcagacctcacccctgtttattgccttaataagtattccctttgaaaggtatgaacggtgttgagtgaagtaactgcatccctatttacaaatggagaacctgagagcattccatagagacgattgtagactaacttaactcagaagcgacagcctggggttgccaaggctgtctacgaagtaacttgattaggaccgaccccagcttccagtaaggaagcctctgatgcctctgtagccaattctgcagacacctgagcctccaaggccttcagccaagacctttggcggtaattggagtctcgggataagctgcttcaggtgtgtgagcctcaggttcttctctcctgaatgtggttgtgggcagccggtgactggcgcaggtgcagaaggggcctggttcttggccccacctcagagctgcgtcctcaggacgcccacgttgagccttgggttccagggcagagactggagtgagggcttgggggcatgttgctttgaagtgggatggatgtatcaggtttttggggaaaactctgtaccctttggtgttgaagtgcccatgtgccaagtcttgagtccagcatgttcacatgtggggagtgagtggcttgttcctgtctatttgaaagagcagcaaggaggaggaggagcaagggctaggggctgctgctggggtgcctggagctgtggtgcataatgtcacacctgtctcccctccgtagctgctcaccgtccccccaaggggggtttgcctcttgcctactttggcctttctctgttatcgatgttaataatgacatatatctcgcttatgagttggtcataataaaaagctatcttgtacagaatattagaatttaagatcttaagaatttcaatgacactgaaatagtttattattacctttttacagaagaggaaacaagttcagggagttaagcagctagtccagttatgtggcttcagtgctttaagcaccaggatttgaacatagctggctacactgtctttatctcttgagtttttgcgcaggaggttcctgtattcaactcctacccgtgtctctccactactgctgggaaagttttgtggagtccccatgagcaacttcctgacaaacaaacaaaatttttttaaagaaaccaaagcagtgtgtgtaggtcacatgcagtgtgtctaatgaaaacatctctggcgggttttcagctgttgctttgactttcggacactgtttagttggggactgataagacagcaaatatttctgcaagtattcccacctgttctattcccagctgccacagctgcggaaaggcgggggtgaggctgagaggccccgagaggaacattttccactgggctccaatcctggagatgggatgaccatcatgttaatgtctggagaaaagaatgatttcaggctgggtgctgtggctcatgtctgtaatcccagcactttgggaggccgaggtgggtggatcacctgaggtcggaagttcgagaccagcctgaccaacatggagaaaccccatctttactaaaaatacaaaattagccgggcgtggtggcacatgcctgtaatcccagctactcaggaggctgaggcaggagaatcgcttgaacccaggaggcggaggttgcagtgagccgagatcgggccatggcactccagcctgggcaacaagagcaaaactccatctcaaaaaaaaaaaaatggtttcacatcagtcctcaggaaagatcagatgtcagtgagggagatcatttcttgagagcctcttcactgagtgggagaatgggctgcttgttcatctttgtgaaaattctagaacgggaagaacaattcaaagggtgtccaccattctgctgtaccttaaccagaaacttactggactctttttaaaataaaagtaattcatgtttattctagaaaattagggaaaaaaaattttttttgagatggagtttcactcttgttgcccaggctggagtgcgatggtatgatctcagctaactgcaacctctgcttgccgggttctagcgactctcctgcctcagcctcctgggtagctgggattacaggtgcctgccaccactcccagctaatttttgtatttttattagaggcggggtttcaccatgttggccaggctggtctcaaactcctgacctcaggtgatccgccaaccttggcctcccaaaatgctggtattacaagcataagccattgcgctgggctgagataaccactcttaacatgcatttccttccacactgttcacatatgcatatttatctattaaaacaatagagggagggaaccgtaggtgaagtttgtgtatcctgttttttctgttatgccttcagaattttccttttattgagtactcatggaaaagcagatttgatggctgtgtagagcatttgaattatttatcctaccagtcccacagcaggacactttcccaccctcccttatgccccagagaagcagtgccctctgtcctccccatgcccatatgtgggcactccccaccatggagccaaacctacctgggcaagtagcagagggagagcagagtgagccctgggggcaggagagagacttgagagttttgaggtgacagatgagctggtgagtgagtgattagggagcatttcttgacacatacctgcccgtggtgaaggcatgtgtcttgtgagtgtgctcccagaaagcctgtgtagtgtgtggtgggcctgcctgtgtgaccaaaccctggccactgggtacgtgaccctcacaagtgctgactgggctgagaagagctccttgatgggcagtttggagacttgagttgtaactgtggcttttggccatgggacattaactgattacttttgcccctctaggcttcagttgtccttaattataatacagggagctgactaggtggcgttgatggcctttaaggtccttgccagctctgacattgtcctatggatatgtcctttcatttgataatatgtttacgtggccatagtgcctggggctgggccgggaatggaaacttgatctctggggcctggcctttgaagccagttcatgtgtctggtggttcagcagatccgtaactttccaagaggcacatccataggctaccgtgtcctttctcactgtgtccctcctccatttcatcttctttataactacgacttattgaacatctactgtgtgctggacactttacaggttatctctaggttttacgataatcttgcaaggtatgcctgttctgctttttacagcagaggaaatgagctgtgtcagattagactgtctgaggcctcttggccagggagtatgtggttcaaatcacataggcaggcgatctgaaccctgtcagtctccaaagcctctgcttttgaccgctgacttgctgctgcttgtttaaaaataaatgtgtttctggagcctactccagaggggcgtgctaggggctccctctcccacttccccacaaaccacccttttccctggctgcttcaggaaatgagagaactctgcctgggccccaggcacttctgagtgggacagggctgttagaggtaagtctagagcctggcccaaaattcaggaggccccatcagagggcccctggggcctgtggtccgggagggtggtagggcagtacctcacttccctttgagactcaggccccagctctggcttaggccagggagaaccatccccaagtggtatgtgttactatatgagctgagatggatggtcagctggaccaaatacatagtcgggtacccagggccagggggaggaaggtgagcagggaagctgtgggcaattgtctgggtatcacctgaccttagcaaactcttccttgttttaagcgaggacgtgggacttctcagacgtcaggagagtgatgtgagggagctgtgtgaccatagaaagtgacgtgttaaaaaccagcgctgccctctttgaaagccagggagcatcattcatttagcctgctgagaagaagaaaccaagtgtccgggattcagacctctctgcggccccaagtgttcgtggtaagtgcagtgactcccaacctgcttttgaaccctctttttccattaggattttctccgtggaggcagatttccatgggagtttgctgtggcattttgaaatctgtttcttacctagttccattggccttaaatgttaaggccaaagcctttacatttctctgtaatgaaaagaaggtcgaggaaattgggtcattgggtttccataatgattgcaggaactgctgacacaagcacggctggggagattctctaggtcagactcccttggtttggctaattcagcagtttgatcccattcagctgattaatgggaatgtgcagtggcttctttggatgtttgattttgcatcctaatccaaagcagctatcagcctcagcacttccttgttggaaggctttccagaacgtagtctatgctggacacttccttctgcctctctgcattttcctgccacttctctagagaatggggtgcagggggtgggagacggggaaagctggtcgctgagtggctgatgggacttgacatcacccagccccacccccacctgcccgtgagtcagcctccggggagagttcatcgcgtcaccggcactctaatgtggacagacacctagcagtgttgtttatctgcacacgtttgggtggtgatttttccctccaaggatttcagagcaccagcaggcttcagagcagacttaggtggcttgcaaagcaggccctcaggaattcagagggtagcagaagtccatcccagatgctctgttttccttcaggagctaggtaaatcagaggggctgagggacaaatgaaaaaagttacagcctttgagtcccatctgctcctcctggccaatgagaggggatctgggaggggcagatgtagaggaaaatctgtctaaatgttgatgctcgttattttcctttaaagaattaatagcctaaaataaaccctacagatacagtctgtgtttattatggcgacttagagaaatgcagaaaaatatcaagaaaataaaaaccactcttggttctaccatgcaaagataatcatctttaatgttttgtaatatttccgatcttttatatacatacattttataaggacattcagatgatcaggttcgtaaagttttatgttcggttaaatttaacagcgtgtcattgttcaggttattaaatgtttgaaataagatttttggtggtcctgtcacagtctccatgaagtagcatttcaggatcgaaaggtatgctgtgtttaaagtgttgattcttactcctttcagttaaggccagtgcagtttgtccaggtagtgactgagacccagtttttccacactctcctccgcagtgggcattgttttgggcctttttcagcccaagagctctcttctccccatgccgctctgctggtctgagatttttccactcctcctcctccctagttgctctctgaccagactctaggtattcaggagaaagtgttcattgtctcactctctcatgtggcaatcaagtagtgccaagcagtgagagggtgaaggtgggtgggtgagggacactcaccttgctgagaaagggccccagcctgttcgggtgattataaagcagagacagtgccaggaaaagtctgacactggctgagaatcacccggggaccaaccatcccgaatgcggatccctgacactgggtgaggatggagcttggagatctgcattgttaataagcagcctagcagagtggtgaagagtccagacacactacctaggtccaagggtaaccttgagctaattactttttgagcctctgtttcctcatcagtaccatggggaagaatagtagcaccttgctccaggatgtttagtgccggctaagggctcagcaggtgctggtccatctccaccagcccccagtggcctgggccacctttgagaaacagtgatcctaagggattcagcatttcctaagttggtgcctcccacctgtcacccccaccccaccaggctaggagggttgtgattagagggtgcccttgctgtgacagctgagactagctcttccctgattattccttaatgacagctctctccttccctgctttcttgaagtcttggtcctcgttgttgtgggcacagcttcaggggaggccttggaggaatttttgaaagtggaatgagggaagcagcctgctcaagggaacacttgttttctggtgaggaggccgcatgtatgaatgacgtttgtgggttagaaagcatgttttgtagtttttccttgtttcttcctgaagacatgtcaggtcttgatgagaccgggcctgggcacagggcaggcagtcagcgagtgtggatgatgacgacagtggtcaccaggtcactgtctagaccaggtcactgtctagcgcagtgtcacatggaaagggtatggtcctttaaccctaccctccccagcacaactatcacagatgtcagggaacctctgctcacagaactgctttccagggattgtcttttttttctttttctttttctttcttttttttttgagacagagtctcactctgtcgcccaggctgaagtgcagtggtgcgatctcagctcactgcagcctccgcctcctgggttcaagtgattatcttgctacagccttctgagtagctgggattacaggtgcctgccaccatgtccagctaatttttgtatttttattagagacggggtttccccatgttggctaggctggtcttgaactcctgacctcaggtgatctgcccacctcagacaggcatgagcaccgcacccagccccagggagcgtcttattagtggttggcaactgaatggagacgtgggaattgtaaggaactgattctacttgatcctgggtcccctgcttctccatcttcacccacccatcagctccctttctcctttaaacaggcacctttgctctctgcttatccatttttgttgtgcattgctatttgggagcctaagaaacacaacatcctctgaatgctccagctgttgtgggtctgaagggtgagcctgccctctgtcattggaggctgcagcctgtggctttttaggtacagggactcccagaactgctcctccagtcatagcagagataaatcacaggagcttaagaggcatgggaagaacagagggaggagatcgtagcttccctgttcattcacacccaaaacaaaactgtcatactagaaaaggaggtattaaaagagccacctgtacagcctcgtatctcatccagcacactgctgcagatggaatattatgatttagcttgagaaaatgcagcaactctttgttgtggtgcccctctttgagtaagagtgaattccccattgccagagtggatagtgagggaaaccctgggtccaggcaggagtctgtttaggatttatctagtgaggctgagccagaggaggaccttacagttttttctcttcaatttcttttatttatttatttatttttgtagagatggggttttgccatgttacccaggctggtcttgaactcctgggctcaagcgatctgtctgcctcagcctcccaaactgttgggattacaggcgtgagccgagccaccatacccggcccttctcctgcatttccacctgataatttctctcatttccatagatgatgaaggaactaaagccaagaactttccaaggtcctgcagctctttgggggatgtgaagctgtgctctatttgtatggattttgctggttcccagaacttccctgtggccctggggcctagtctgagggtactctgagtgaagagggaggagggcccacacctcttctgcaaaggctgcttttgtaaagttcacttcagttcacatcttcctcctggtcagaaagcttcgggggctctcctctgctgcattaagctcttactcctccatcaggcaccaaactcctccctggcatggcccatcctaccaggtccccacacttgagccacatccaattgctcgatattatcaggataggttatgttatgttcccaactcatatgtttacttaagtggttacctctttccagaatgagccccctcctccaaactctgcctggtgaaatattcctaacctttgcagcttcacatccctcttacttcttgtgacctgaggcatctactcctgacaactgatagactgtgtcccctcctgtcgggtgcattgtccttgtcactaccctcctggcttttagctggctttgcttcccgctgttgttactcctgtacttgtctcatctatcctaaacagaaggtgctgcaggctggggagtttgttcatgttgaaatccctgtgatggaggtgagcagaggcagtctctgcctgtgcctcttatttggggatgaagttaaagtccctgtaggaataatccaggccatagccggggttgctgtcttcagaaagaagggcagccacaggtcttgttaaggggattgaaattggctgacttggtggaaggaacctgcctgctttgtttaaaaaccacatatagctgagtgtagtggttcacactctgtaataccagtgctttgggaggctgaggcaggaggatcacttgaggccaggagtttgagactagcttgggcaacaacgtgagaccctcatttctacaaaatattttaaaaattagcctagtatggtggcgtgcatctgcagccctagctactgaggaggctgaagtgggagaattgcttgaacccaggagttcaaggctgcagtgagctatgattgcaccactgtactccaacgtaagtgaccagtgagaccctgtctctagaaataaaaataaaaaaaatcacatatattgtggggtgacttacttggagacgaactttcagcagagcgcacacctgctatccctgcccagggtgtgaagctcagccctgagggtctctggacagcgatcactcagcctctggacagcgatcactcagcctctggacagacagcgatcactcagcctctggacagcgatcactcagcctctggacagcgatcactcagcctctggacagcgataactcagcctctgtccccgtctgagatgttggcagggactgtcagatttgccaggcattgtttgaagttcttcccagcccagaaacctgcatgtgtagattttggtacactgggtcccccacttggtactactgtgtgaaaccccacttggcactgttttagggggcaggcttccctcctgtccccttggccttggccttcccctgggtcccgccctcagtggcacttccccacctcacacgtctgctctcatggcttaggtctccacttctaacctcaggagacctggtcctcagacacctcccagacagcttccccattttatcccatagacactcaaagggtgaaattcatggtctttcccgagactctcttctccggtcttccctgtcttagtccccacctggctgccattctagactgtgttttctctcctgcgtcaggtcctgcccttgacctcttgaccccttctggactctgccctcacttgcatccatcctgctgctgtcctcagctctcctcacctgccacagttgtctctgggggtcactttccctctctggtcagtggccagactgacttttataaacctggttcagatcttgtctgtcaagattgtcctcagggtgatgtgtgtctccttaacatggtgcctgagaccctgatcatctccactgcccgccccacagtgtgaggccctcactggaacattgtgccttctgcccttccctcctcctgggaaaaccagtctccatcagataggctcttctctagaaaacattcgtgatctctgagatttggttccacttttgtgcttctgcacctaccatcaaacacccggattgtatcatttgtcacattagatgatttttgttttgttttaagacaagggtgtttcttactcatctttttatccccagagcccagcatgatctttggtgcataatagatgcaccacagatgtttgctgattgaatgaatgagcacactgacagtttggagctgccctgactttcgtggctatgcgttttgccccctgggatgtgagtcacctcaggccagccccaggcaaggccgctgctgcctccatggtaactctcaaggcctcttgttttatggcagtcgtttgattgacaggcatctcttggaagcttttggggcaggacttgtgtccaagtctccaggtcgcctccagccaccccctgagtcctccactgcctttgtctcacaggaaagtggaacaaggtccttgtgctcctttttccaggtgcttccagaggcagggctatgctcacattcatggcctctgacagcgaggaagaagtgtgtgatgagcggacgtccctaatgtcggctgagagccccacgccgcgctcctgccaggagggcaggcagggcccagaggatggagagaacactgcccagtgggtaggtcccaccagcagctgggggccttcaaacaggtccctgcggctactgtaccttacagatgaaaaccagacattcattccctgatgcgggagggagaagggaagtaatgatgaggattggccgaaaaggtgggtggctggccatgatggaccttccatctgcagggtttcataggactgcgcattcacagccagagatggacttggcagtgggctgaaggacgctgtccactctgccaccttgggtttacctctctcatgcaggtcactgtttccactgtaataggagagtttgtttggatgcctgggtgctaggacaggtaacacagaagcttaggatggtagcaggggaagcattttttggcagatggccagacatggtaagtgtgagaggagtctgcctgatacacgattgacttttgagctggggatatttgggcttcactgtgatcattcagcccccaggggaggagattgtaacgttagaaagagtaggatatcgttgggagagccacttagttgtgtcctttctctcccgatcagggcagaacatctgaatttgcctgaaccctgttctctgttttgcccattatagaattaaaaaatgtctctgtgtggactgttttcttgcagccagtcttaatcctgcttgctgaaatttgagctcacttctccatgttctccttgagaacggaaccatcgtccctaagccctgagtgaaatcacaccagcttaaggccactgctctgccactcctcagccttttcttgtttgttatctccgggaagttttgtacactttggttgtttcagtttctgttcatgagtagtcttctttcttggctgaacgtctagattgggactctctctgcagagaaccggtactgaagcaactgtcattttcagtttttgtttcatttggctttttctttagctgttcacctcattagcaaggcagcccatgaccttgacttgccacagttccaaaacacaaattcttacagatcggtttgtgctagtgtctggcaggtgtcctgccctccctcgttacctcctcatttgtgcctgcccaccttcccagagcctgcgtcttctcagatgcttaacacctgtttagcctctctagttcagagctacaaatttacatgcttgattctgtggggcagaaagttcaaagtaatttcttcctctgcaaattcccagtatcttagtcacacgcaaagagagtgtccctgtgcactgactcctctagctagtgatttgtcagccaaaaatgtttatttatctcctggcctgtctcctcccatatcagtatggccacatgaacagaattgagtgacctcctgagtccctgtattaggaaggggaaagatcttttgattcattaaccattaagttgattcattaaccattaagtcttgggcctgcagaccatagcaaccttccttccttcatttatggtgcttcatccagctccaaatcttctctactttgtcctcacaaacttttcatatgccctagtagctcatagactgctccttatatctggaaagcaacattcaaacttctcatttctggttccaaaaatccgtgcattacatggataggctgccgtgggggacattccgcggccctcacgatgtggtttcccacagagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctgtgagttggggggctggggggagcagggtggggtgagggctgagttgccagggggtggggggcgcagcagcctgtgttggtcactgtacctgcagctccacaccagcagcggtaaagagcagggatgaagaaccgcccaggttcatggcctggctcactgcctcctggattgtgacctacttgggcatgcttttaacatccctatgcctcagcttccttgttcgtataatgggttgataacgcagttactgggagaattaagtgagttaatatgagtgaagggcttagaagagtgtctactgcacgtgagtgctcaggcaagctggatcctgctgcagaaagcaagctcttgatcctgggcatggctgtgccactgatccctgtgtgactgcaaacaaatcacttcctctctgagtctctgcttccctgaatgtgaaacaaggtggttggaccagatatttctcagctcacttccagccttgtgaggaagacttataaagcctttcgtttattttagtaaaatacatgcagaggcagcagcgtagaaaaatgagaagcttcctccacttcttccccctcccctttctgtggtcctcactgctaagcaccttctgtaaacttttttttttttttttaaagttagggacttttgtttcatttcgtgtgtgttggttttttttgttgttgttgtttcttttaaagaaaggaataaggccaggtgtggtgtctcatgcctgtaatcccagcactttgggagactgaggtgagaggattatttgagcccaggagtttgagaccagcctgggaaatgtggcgagaccctgtctgtacaaaaaatgcaaaaattagccaggtgtggtggtacatgcctgtagtctcagctacttgggagactgaggtggaagaacacctgagcccagaagtcgaggctgcagtgagccatgattgcgccactgcactgcagcctcagcaacagagtgagaccctgtctcaaaatttttttaaaaaattaaaaaagaagtagagtcccatcctcagaaagcttatagtgtgtgggggattcagcgcagaacaggtgaaagcatggagagaatgcagccagcggtttgtttgcagcagtccaggctgggaagagtgaggtttgagtgaattgcttcctgtgtctgcttcctgagcttatgagctgcaaggacagcagttgcttcagcggatgggggtcgggtagtagcaggtggaggagtgctgggctgggtggagctggtggagaggtgtgggtgggtgggggaatgagaactggatgggtgagagaagtgcctagggagcctttaatccctgtgggggtggggaaagcagcagggaggtcatctagccctcgtcctcactgctgcactgggcccagttggcaggctgagagccacaggtctgtggtcagggtgccaggaaatgagctggaggacaggaactgctcatggggatggtgcccgcactccatcagggcagcatgtgggcagcatgggcatcccaggcacctcccctagcaggtccagaatcactcaaggtggggagcctcgaggagcagtcagggccgggagcatcagccctttgccttctccctcagcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaaggtgaggccctggccctgccctccagccacccttctctccgtctgccccacaccatggcggcagggcccgtgaaacagccgcctttagaaaaacacaaattagaggaaaatagacccagattttttgtactcctccccaccccatcctgtctcccaccgtggatgacctaatactgttgtcttttatttttatttattttctttttcttgaaacatggtctcactccattgcccaggctggagtgcagtggtgcgatcatgactcactgcagcctcaacctcctgggctcaagaagttctcccacccagcccctcaagtagctaggactacaggtgtgcaccaccatacctggctaattaaaaaatttttttttgtgcaggctagatctcacagtgttgcccaggctggtctcaaactcctggactcaagtgatctcccaccttggcctcccaaagttctgggattacatgtgtgagccattgcatccagcctgttgtcttttaaatttacacattatcccacttgagttcctcattgcagtgttccaagcatcatttctcatatttcaaagttaattttgttttgcttctctttctgaagttctattttaggctcccctcaccccgatacttcccctgaagatttatttttagttttccttttccttttcgggcaaggatgtgcagaggccatgctgaggtcttgcagccctgggagacttttgggttgtagctgcctatagctgccaagtagccccagggagtagtggaagggcagatcccatctggccagaatcatgggcactgcctgtccccaaagatgccataagcttttagacagcggcttcaggcttttctcccaggtaaggggttgaacccctaacgatggaaaggaaattaagctgggcattacctattttaaaactgtttacacacaggtgcctcacagcattttttgttcaggccgctgccatccatggagcaggtagatagaagtgcagagtgcccaggctagagggatgggacagggacagtgcagggagggagctgagcccccttccagcgggggcagcagaggggaaagccatgggaggggctgcaggatgtgtcctgagctgaagcttatcaacaagtaatgagtaccagctgggcattgtggtgcacgcctgtggtcccaactacttgggagactgaggcaggaggatcgcctgaccccaggagttcaagtctagcctgggcaatgtaagaccctgtctctaaaaaaataataataaaataagtaacaattacctgtgtaactgtgacgaggcagggtttgaacattgccgctgggaggttggcagatggtgggaagcagggtggagggctgctggtttggagcagaggatacagattgcatggggtcaagctagaaattgcgtggcagatgtgaagagctggccccactgcgggcagtaggtgtctggtggccagtcccagaggctgtgaagaggggctcagccatctgtctagtagggcttccttggaggttccacgatacaggcagatggtggtggcccgggcagccaggtggtggctgggatgaagagggttggcaggtcccagaggcagccccttccccttttggctgtgtgtgcagcagggccgtggaggctgcttttagtccaggtagaccagggccacgctgaggtcccagtgggctgagctggtgactgatgagttggtcctcaggggtgaggctggtgggaagtgatgtcactgtcccgccgatggccagctaagggactgggttaggatcagccccctcttgtccttcactctcccatccttggccaggagaagaggaacaggtctttctgaggacctgcttgtagacctttgggtaggaggggacttcccaggttctctgttgaggccactctatctaaaatagcaccccagtgagtctcctatcactgtatcctaacattattttctccatggccctcatcattacctgctgatatactgtatgtttgtctatatgtcatctaacacccctcacactggaacacaatgcccgtgggcagagactttgctagccttggttccagagcctagaacagtgcctggcaagtaggagacacccagcattacctttctaagtgaaccagtagagatggggggagaccgcaaggctatgccggcagacctgagggagtcctgtctgcatgcgctgcaggatgacctgaggggaactccttggacttctgtgccctctttatctgtaaggtggccacctgatcccttccagcgtaggcatgaagtagcctaatgaagagcattcaggcttgggtatcagtctcaggatcctgggggccttagaatttgtggcgcttggggacaccttgtgatcgtgcaatttctgttgtctagttcatccatggctggttgatcatgtcttcactgatgctgctgttcctcttcacctatatctaccttgggtaagtgacagataagcagcagggtccctgggagcccctctccatgtggcacaagtggacatgggcatgaggacctgggcggggaaagatgaccatcgagctccagtcttccccagtgccagccgttttgggaacccaggcctccgtcgccctctctcatggccttgacacaggggagtggaagtggggctgcatggtggaccacatgtttctgtctcgttcctgatttaaaatgaacccttcatggagaaggctctctgtgaaccccagggggatagaaaccccccaaaatttacattctgatttttaggctaggcctgggtactttctggtttgtgggaaaaattatctgttctatcgccccttgatttgggatatcagcctgacccaggggcccaaagagactgggaggacaagagaaaacactttcccaaggacctttccatgtgcacagggtcttccaggtcatgcccatgcacatttctgtgatctgttccaagcatccccaccttgttttagaaaatgctgcaaatggtaaattgtaaggacagtgaaggtcggggaaggaaatgttagtaaagagggccaggttgggactgaatggtggtaaactgctaggctgtaatgcctccactgagtcccagtcacaggctccaccttggtcctgcagggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatggtaggtgggcagcaaggctggtgggggcagtgggggcgatgtccagggccaaatcgtccccagtgctgcacaaggagggcaggtgctgaagggcttgcatccctttctgcagaggcctgggtgggatccctcctgagagagtcgcctttgtaaaacagaggggggtccactatttctggaacactcctggtggtctagataaaacgcagtagtcactgagctcctcatttactttttttttttttgagatggagtcttgctctgtcgcccaggctggagtgtagtggcgccatcttggctgactgcaacctccgcctcccgggttcaagtgattctcctgcctcagcctcctgagtagataggattataggcatgtgccaccacgctgggctaatttttgtatttttagtagagatggggtttcaccatgttggccaggctgatctcgaactcctgaccttgtgatcggcccgcctcagcctcccaaagtactgggattacaggcatgagccactacacccagcctcattttccattattactgctatgctgattgagcaagtgcactgttaagcactggacacgctgtaagtgatttgttcatcaagacagtcctttgggtaccatgcatatacataaccccaaatgttagctgctatttgatattagcatgattatcattgccagtattgttacttccattttaaggttaaagaattggaggctcagagaagtgggactccccagcctggccaccgcgtctcgggtgcacagctcctccatgcttgcagttgcctgcgaggccctactctggctcacaccagggcctgctctaagttgtgactggagaatgagaatttgggatgccagcccagaggcaaggcatgctctgagagctccacccggggctcctgtgctacagggcaggctcttcttcagggggctgcccggggatagtttgacaaggatgtctctgtcttcctagatctcgtggctgtgctgtgtcccaaagggcctctgagaatgctggtagaaactgcccaggagagaaatgagcccatattccctgccctgatatactcatgtgagtgagccccccgtgcctctgcctgactcggggtcagcaggcagcctgtggggggacaggggcctgcttcctggccgtggctttcagagttgactgggcgatcccaggagggtctccactttcagaagccagggagggcagtatcttgttattacacagtaagaagcttagaaagttaggacaggaagcaggcatctgctgggatgtgctgcagtccctgacttcatcccgtccatcctccagcggcatgctgcggtgcaggttgcattcctgtgatcccgcagccacccctcagctctccaggctcttgagaagggactttggagagggattcttcagggcagggggtcggggagcaaggagcttctgggcttccttgacagcagcgtggctgattggcattaatcctaactgaagggaaggcacacgggatggcccctggcctcggggtcaatgtgtagagatttggacttacacatgcagtcaacaaaggcacatcaagtccccattttgtgacaggcactgtgctaggcattgggggacccagcaggaaagaagaccacagggtcccaggcctcatggagctcacggccctgtgattgtgatgccctcggtctgttgatggcggggcttaaatagcctgaatttctggagctctggcgtctgcaaggtggcctgggaaagagtttatggaacagctacagagttctaggtaccttcatgcagttgaggattcgagcccgtagaggagaattgcctgcagcgtggccccacgggaaagcacattccaggcgcattccgaggatgagcggagaccatgtatggaaaggtagtgccaggactgtcatgagtgtcccagggctcgggggattcacccgtgaactgtgaggtcttggctctgatagacctggttcttatgctttaggaggggagacaaacagtaacagaatagacaaatgcaagagagagtgactctggacccctcccacaacggcctcctaacaatggagcatgagcagatacctgcaggatggagggtcctgtgcaggctttctgggacgcagactggccacctcccccaggccctgcaggcagccactgttagcaccgcctgagacgtgaaccttttctcctcccccagctgccatggtgtggacggttggcatggcgaagctggacccctcctctcagggtgccctccagctcccctacgacccggagatgggtgagtatcttggggagctaacagcctctcatcactggggggcagctccctacctgcacccagctctgctcggcctggcttccctgagaggcatgagttcaggaggggcagagggaaaggtccgttgaaaaccagccggacacatgcggcttgaagattcagcaagtgttggaccctcggtcctctgccagcctctgttgcatcgttctgctgggcgtgggtgggtggagtgggggaagccctggtgtcaggtgctggtgctcagggggaccccttcttggagctttgttccctggtaacactctgaccagctgttgtttctctctcttgttgtcccctcctcacggtgatgacggacatcttctcttcctggacacccagaagaagactcctatgacagttttggggagccttcataccccgaagtctttgagcctcccttgactggctacccaggggaggagctggaggaagaggaggaaagtaaggtgcccatgttcacacggcctgcttcagcctacggcgggagcggagacagagggtggaggctccctgcagcctgggtggaggagggcatgaggggaggggccccttttcccatcagaggcatctctgtgaaagtagaagatgcctgcagcgctggggtcttctcagcaggccccatgtagttgtccggcatgtattgagtatgggccacgtgcccgtgctgtgctgggtgaggcccagccctggtgggacccacaggctaaggagacacgggcagtaatcacatagactgagaagccaaggactatgaagggggccatggggttggggaggggcggcaggagagcatgccacggggcttcttgacctggttggcaggggtgagagaaagtcagctgaggaagtaactgctgagctgagctctgaaggttgagtcacagcagtcactagaggagaggagcacagggtggggagcatttcctgacagacagactcaggaatcagaggaagccggggcgggatgcagagagcagaagtgtgggagagccttgcaaacaggcctggagacatgcgaagataggagttcatcctggcgtcagtacacggtgcctgcctaacacccaatgccagcccactgctgcgtgccaggcagcaccctggagcagggagatgctgcactgtcgtaacagcccctgccttgagaggtgccttacgggagcagcctggtgacagtggcttggcatacaggactccagtgacacgggaggggcaagctagggaaagatcactctgcggtgggtctggaaggaggagcaggtgcgcaccctccaggcaggcttgggggaggtatttattccaaggccaactggtgtgctgcagaccaggagttagcacagatcccacggggcccgcaggactggcctccctccagacaccagccacaagctctagagggtctagatgccacttgtgcttctgaccggctgcaaatttagggctcccatgacccccttaggttcaataacttgctagaatgactcacagaactcaggaaagcactacacttaaaattgcagtttgttttttgttgtcgttttgttttggagacagggtctcgctctgttgcccaggctggagtgcagtagcacgattgtggctcactgcaaccttgacttcctgggctcaagtgatcctcccaccttggcctcctgagtagctgggattacaggcacgtgctaccacacctggctcatttatatttttagtagagacaaggttttgacttgttgcccgggctggtttcgaactcctgggctcaagtgatccacctgccttggccttccaaagtactgggattataggtctgagccacagcacctggccaaaattagttttattataagagatgcaactcaggaccagccaaatgaagagacagtgaagaagtaatgctgatggatcacacctggtgggggaaggaggacagctggggccaggagcaggagggacacctgcagggctggaagggcaggggaggtgggcctccatggtttgtgtttattgcataaccatttttattgtctacagtgagcaaagttatcctataaacaagtgtcagggaccattgcactaaagaaaacaaatgagagcattttggaagctctaatttcctgatcagtaatgggtagactaattcccagttatatttacctgttgtaaggtgaaaggttcttcagaggacctctgtcttggtgttatatgggcttttgaatgtactgaaattaaattccctaaaaatctgtgattcagacttcatactaaattgtacagcagtgcccagcccaaggccttgcatttctatttgttgttttctttactctctaagtgcccaacactggttttacctgagtttcagaactgcccgcttttctctgcccaggttgtaagtcacccagtccacaggtgtcccctgctttcccactggccactgatttggggaggcagctgtccatgtccccagtccacatcttagcttctagaggccaggtggggtgggctgggctgggcaagagcagctgggccttctgggccagagtttctcttctttttccattctgtgcacgcctcttcagtacgggttactgtctctcctcacacagggggcgtgaagcttggcctcggggacttcatcttctacagtgtgctggtgggcaaggcggctgccacgggcagcggggactggaataccacgctggcctgcttcgtggccatcctcattgtgagtggctggggatgcgtccagctgcctcgtggtgggggcccccagggtcctcattgtggtgggggcaggtctcaggatccctagggatttttcatttcttctcttccctctgagggacaagagcagggagcggggctggaagggtcagcttgagaccaaggctcacaggaggtgtgctcgcccctaggtgggctccagcctgtggaggacagtgcaggggagggtgaggagtgtaccggccccagcgtggctgagcacacagcctccaggccgaggacccagctgacagctttgcgcagtgatgataccctcgaggtggttgtgatgacatcagatttgcagaaaagaaaattgcttaagggccttgcccatgggcgcaaagctagtgaggaccatgttttccccctcctccatgccattgggacaccacagggtctgaatctggggcactaggggtggccccgttactgtgaaccacagcagtgaaatgtggaggccctgtagtcagttaacgtgaccagatacacataatggggagacgtcctgccgtgacttcatctcagagatttcgctgtcacgttagaggaggaggagcgtctgagccgtgcgcttggcatctgccccttagtgaaaaccctgggcatggcatgattaaggttgatgctccagtgtccagaaggttttctttttgcccacaagtatatcagggatgggatggtggacccaggctcctccaccaccagactgccttacctgagccctgctggccccaaagatatagaaggcaccctggttccctgtgctcacctggaccactgcctgcatcagctgggtcaggggaggatgggcagcccccacacctgcttcccaggggcaggttgcctggcggctctgattcccttggtgccagctgctgagaaccttactgccatttcagttgagcccacctagctctcatataaatacatgttccctgagggcatcttaccatcccatgtgaccactccagccagacaggggaggcagcacggcctcggggcacagcactgctccaggagtcaggaggcctgccttctggttcactcactaacaggtgaggtgatctaatgggggtgagaacttctgcccttaacacctcaagagctgttgcaggaccagggaagataatggggtgtctagcgccgttatccgactggtcctcgaacaagctcctgtgcccagggactagaccatgactcacagctcctgtccacaccagggatcaccacgctcaccctcccctccatgtcctgcagggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctgagggacatggtgtgccacaggctgcaagctgcagggaattttcattggatgcagttgtatagttttacactctagtgccatatatttttaagacttttctttccttaaaaaataaagtacgtgtttacttggtgaggaggaggcagaaccagctctttggtgccagctgtttcatcaccagactttggctcccgctttggggagcgcctcgcttcacggacaggaagcacagcaggtttatccagatgaactgagaaggtcagattagggcggggagaagagcatccggcatgagggctgagatgcgcaaagagtgtgctcgggagtggcccctggcacctgggtgctctggctggagaggaaaagccagttccctacgaggagtgttcccaatgctttgtccatgatgtccttgttattttattgcctttagaaactgagtcctgttcttgttacggcagtcacactgctgggaagtggcttaatagtaatatcaataaatagatgagtcctgttagaatcttggagtttggtccgttgtaaatgttgacccctctccctgcatcttgggcacccctgggataacttgtgctgtgagcccaggatggaggcagtttgccctgtttgaaggaacttttaatgatctcgcctctctgcacacatttctttaactagaaagtttcctaagcaaaggagttaggagagcagggtggcctgacatctgccagccctgagctgtaaggctgtggatgctgagcaggtccctggactcagttgtgcacggtggcacagacactgccaggtggttgccaaaacatccagtggttccttcagcaagtgttcaccctctgcagaagcctgtgagggcctgagctcagaaaccactctcctttccttctctggctttggccctgggcactgtggtgggagagtggacagtttggctttgccttctctgtacatcaatcatgggttgcaaagagaatctcagaagtgcctcttcctgagcacagtggctcacacctgtaatcccaatacttcgggaggtcgagtcggaaggatcacttgagcccaggagtttgagaccagccggggcaacatagtgagactttgtacaaaaaaaaatttaaaaattagccaagcatggtggcatgcatctgtagtctcagctactctggaggctgaggtgggaggatcacttaagcccaggaggctgaggctgcaatgagccgagatcaagcaggtgttaggtatatcagacagctgagaagacgcaagtgtgccctggggttcaaactggtacccctgtctccctgttccaggaataacatgagtgccgggacaatgcatctttattatgagaggaatgagaattgtgtatcttgacatttgacaggagcttgctttcccccaggctgtttgaggaagggcagaggaaaatgtggtgccctaagaaggaaggacagaggaggccgaacactggcgggtggaatcccactgattagtagtgcaggtcagagacctgggatggggggcattgccgtcatggaagccacagcggggagcgggtaaagcagacagggatggtccctgatggtgacaactcgcaagaggttaaggggaaagaaaaactgaaaagcttattcaatttggcaattatggcagtgtttatcttcagaagagcagttttagggtggggtttccaaagatgggattggacatatattttgaatcattaagcttgaggtctttcaaaggcctggccaagggttgctgggtggagaccacattcagaggtaaaggcagaaattgggggcccttaagtagacagcgagggaggaagaaatgaaggggcctggtgatggttagggtgaagtgttaagactgagaaaacaaggacatgtgagaagacgagggaagagcattggagagaacaaagacactggaggagatgctacttggaggtccccagagagcagggagacaaatgaacccagaacacaaatggcaaagaagaaaaatgagagaatttgtaaaagacagcattcgaacatgccgaacaagagcagggtactggtgttcaaacacctgtatctcccccgtgtaacccgtcaactaatatctttccatatttgctccagatttgtctttagaaataaaacccacgttctgaagtcctgtttgtatgtggccccagtcctgttgcctccgcctcctgtcctgaagtcgatttctgcccttctcatctatggttagttttgttttgtatgttggcatgttttcttaactttacagaaatggtatcatactgtacatatttgataattttttaaaatattgcattctggaggcatgtataaatgtagctccagttcatttattttatttattttttgagatggagttttgctcttgtcacccaggctagagtgcaatggcgtgatgttggctcactgcaacctctgcctcctgggttcaagcaattctcctgtctcaatttcctgagtagctgggattaca

SEQ ID NO: 11813 - DNA, 15384 bp, Human
tttttttctaatcagttgtcttttttggaatttttcttctcttttcttgttttttttttgggtcttgacatctttatgaacacagaaagaccagtgctaacaagtaaagagaaaaacgaggcttttaccactactcgttcaggtctgctgacagtacatttttagatagacctcctattttgaaaggctgtagatatagaatattagcttgacttgagctctgaaaacctacagaatatggaaattaaaatgatccccatttactgttaccatcatttagatagggtaagatgcagagatggggaatgtatacaatcacccagaagaaatgtcaaaatgaagagcaggaatataggataccacatacatctccttctgttgcatttggaaacaaatttcttttcttttctttttctttttttctttttttttgagatggagtcttgctctgtcgcccaggctggagtgcaatggtgtgatttcagctcactgcaacctctgcctcctgggttcaagcgattctcttgcatcaggctccccagtagctgggattacaggcatgcgccactacaccccggctaatttttgtatttttagtagagacagggtttcaccatattggccacgctggtctggaactcctgacctcaggtgatccacccacctcagcctcccaaagtgctgggattacaggcatgagccatcatgcctggcctagagacaagtttctttaaactgtattcttgttactataaaggtgaaaaaaagggaaattgaaaaaaactttaaaatcctgaaaataataatgaaggatataaaaattatcccaaatcctgccatccagagttagtcactgttaacattgtggaagaatttttattctttgcacattaacatttcaaaaattttaaacaaaattttgaccaattaaatatatatatatagttttccgttttattttttttcttttcttttctttttttttttttttttttaagacagagtttcactcgtttcccaggctggagtgcactggcgtgatcttggctcactgcaacctccacttcccgggttcaagcgattctcctgcctcagcctcccgagtagctgggattacaggcatgcgccaccatgcccagctaattttgtatttttagtagagatggcgtttctccatgttggtcaggctggtcttgaactcccggcctcaggtgatccgcctgcctcggcctcccaaagtggtgggattacaggcgtgagccactgtgcctggcctcctttttatttttttcactgaacaaaccatgaaactttcccagatgtaaatatctatttcccatttttctttttttaaaataaggcattattttaaccatttgagtgttagatattatttttagataatattttaatttaggcataactgccgtgcaaaatctgaagattaatatctaccttgtgagtcattcctctgtgagacagtgcatgttaaatatgttgaattggcaggtgaaaaaggaagaaaaaatgagtagtgattggttatccacagctatgaatgagaaattgaaggtagtagactatggatgacaaacctattcttggtttccttctgtttctgaaattctaattactaccacaactacatgagagacactactaacaagcaaagttttacaactttttaaagacatagactttatgttattataattaaaaatcatgcatttttgtcatattaataaaattgcatatacgatataaaggcatggacaaaggtgaagtagcttcaagagacagagtttctgacatcattgtaattttaagcatcgtggatattcccgggaaagtttttggatgccattggggatttcctctttactggatgtggacaatatcctcctattattcacaggaagcaatccctcctataaaagggcctcagccgaagtagtgttcagctgttcttggctgacttcacatcaaaactcctatactgacctgagacagaggcagcagtgatacccacctgagagatcctgtgtttgaacaactgcttcccaaaacggtaagtgcagaacgctttataagggcagcctcgggccatgaaacacagatatgcaaaaggccttctaataaaaaccacatctgtacaagctcttattgtattgtagctaaaacctgtcttttctctttgacctaaataatgaaagtcttaaaatttgtttatttatttgattaaactctgaaataaagattattgcactagtgtcctttgcccaaaatcttaggatgctgccttaaacatcatggtagaataatgtaactagctacccacgatttccttctttaattcattttgtgttttatctccccaggaaagtatttcaagcctaaacctttgggtgaaaagaactcttgaagtcatgattgcttcacagtttctctcagctctcactttgggtaagtcagtgccattagaccaagatttctcattctcgcactatagatatttcagactgaaatatccttgcttgtctggggctgtcctgcacaggatatctggcagcatccttgacctctacctgcaatgtgttcttccctgggcttggggtcatttactttacctcttggtgtctccctttccttaagtgtaaagtgtggatcataatgacctatttcccagatgcattgtgaggattcaatagcatggttcatggaaagtacctcatacagtgcttcttggtgcatactaagtgctcaataaagcttagttattctgattattattctactacaaaatgggtatactataatgttgtgagtgagtgtggataaggtacctagtgggtggcagtcacaaaagagataaacaataagtcgctgtttcttcatacgtacttcttacttttgaaaagatgagaaaagtctgggccatgtcacaaacattgccaaaaataagacaataaaaagcacagttgtcagagttaaaccacaacagtaccaaactctaccatttcttttctttttctcccactagtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacaggtagggagtttgcggcagcagtgggaggtagtttcagtgtgtgggcatcttggcaaatttacagcatgcaaaaactgctctctattgtggtcattttatgttccaaaagattctgtttaactgctaaagtttctctcttttgctgttttgtgtgaatgtgggcaagaatatgtggatatgtatatatatacacacacacacatatatacacacacacatatatgtgtgtgtgtatatatatatagcctacagcatttatatacattttatatatatacatacacacatatacacacatatatgtgtgtatgtatatatataaaatatatataaatactgtaggcaaatatgtagttctttacatataaaaatgcacacacacaatacatattttaattacttgtttatttgtggtaggggaactgtcttcagagtttgtgaagaagtaaattttctacggtaggtgccagccacagctatacattagcatcaaggtttaggataggtgggcctgaaactcagatttggaactttgtaaaacacttcagttaaagtctatggcactctgtaggactgctgatgtctctgttgcacactgttgattctaaaatcaaaggcactcagtataagcacagtaatagtcctcctcatcatgctttgtattttccgtagctgcctgtaccaatacatcctgcagtggccacggtgaatgtgtagagaccatcaataattacacttgcaagtgtgaccctggcttcagtggactcaagtgtgagcaaagtaagtctggttcttgcctctttcttcacttgagatggtagcaccatctcacgtcctagctggcattagagtcaggtctgcatgccttcccttccctggtgcagatggtgtcatatggtgatcgtgagctgagactatgaagtcagaccctgctgggtttgagtcctagattcaccagttatttattttggcaccttgacaagatagtttaactctctatgtcagttttctcattgtaaaatgaggataataatagtgtgaacttcataggctcatggttacatggtgcctggcacacaggacacattcaataaactgtaattctgtgtccctgcgaggaacatgtactcacctcatctaggtggtaacaagacgttgcagtagaaatgagtgagttacagagtccagggtatcttggttcatgctctggcctctggctctgtaatgactagccgtgtagcatggagcaagtcgcttgaatgaaatgaggtctcagttcctaaatttgtacattaagagagttagatgagcttctctccaagattccttagcacagcgttgtgcagtagagcttttgtgataatggaaatgttccatagctgtgttttccagtgtgtacctatgagccacatgtggttattgagtacttgaaatgtggctggtgacactgaggaactgaattttaaatgttatttgatttcaacgaattcaagtagccacagatagtggctactatagtagacagtgcagcattagggttttaaaatttgtaatgtattctagtacttaaatttgaaatatagctttgtgaatggttctcatcctggttggaagcttactgtagtatttttagcagttgtgagaaaagtaacaagaaatttgttgtggtacctaagtttgctgtgtttgttcatataatttgaacagttttgaggtaaacacaattacactactctccccatatcactcaatatttcttttttatggttgtcatcactgcttttttgttgttgttgttatggatcagcattttcttgaataaaagaaaaggggtagaattacagtcaattttacaaattccattagaaattttataaatttttaaactaaaaaaaaaaaaaaccaaactgtagttctagttttcagtgttcttatctgttaaaggtgagagatgagcagaactgatttgggtttctttttcagttgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatggtaaatccctctgagaatgcacagaacgttctgtaactcatccctcattgcttctgttttttgattcaacttacattttcaaaacttcagggaaagttttttttttgtttttgtttttaatacaatttgttctctcagccaatgtatattgccaacccagtacctgcttgggttgagagaggtttttttattctatgcttgaaatgggtgtttctgaggctctggtgatttgtaagggagaccataaaacaataaagctctagaaatctcaatggatttctcatcttgtttccctgtttaacttttccaagccatgggactaacttaagaccatgatagtcaagcagtcttagtatctctttttctctcttaattttatctttctgaaccagaggccaaaaaaagaaaaatcagttcttcaggctctgatgggctaaaataaatgaatagcctacgtatgtcagtactagtcataactcctaatctggaatctattttttttaaatttttacctcacgtaaatgataacatagattagagaccactcagcataggcaaagtggaaatcagaaaagatagaatatccatgaaaaagaataaaagcttttattctggctgtgcatgtccctaagaattgacataggactttggaatctaccctttgaaggcagcttcctcactctgttaggcacccagctcaataggaagtgaaaagatcattcttctgtaaaattcatggtgctctttcaaatcctcagtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaaggtagagttgttccacatggagacttactgtgaacattctttctctcaacccatactggaaatgggcaagctaattctaggccgtgctaatatcaatgcgtatatttgttacagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaaggtaagcttgagatccttcgatttatactttcttaaagaacaaccatcttcaaacttggacagtgaaaaaaaaaaccaatacccactttaactatagaaatcagatttgatgagcaaccctcgtatctttgagattcatttaaaagaactaatgtttggccagggaaaggatcatatgtgttaagaatgaattctttgctgtttttttttaactgtgatgtgctgataaaactttgtagacattagcatggaatagacagaattcttaatctaaaggaatcatattagaaaattcggaaagcagaataatgagaacatgatttgaatgtaaaactctcatcacacctgtcttctgaaatggctcataattagcagtgatgagactgtttcaagcatggtgtcagctacagagatagtattgatgcatatataagcagtaaattttaattcactttaaagtgagagcaaggatattgaaaacaagcagtttttactatcaggcactggccttgtcctagccaaagccagcacagaatgatttccagtagcaaaacataacacaaaaaccaaactgcaaaacagacaaattttataggggtgctttcttttctttctttttggcaccatctataaacatccatgacccatatgttgtcctcagactgcgtgaaatctttccttggaccataatttattttgtgtgttagaagaacagtgctcaggaactaatgttctgattaattagtcttttaattagtgccatgatcagtgagggggctgaaattcaaagaaaacacagccatcttcccatttgtccagggaattataaagaatcttcagttctccaagtgttgcttgaatgaactgggttcactcaacaaacgccaagtactctctagttccactgcaatattttctgaccatcattttgatgtctcagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaaggtacagtctttgtttttattttattttaagataaaaagaactattgaagagcttgggaacttggttaccttgggaaacgtattgctggagatgcaaacaaacttctaaagtgctctctcgtgtgttccagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaaggtagaattgagtgcagacttttttagggtacaggtcaaatacttcataaagtttctgaacctagattgccccaaaggggtttggtcctaatttcctacatgctgaaaactaagtagcgcttacactttacattcattgttgacttttaagcaagttttggaagttttccagtagatttttctgaaactctgcctgtgtacctaacatttgcagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaaggtgatgcattgattgatggtggttgtctggtgattaaaaagaaaaagggggagctatcttgttacagtaatcaactattcattatatccaaaccagaaagttcgcccaggttgacaagttgtgaatattaagttgtatggggatagagaaaaaacagaagttgcatgttgatggaaagggtagaattctgacaactggaaaaaggagacagagagaggagaggagaaaggggaaatggaaaacaagagggagtgagagcaagagagcaagcaagtgcagtgtttattaaccaaggtgtggtgtggtattgtgaacgagcttggcaagttagagttctgcctgccaatggtggaaatagcttcaaaggtggcttggagcagatctcaaaggcctgtaatgccacatctctgcttcttgtattaaactagatagctcttctgctcctagtaatgaatgtacagaaaaaaggccaaagggacaggacggagagactttaacatcaattcttcctcatgacctttcttcgtctcttacttccttagctcccactgagtccaacattcccttggtagctggactttctgctgctggactctccctcctgacattagcaccatttctcctctggcttcggaaatgcttacggaaaggtgaggaagtttatgaatgtacttcaaaaatgtttttgaaaatacatttctttctcattgataagtcatggtcttgcttactgatttaaacaataattagaatctggataaaatgcagtataattaagcagaagtattaagaaaagagttagtagtacaactcagtgtgggaagtgtttcaggaaataaaaatgttagtcgtgcctaatattgtacaactccagggggtgctattcatgttgaattatatgatgcctcccggaattgtgcaatggaactgccatgatgagcactctaaggaaaatggataaaattcttcctaaggagatttatttggagtacaggcttaaatttgagagtctctcataaggaatatggaagcacatctgactacactcatggtttgtttggcttacatgtttaagagtacttaaaacatttttgagttaagttctgacgtttacaaaataggaaatctcacatttaaattaagactttggacttctcatgaaaaattgggagctgaattgggcaagatgaccccgtagctatttgctggcattaggaagctgctatgccctttggatggctgtgcactttgcattttaccctagatgccacagagccatgcttgtgctctgattattacagaggccctgaagcatcgagtttgcaacacttgatgaattaagtcatattgtatctggatttaatatatccttaaaagtcatttagtctgaattaatggttgtttgtcttttcttttgcagcaaagaaatttgttcctgccaggtaagttgcattcttatacaaagcatgccattgaacattccacatatttttctctcttcatgttggaagacagtgctttacctagtgttctcatgtattccacagcagctgccaaagccttgaatcagatggaagctaccaaaagccttcttacatcctttaagttcaaaagaatcaggtaagacttgtaaatcacaaatggttatgagagaggtatcttctctacatgctctgtttctccttgaaccctccaaacttgccaatatcttagggagggagcaggggagaaatcatcacctgggtattgttctggaaagttgctttattttttgtagaaggagaggaaagaaacggatctagctttattgtgtaatttcatttatgatagataataataatgaagatagctgacccttacattgcacttattatattctgggaatttttctaagctaggaactctgagataggggctggtactatatttcttatcttttctttttactttttttttttttaattttgagatggagtctcattctgttgcctagactggagtgcagtggcatgatcttggctcactgcaacctccacctcctgcgttcaagcaattctcctgcctcagcctcctgagtagctgggattacaggtgcctgccaccacacccagctaatttttgtatttttagtagagattttgtattttttcgtcatgttggccaggctgatcttgaactcctgatccacccgccttggcctctcaaagtgctgggattacaggcgtgagccactgggcctggcctgttactttatttcttatcacacagatgaagaaaatgagacagagaagttaagtaaattgtctgaaatctcaaagctagtaagtggtgtagccaggattcaaactctggcagtctggttctaaaatttgtgttcttaactactccgacctgctttgagagaatttggaaaggtcaagtccctctgaatactttttaaaaaattaaaataactttttttgtgtgtgcggttttaagtttacagaaaaattgagcagaaagcacaaagagttccaacatatctccccaccaccccttcaattccccctgttattaacatcttatattagtgttacaactgatgggccaatattgatacattattattcattaatgtccacaggctacattagaattcactctgtgctgtgttgtatattctgtaggttttgacagaggtataatatgtagacatcatcactgtcctaactgaatagaattcgatgttcctacatggtctatcctagtgagagtgtctgtgttagaaggtacattttgttgtcatgatcagtatgcagaatattaagtgttctgatgacatgcatgtttatatttacagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgtttatctctgtgttaagtctctttcttagaaattttatttagataaaactcactttccataaaacgcaccctttaaaaatgtatgtgattgtacagctatcaccattgtttaactccagaagatttctatcaccctgataaaacattatttctcagtgtgtctgtgagagtatttccaaagagattagtatttaattggtagactaagaggattgccttcaccaatgtgggtggccatgatccaacccattgaggccctatgtagagcaaaaagagtgaattcactgtctttttaagctgggacacccatcttctcctgccttccaacactggcactcttggttctagggcctttggactttgaagtattccactggctttcctggttctcagctcgtagacagcaggccatgggacttctcagcttccataattgtgtgagacaatttctataaaaaataccacacccccacaccccaacacacacacgcacacacgcacacacacacacacacaccattggttctgtttctctggagaactccaactaatacatgtcccttcacgagaactggctacttacactaggtctcctctttaatgccctcataatccatatgtctcttccttcctttaattgtaataaataattatagattattacttgcacaattgtttgtttaatgtctgtcttccccactaaactctaagttccttaggggtagggaaaaattaccttgttcattgctgtattcccagaacctagcacattcctgatacagagtggacatccaacaaatatttattgaatgaataaatcaatgcatgggtgaatgaatgcatattttggctcataataagaagtagaatcacttttcacaaatggaatgagtggtctcagaaggctagactttaaaacctagttatgtatcaactgcccccactactgccagtttgcaatttaatatatctatctctcaaaagtccagcaattatttcaatccccatttacagaaatggggcttgtaggaatcattgtgagggctaaaggtcaatagaaataaaagggaaaaaattttttaaaaaaggaggtgtaaaaatagcacaagaggaagtaataagagagaaaaaggaaagatactaaaagaaaaaatattgagatgcatagagtaaacagtacagatgctacagaagggaaagatctagttttgtattcactcacctgggagcttaaaacatccacacaagtgctgggcatggtgactcacgcctgtaatcccagcactttgggaggtggaggcgggtggatcacgaggtcaagagatcaagaccatcctggccaacatggcgaaaccccaactctactaaaaatacaaaaattagctgggcatagtggtgcgtgcctatagtcccagctactcaagaggctgaggcagaagaatcgcttgagcctgggaggcggagtttgcagtgagcagagatcacgccactgcactccagcctggcgacagagcgagactctgtctcagaaaaaaaaaaaaaaaaaaaaaaaatccacacaagcgtacatgctaatgtgcacacacatacacagagagatatattcctaaaccctaacccacaggtaatttgccctgaagataatgaaaattaagcttcagggcccattacttagataaacctttaaattacaagggcctgggtcctaggaatgtgtttacatggtaatacatctttgtaagatctataaaagcaagacgcttttacgttccttttctcaaagagagacctcaaattatataaaccttggaccctgaaaaactcctgaatgttcctgaaccaacccaaaatattctgattcagtaggattgggagcgaatgttgcgtgtatatttttttgtttttttaatgttaccaagtgatttggatgcacaaccaggtttggaaattactgaaaaaggactataggctgattagtttaaagtgtccctgatgtctatgtg

SEQ ID NO: 11814 - DNA, 29927 bp, Human
  misc_feature (1)...(29927): n = A,T,C or G
gaggaggtcccagttttctggtgggggtgggcgtggagtagggggcggggaagggatgagggccttaggttctgcactgaagagggctggaggccccagagggccccgtacaaatgccgctctgcaattaagagctctgggcgtgaaatttgatttaaagtaaatacatcaggttccagagagcggagcttcgttggagctaaaactgaaaaaatataatcaaagccatacttttcgggagttaaagaaatcaagtgttcagtatttgaaggttcacggcttctattccccttggtgctgcaaatgacagagagagagagaaaggagagagagaaagaaaagagaagagagagagagagagaagacagaaagacagagacagagaagagagagaaaagacagagagaagagagaggacagagagaaagagagagagagaaagacagagagagagagagaagacagagagagaaagaaaagagaagagagagagaaagaagacagaaagacagagagagagaagagagaaagagagaggagagaagagagagaggagagagagaagacagacagagaagagagagaaaagagagagagaagagagagaagagagaggacagagagaaagagagagaggagagagagaaagacagagacagaagagagagaaagagagaagacagagagaaagagagagaggagagagagaaagacagagagagagaagatagagagagagaagacagagagaagacagagagagagagagaaagacagagagagagaagagagagaaagacagagagagagaagacagggagagagaaagagagcgagaagagagagagaaagacagggagagagagaagacagagagagagagaaagagagagaagacagagagaggagagagagaagacagaaagacacagagagagagaagacagagagagagaaaaagtcagagagagaagacagagagagagaaaaagacagacagagaagacagagagagagaaaaagacagagagaagacagagagaaagagagagaagagagagagaagacagagacagaaagcgagagaaagacagagagagaaagtcagagagaagagagagagagagcaaatgacttattccttaaaacgtacctaattcacatagaaaaagccagattatttgataaagtgggccagtctcagagttccttcctcttcgcagccatcctaagcgcgttcctcgagtttccccccagcaggtgcgttctagaaagcgctggtcaggacgcatggctgccccatagatttcttggggacgggagtgagagacgcctggacgcccaagcgcaagcctccagcctccaaggtcctacaacagatacagcagctactgagtctcctctctggtttcttttccgcccctggggagagaaaagagaaggggagaaacgtcaccaccagcaactgctcccagccagcaagacgcacggcggggaggccggggctggccgcgtcctgcagctcctgagctgcgtgtctgagcttttcccagccccgcctgcgtctccaggggcgaaataagaagcaaatcttgctgggaccgagttcaggtcgaggaactccgggaccctctgcagcctcagccctgccgcgctccccgcagcttcgggcctgttgcggggagttggggaggaattcagggaaggggggaaccaggccgggataagaggctccggcttgctgtgggctgcatgacggggtgcaaaggcgaggagaagcccctgggatccttggctcgtctgctgcgggacccccagccccggcgggcggaccgcggagagcgctgtcccggatccggagattcgcttttcctttgcgactgcggggctggcgcgcgcgcgcgaggggtcagcaccctgggcattggggtcaatgcaaccagggcaggtccctggggggcccccaggagccaataggggtcttcgagtcaccctgcggccgcctgcttttgcccgggtcctgagaacaggggctccccacactttgttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggtgagctcggttttggaactttccttttcttttccagaaagctttgccttctttcctttcttcgttcgttccttccttccttcctctcttcctctttcttttctttctttctttctttctttctttctttctttctttcttttctttcttcctttcacttggcaagattggttttggagctttccttttcttttccagaaagctttgccttctttccttccttcgttctttccttccttccttcctctcttcctctttctttcttttctttctttctttctttctttctttctttctttctttcttcctttctttctttctttctttcttttctttctttcacttggcaagattgcttttggagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtctctctctctcctctactactactttctctgtctctgtctgtatctctatctctgtctctctttctctctgtctttgttcctctcttttttctctttctctgtatctctgtctatctctgtctctctttctctctctcctctctctctgtctctttttctctgtctctctctgtgtctctacctctgtctctctctctcctctctttttctctgtctctgtctgtatctctgtctatctctgtctctctctctcctctctctctttctctgtctctgtctgtatctctatctctgtctctctttctctctgtcttcgttcctctctctctttttctctttctctgtatctctgtctatctctgtctctctttctctctctcctctctctctgtctctttttctctgtctctctctgtgtctctacctctgtctctctttctctcctctctttctctgtctctgtctgtctctgtctctctctctcctctctctgtatctctgtctctgtctctttctctcctctactctgtatctctgtctctgtctctctttctctcctctctctctttttctctgtctctgtatctctgtctatctctgtctctctttctctctctcctctctctctgtctctttttctctgtctctctctgtgtctctacctctgtctctctttctctcctctctttttctctgtctctgtctgtatctctgtctgtctctgtctctctttctctcctctctctgtatctctgtctctgtctctctttctctcctctctctgtatctctgactctgtctctctttctctcctctctctctttttctctgtctctgtatctctgtctatctctgtctctctttctctctctcatctctctctgtctctttttctctgtctctctctgtgtctctacctctgtctctctttctctcctctctttttctctgtctctgtatctctatctctgtctctctttctctctctcctctctctctttttctgtctctgtctctctgtctgtctctgtctctctttgtctctctcctctctgtctctttttctctgtctctctctgtgtctctacctgtgtctctctttcctctctctttttctctctctgtctgtatctctgtctacctctgtctctctctctctcctctctctctgtctctttttctctgtctttctgtctctctatctctgtgactctttccctctctcctctctctctctttttctctctctccctgtctcagggaagcatcagtaaaacctccaacaagcacccccttgtacacagcccaggccaagagaggtgcagaccctgctttctgcctgcagccgcctgctgtaaaatgtcaatgcaaaacatttcatacagtccacccactctgcagactggagctgcggcctctcggacagcgtcttgaatttgcaacgaaaaacgtgtggggtagaaaaagctctcgtctggatttctaacatgttatcaagcactcaaacgctgggtgtttcctgcctgtctttaaagggaagggcagggagagaacgtaaaagctctggtcagagaagggaaaggtctttaggtgagaggggtgaggccgcctccgtgctcatcccacaggaagagttggagttttacagaaagatgagatctctttcgcgtagccagaaactcttaggaaaagcggggtgttggaaaggcagaaagtgtgccatgaatcggacgtgcgtgatttcaaagccacttgtctgcagtgagaattacaattggggcttcagttgaaaaagggcctttgctttttctccgaggccgaggggccttgaatagccacacagctcctgactggtgtccccatgctcattcctggaggctcggacaccctggtagagcggagtttcctactagacaaaggggtccagattgcggcccaagaaggaacctcaggtcggggaaagcctgggcctcacgggaccccccaggaaagcctggtccttggggttggagaagacagctgagctgggaggacggagggttttcggtagggagacagtgagcagctgtgagaggtttacggcgcagtccctggggacccagtttcccagcagaggcagagatggggaggcctttagaagcagaaaagttacccggcctctgaggacccagaaagttgctctaagccagagacccttctccgaatctccctctctgtctgtctctgcctctctccctctttctcttccccctccctgtctccctctctgtgtctctgcctctctttgtctctgtgtcccctgtctctctgcctctctttgtctctctctgtatctctatctgtgtctctctttttctctctccatctctctgtctctccgtttctctctttctctctccctctctctccctgtccgtgtcgctctttctctctctccatctcccagtctctccctttctctctctctccatctctccctgtctctctttctctgtctccatctctttctctgtctctccttgtctctctctttctctctctccatctctctctgtctctccctgtctgtttctctctctccatctgtctgtctctccctttctctctctctgtctctccctctctctccctgtctgtgtctctctttctctctctccatctctctctgtctctccctgtgtttctctctctccatctctctctgtctctccctgtctgtttctctctctccatctgtctgtctctctctttctctctctatctctccctctctctccctgtctgtgtctctctttctctctctccatctctctctgtctctccctgtctgtttctctctctccatctctctgtgtctccctttgtctctctctatctctccctctctctccctgtctgtgtctctctttctctctctccatctctctctgtctctccctgtgtttctctctctccatctctctccgtctatccctgtctgtctctttctctgtctccatctctctctgtctctccttgactctctttctctctgtctccatgtctcatgtctatccctgtctgtgactctctttctctctctccatctctctccgtctttccccctctgtctctttctctgtctccatccctctgtctctccctttctctctgtctttccttgtctctctctttctctctctctctccatctctctctctccctgtcatctctctctccatctccccgtctctccgtttctctctctgcctctccctgtctgtctctctctttctgtgtcttacacacaccccaacccaccgtcactcatgtccccccactgctgtgccatctcacacaagttcacagctcagctgtcatcctgggtcccccaggccccgccggggaggaagatgcgccgtggggttacgggaggaaggggactccgggcctcctggtgccccactttatttgcagaaggtccttggcaggaaccgtgacgcgtttggtttccaggacttggaaaacgaatttcaggtcgcgatggcgagcaccggcttcccctgaagcacattcaatagcgagaggcgggagggagcgagcaggagcatcccaccatgaaaaccaaaaacacaagtatttttttcacccggtaaataccccagacgccagggtgacagcgcggcgctaagggaggaggcctcgcgccggggtccgccgggatctggcgcgggcggaaagaatatagatctttacgaaccggatctcccggggacctgggcttctttctgcgggcgctggagacccgggaggcggccccggggatcctcggcctccgccgccgccgcctcccaagcgcccgcgtcccggtttggggacacccggccccttcttctcactttcggggattctccagccgcgttccatctcaccaactctccatccaagggcgcgccgccaccaacttggagctcatcttctcccaagatcgtgcgtccccggggcgcccgggtcccccccctcgccatctcaaccccggcgcgacccgggcgcttcctggaaagatccaggcgccgggctctgcgctcctcccgggagcgagggcggccggacgactgggaccctcctctctccagccgtgaactccttgtctctctgtctctctctgcaggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaaggtaagttcctttgcgcgccggctccaggggggccctcctggggttcggcgcctcctcgccacggagtcggccccgcgcgcccctcgctgtgcacatttgcagctcccgtctcgccagggtaaggcccgggccgtcaggctttgcctaagaaaggaaggaaggcaggagtggacccgaccggagacgcgggtggtgggtagcggggtgcggggggacccagggagggtcgcagcgggggccgcgcgcgtgggcaccgacacgggaaggtcccgggctggggtggatccgggtggctgtgcctgaagccgtagggcctgagatgtctttttcattttctttttctttcctttcctttttttgtttgtttgtttgtttgagacagagtctcgctctgtcccccaggctggagtgcagtggtgcgatctcggctcactgcaacctctgcctcctgggttcaagcgattctcctgcctcagcctccccagtagctgggattacaggcatgcaccaccacgcctggctaatttttgtgcttttagtaaagacggggattcaccatgttggccaggctggtctcgaactcctgacctcaggtgatccacccgcctcggcctcccaaagtgctgggatgacaggcgtgaggcaccgcgcccggcctgggtcctgacggcttaggatgtgtgtttctgtctctgcctgtctgccttgtatttacggtcacccagacgcacagaggagccgtctccacgcgccttcccagcgctcagcgcctgccgggcccccggagatcacgggaagactcgaggctgcgtggtaggagacgggaaggccccgggtcagctcggttctgtttcctttaaggaacccttcattattatttcattgttttcctttgaacgtcgaggcttgatcttggcgaaagctgttgggtccataaaaaccactcccgtgagcggaggtggccgggatctggatggggcgcgaggggccccggggaagctggcggcttcgcgggcgcgtcctaagtcaaggttgtcagagcgcagccggttgtgcgcggcccgggggagctcccctctggcccttcctcctgagacctcagtggtgggtcgtcccgtggtggaaatcggggagtaagaggctcagagagaagggctggccccggggatctctgtgcacacacgacaactgggcggcatacatcttaagaataaaatgggctggctgtgtcggggcacagctggagacggctatggacgcctgttatgttttcattacaaagacgcagagaatctagcctcggcttttgctgattcgcagagttgaggtgcgagggtgaatgccccaaaggtaattcttcctaagactctggggctacctgctctccggggccctgcatttggggtgtggagtggccccgggaaatagcccttgtattcgtaggaggcaccaggcagcttcccaaggccctgactttgtcgaagcagaaagctgtggctacggtttacaaagcagtccccggtttctgaccgtctaagaggcaggagcccagcctgcctttgacagtgagaggagttcctccctacacactgctgcgggcacccggcactgtaattcatacacagagagttggccttcctggacgcaaggctgggagccgcttgagggcctgcgtgtaatttaagagggttcgcagcgcccggcggccgcttctgtggggttgctttttggttgtccttcgcagacaccgttttgctcctctgaactctctcttctccccctggccgtggacccgggagagcaaagtgtcctccagaccttttgaaagtgagaggaaaataaagaccaggccaaagacccagggccacaggagaggagacagagagtccccgttacattttccccttggctgggtgcagaaagacccccgggccaggactgccacccaggctactatttattcatcagatccaagttaaatcgaggttggagggcaggggagagtctgaggttaccgtggaagcctggagtttttgggaacagcgtgtccccgccgagcctgggagcccgtgggttctgcaaagcctgcgggtgtttgaggactttgaagaccagtttgtcagttgggctcaattcctggggttcagacttagagaaatgaaggagggagagctggggtcgtctccaggaaacgattcacttggggggaaggaatggagtgttcttgcaggcacatgtctgttaggaggtgaaacagaatgtgaaatccacgttggagtaagcgtccagcgctgaatgtagctcggggtggggtgggagggccctggtgtggatcgtggaaggaagaaagacagaacagggtgctagtatttaccccgttccctgtagacaccctggatttgtcagctttgcaagcttcttggttgcagcggccttgcctgtgcccctttgagactgtttccagactaaacttccaaatgtcagccccttacccttgacagcaagggacatctcattagggcatcgcgtgcttctcatctgtgctcagcaggcccgagataggaacagaggggcgttggagatgccacttccaccagccctgggttgaaggggagcgagggagacaccttttacttaaacccctgagcttggtcagagaggctgaatgtctaaaatgaggaagaaaaggtttttcacctggaaacgcttgagggctgagtcttctgcccttctgactcccccagcaaatacagacaggtcaccaactactggagatgagaaagtgccatttttggcacactctggtggggtaggtgcccgaccgcgtgtgaaaaagtgggaaggagagatttctgcgcacgcggttcagcccccaggcgcggtggcgcattcaggtactcagacgcggttctgctgttctgctgagaaacaggcttcgggtaggggctcctagctccgccagatcgcggagggacccccagccctcctgcgctgcagcggtggggatagcgtctctccgtaggcctagaatctgcaacccgccccgggtcctccccgtgtccttcccgggcgtcccgccggggatcccacagttggcagctcttcctcaaattctttcccttaaaaataggatttgacaccccactctccttaaaaaaaaaaaataagaaaaaaaggttaggttatgtcaacagaggtgaagtggataattgaggaaacgattctgagatgaggccaagaaaacaacgctcgtgcaaagcccaggtttttgggaaagcagcgagtatcctcctcggcttttgccttatggaccccacgcagtttttgcgtcaaagcgcattggttttcgagggccccctttccaccgcgggatgcacgaaggggttcgccacgttgcgcaaaacctccccggcctcagccctgtgccctccgctccccacgcagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtaggaacccgggggcgggggcggggggcccggagccatcgcctggtcctcgggagcgcacagcacgcgtacagccacctgcgcccgggccgccgccgtccccttcccggagcgcggggaggttgggtgagggacgggctggggttcctggacttttggagacgcctgaggcctgtaggatgggttcattgcgtttgtttttcaccaacagcaaacaaatatatatacatatatattatacaaataacaaataaatatatatgttatacagatgggtatattgtatatattatagatatttgttcgtccttggtgcaaagacacccggtgaacccatatattggctcctgactgccttcggttcccctgggattggttataggggcaacacatgcaaacaaaactttccctggattatacttaggagacgaagctacagatgcgtttgatccagagtgttttacaagatttttcatttaaaaaaaaatgtgtcttttggcccctgattcccctccgtcttcccgtgtggctgcattgaaaaggtttccttaggatgaaaggagaggggtgtcctctgtccctaggtggagagaaacagggtcttctctttcctccgttttttcacctaccgtttctatctccctcctcccctctccagccctgtcctctgctacaaaccaccccctcctccctccggctgtggggagcgcaggagcacgttgggcatctggatgagcggagactattagcggggcacgggggctccccgaggagcgcgcgaattcacgctgccccatgagaccaggcaccggggggcggaggggccttgggtgtccgcagagggacgggcgggcagagccttcctccgcattctaaacattcacttaaaggtatgagtttatttcaggggtgctgctgggagagcctccaaatggcttcttccagcccctgcctgacagttcagctcccctggaaggtcaactcctctagtcctttctcctggttctgggcaggacagaagtggggggagggagagagagagagagagagagagagacggtcaggatccccggaccctggggaccccgtcaaaaataaatgaaattaagattgccgaccagagagagaaccgtgacaaagcaaacggcgttcaaagcaaagagacgaactgaaagcccgttcccgtaggactggttatgaggtcaacacattcaaacacagcttgctctggattttgctgagcagaggaagatacagatgcatttgatccaaagtgtgttacatctttcattatatgtgtgtctatatatataaacatatataaatatataaacatacataaatgtatgtaaatatatataatctatatacatatataaatatataaacacatatataatatataaatctataaacatatataatatataaacataaatatataaacatatataatatataaatatattaacatatataaaatatgtataaatatatataaacatataaacatatataaatatataaacatataaatatataaacatatataaatatatacaaacatattgtatatatataaatatatataaaaacatatatatacatataaaaatatatataaacatatatacatataaagaaatatatataaacatatatacatataaatatacatatataaacatatatatacataaaatatatataaacatatatacatataaaaatatatatatattaacatatatatacatataaaaatatatatattaacatatatatacatataaaaatatatatatatttttggcccctgattcccttcggttcctgtgggatgggtgattgagtcaacacattcaaacacaacttttccatcgatgttgcttaggagatgaggatacagatgcgtttgatggagagggttttacaagctctttcatttaaatatatatatatatatatatatattttttggctcctgattctcttccgtcttcccatgtggctgcattttaaaaggcttccctaagatcgttacgattaaatcaaccctccccaggcatctttaccgagggctgtggtccccaaagcgatacagcccaggagggagagaggctttggtgacttggaggaaggactgtgtccctccttagggcgtctgtggcctcagtgagggaaggaagctgcatcagacaggggtttcctcgctgtccacccctctggcagaagatggattgggctgccccgtataaattaatgaaaagattaaagtttcgctaaaggggacatcgagtttatgtgtcatctcctggtgtctgtgtgcctgggatctgcaatatatcccagcccttgatgtactgtttctataaaaataaattacttgtaatttaattccacactatttctttccgtagtctattaccgacgagagcacgttagttcagctgcggaaaattggttgtggggtgtgtgcggaccccgagaacgccctaaaataaagacaaatcggggacaagctgggggttatcgattgcaggggtcgcatgaaaatttaacgacggtaaataataataaaaacaaacatgggaatgcaataaaagacataattctccatcgccgcggggggaaaggatcctatagtaaaggcgagtgcgctttgaggggtcataaaaatcaattagttccaacacccacgtcccgcgttgaggggacggggacgagcagggacagaaaaagaaaccatatttgaatcccatctctctgtgaattcttgggtcacatgcgtctcagtacagcccgtcccgtgctgtgaccggatagagtttcaatttactgtggaaatttgctgtaaataaattgagcatccgatagaagctgttgctgattaaccttttatttttagcgtggccctgcaaagtcgtatcacccagctgtcaggcttctaatcgaaagttatgagaccacggtgaggggcaggcggtaatttaattacaacaaatatctttgggtttatggcgcagagctaaattaaatgtcattattcactgtctgtaatggaaatcaaaaggaaatcgcattacggcatttgggaaagaaagcggggagtgctctttaatgaagaaataactgtcttaagcagtgtcacacacttcacttaccatattcgggcctaattggaatggatcgtgaatcactccaagactgatttattagcgcttcacgcagcggctaattcatcacttgtattcttcatcatttttttttttcctctcgccgtgttgaagggagagtgaatgaggctttccacgtttcaggaggattttcttttttgaaaaatgcccttccagaggcttttgggtggctggcttgctttctgggccctggaggagacaggcggagagtccaggtgggcatggagaggcacagtggcaggtcacctggatggtcagtggaggtggaggtctgaaggcgccagctttggaaattattggtgaatttcgatgtcagcaccaggcaggggcctttttggcgggggtgtgagggaggatgactttgctgggaaacaggatcaggttctccaggcgcactgcagcccggtaggacccactttggaaatgaaaagccagttccgaaagctgggctggaagcttccgtgttgggttcaagagcaagttcacgttgcgctgtgtagactcctggctgctcccaaactctgagggttttctgaggttcccttcataggggcaccggccctgggccatgcacagtgcgtaagggtggctgtgggccgagggacccagcacgtgttttgcccacaacagccggagtgactggttcactcaccgccttggcggaggacgcctgttctctggacgaatcatttctcttgggtggtgactgccttgtgggtcaaggtgcaggttttctgccacagaaaacctgttaggaggaattaagcgactaagactgtcagggaggtggtggtgggggagaggagggggtggtgtccagattaccaggcataggctaaactgcctgcactctccagctggtctgtctgtggaggaggggattgtcaatactgggagagcagaggaggctcgtaggaggtgagagggggtggaatttgcatgcaaatcttcacatgaggcctgtgtgaatttctccagcctcctgagggtcccctgcgctattgcactcaacttcttgatagtttaccccaagactcagaagtccttagaggggcagaatgcccccaccacaaagcctgctatccttgggcgtcctcaggacccttggtcatgaatgggaccctttcatgtatggggacccttggtaatatgaatgggacgccttcagctccccagggcttccgaggaggccgagaagggcaaagacacttccgaggaggccgagaagggcaaagacattttctgggcttggtgtgtcaagagctagattggagaaggggctggatttggaactctttagccatcagctcaccctctccgtttgtggctaaagtctgaaggtggaaacttcggttctcctacagggtctacaggagttggggggcggggcgcccacacagaacgctggaaagttcgacagtccacttccactggctcggaactcactttttcaccttaagttcatcagcggtaacgcataggtctcacttaggcagggcacggatgatttaacaatttctacttctaggtcaggtgcggtggctcacacctctaatcccagcactttgggaggcccaggagggtggatcgcttgaggtcaggagtttgagaccagcctggccaacatggtgaaaccccgtctctactaaaatacgaaaattagccaggcatggtggtgagcacctgtaattccagctactcgggaggctgaggcaggagaatcgcttgaacctgggaggtggacgttgcagtgaggtgagatcacaccactgcactccagcctggatgagagagcaagactctgtctcaaaaacaaaataaaacaaaaacaaaacaaaaatcaaaaaagaaaacccaatttccagttctaggccaggtgcagtggctcacgcctgtcatcccagcactttgggaggcccaggagggtggatcgcttgaggtcaggagttcgagaccagcctggccaacatggtgaaaccccatctctactaaaaatacaaacgttagctgggtgtggtggtgtgcgcctgtaatcccagctactcgggaagctgaggctggagaattgcttgaatctgggaggtggaggttgcagggaggcgagatagtgccactgcagtccagcctggaccagagagcaagactccgtctcaaaaacaaaagaaagcaaaaacaaaaaacaagagaccagcctggccaacatggtgaaaccgcgtctctactaaaatacaaaattagccgggcatggtggtgggcacctgtagtcccagctactcgggaggctgaggcaggagaatggcttgaacctgggaggtggagcttgcagtgagccgagatagtgccactgcactccagcctgggcgacagagcgagacttgatttcagaaccaccaccaccacaacaaaacaaaacaaaaaatccaaaaaaaccccaatttccagtactaggtagtcagtgatgcagggctggagacagaggggcggtaagtgtctgggcgcccaccatcagtcacctcccagctcccagaggtgcaaagtgcttggttcagcctcatgggaaggatgctccctggggaggctgggctgggttcacagggctcttcacatctctctctgcttctccccaaggtttggttccagaaccggagagccaagtgccgcaaacaagagaatcagatgcataaaggtgggtgtcgggactggggggacctgaagctgggggatcctgctccaggagggatggggtcgacgaggtgctggctacacccaggaccaccacactgacacctgctccctttggacacaggcgtcatcttgggcacagccaaccacctagacgcctgccgagtggcaccctacgtcaacatgggagccttacggatgcctttccaacaggtagctcactttttcttcctctgaagatccctagggacctgctgctcccttcccctttcccctatttgctgccgcatcctgacactcctagtccctccctgcccctgcagacttctcagctggcccttagaaaaaaagcctcttttccgaggaggcatttacaggcaccttggcacctatgaaatcaggctgggccaggcggggtggctcacacctgtcatcccagcactttgggaggctgaggagggtgcatcacctgagatcaggagttcaagaccagcctggccaacttaacgaaaccctgtctattaaaaatacaaaatgggtgtggtggctcacgcctgtcatcccagcactttgggaggccgaggcaggtggatcacctgaggtcaggaattcgagaccagcctgaccaacatgctgaaaccccgtctctactgaaaacacaaagcttagccgggcgtggtggtgcacacctgtgatcccaggtacttgggagggagaatcacttgaacctgggaggtggaggttgccgtgagccaatatcgcgccactgcactccactctgggtgacagagtgagactccaagactccatctcaaaaaaaaaaaaaaaaaaatcaggctgtaaaaatccacttttgggaaggtgaacacacacaagcccaaacagaaatctgacaaaaaccagaggggtgaaaagtccacacagtcaggcacccccacctggcttgctgcctggttaagaagggcgcagatgcctgtgcctggataccagagatgggacagacacccattcccttttcatcaccacccccgagtgcccgagggcctggggcgtctgcctggcccctggcccctggcttgggctctgcacctctgagctggagacaccctactcagctccccacttactttggagtgagcagcgcttgggtgcccagcgtggatttggggcttccagggagtcggggttcggtcgcggagcccaagcttcccaagggcgcccccgccctgccctggcttagtggtggggatgggatggggggaagcggggagctgcgtggaaggaggtgaagggtcacaggaggagagagcgcagcgcccacgtgcgccctgcctgaacgcgcagcgcagcgcccggctgcggtgccccttgccccttcggtccctaatttgggggtcgggagtgcatgcgcgggcggaacgggcttggggggggggctctggcagggcggacgcgtggcctcccttcttcaccgttttattccaaggggacaggctggggattgtatttgggcgcgtgtttggctgagggtgcagggacttggggggtggcggtggggagcgcggaaggtataaacgtataaatcataagtaaacaactcagaaatggaccccgagcgctggtcgccgctagctctccagctctccctggcccaggcccgaaggagaggggtccgcatccctccgcggttctcctctcctgggtacctggccttgaggtgggggaacgagcctacttcttgtaccgtcttttgccgacggcgggacccagtgaaattaggccgttggagcccgcaggcctgcctggctttgcgcaccggagtcttggggacctggtgtccccgggaaaaacttggggacctggtatccccgggagaggcttggggacctggtgtcccgggagaggcttgggtacctggtttctctggaagaggcttggacacctggtgtcctgggagggcctttgggacctggtgtcctgggagaggcttggagatctgttgtcctgggagaggcttggggacctggtgtccctggagaggcttggggacctggtgaccttggagaggcttggagacctggtgttctgggagaggcttggggacctggtgttctgggagaggcttggggacctggtgtctctggaagaggcttggacacctggtgacccgggagggccttggggatctggtgtcccgggagagccttggggacctggtgtcctgggagaggcttggggacctggtgaccttggagaggcttggggacctggtgtcctgagagagccttggggatctggtgtcccaggagaggcttggggacctggtgtctctggaagaggcttggacacctggtgtcctggggagaggcttggggacctggtgtcctgggagaggcttggggacctggtgtcctgggagaggcttggagatctggtgagccgggagaggcttggggacctggtgtcccgggagaggcttggggacttggtgtcccgggagaggcttggacacctggtgtcccaggagaggcttggggacctggtgaccttggagaggcctggggacctggtgacccgggagagccttggggacctggtgtcctggggagagccttggggacctggtgaccttggagaggcttggggacctggtgtctcgggagtgccttggggacctagtgacccgggagaggcttggggacctggtgtcccgggagaggcttggggacctggtgtcctgggagagccttggggatctggtgtcctggggagaggctgggggacctggtgtctcgggagagagccttggggacctggtgacccgggagaggcttggacacctggtgtcccgggagaggcttggggacctggtgacccgggagagccttggggacctggtgtcctggggagaggctgggggacctggtgtctcgggagagagccttggggacctggtgacccgggagaggcttggacacctggtgtcccgggagaggcttgggagcctggtgtcccgggagagccttggggaccaggtgaccttggagaggcttggggacctggtgatcttggagaggcttggggacctggtgtctcgggagaggttacgggggctggttgggggagagaacgttgtgagccaaagtccctgaatccctgcgaagagagcgcatcgggagctccccctgagggcgttccatttgtggacccccctcccatgcgctttgcagggagctgttcggattcccctggcccggctcccgcggatgcatccagtggcagcgccaattctgggccagggggaaggaggaaaggcgggtgtggggtggtctccacggctggagaaggggcgacgctccctaggggagaagaggcacgttgggggtttccgggggcgcggggcggagcaggccccccagtccccatcctgcgccctcaccccgccgggtccgctcccgcaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggctttaatagttaagctgaaatttttatcgaaaagaagaattgcattttgaatctttgggaagtaggttcattcatcagagtatgtaaccctttggaaaagtggttggtaagatatgtacagccctagatttttttttttttaaccaaaaaggctgagtaattttgaaaaatcgaaacataacagtgtgtcatcatttcctcccaagaaaaagctcactccacgtgagtagaaagacatctacctggtccctgtagaatctgaacgtttctctttagagacggaatttcaatcttgtcccccaggctggagtgcagtggcacaatctcggctcaccgcaacctccgcctcccgggttcaagccattctcctgcctcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcagcctcccgagtagctgggattacaggcacctgccaccaggcctgggtaactttctggtatttttagtagagacagggtttcggcctcccgagtagctgggattacaggcacctgccaccaggcctgggtaactttctggtatttttagtacagacagggtttcggcctcctgagtagctgggattacaggcacctgccaccaggcctgggtaactttctggtagttttagtagagacagggtttcagcctcccgagtagctgggattacaggcacctgccaccaggcctgggtaatttttttgcatttttggtggagacagttttttgccgtgttggcccggctggcctcaaactcctgacctcaggttgacctgcccgctttgtccctcgcaaagtgctgggattacaggcgtgagccaccgcacctggcctgaatctgaacttttaaaagggagttactgactctcaactgtgcggggacggtttcagtttgatttaatatggaaagagggccaagtgtcatcctcacaaatgggtccccgaagcagatcaaacgcagagaactgtgagggtgggacacgagtgtctgtggacactggctgcctttggcttttctcctgcgagagaagttgggtgactttctgtaggtggatgagtgatccctgaatgagtgtggggtacgtgtatgctagctgcttctttctccctgaaactctcggatggaaggaagtaagaaattcagcttgggctgtgaccagttctcaccaccaacgccctcttctctctcccttctccttccttccttccttccttcctttctttctttttctttctttctctctttctttcttttctttctttctgtttctttcctttttatctttctctctttttctttctcttttccttttttgtttctttctttctttttctttctttctttttctttcttctttctttcttcgatgaagtctcactctgtcacccaggctggagtgcagtggtgcaatcccagctcactgcatcctctacctcctggcttcaagaaattctcctgcctcagcctcccaagtagctgggatgacaggcacccaccaccattcccggataatttttgtattttttagtagagactgggtttcgccatgttggccaggctggtcttgaactcctgacctcacatgatccacccgcctcagcctcccagagtgctgggattacggggtgaggcaccgcgcccggcctcctctctctttttctgagatgtttaggaaggactgggctgatggggaccctctgtatgtgatgtgcgtgggtttggtttcccggaaggccctccagagacacgtttgcgtgaacattcagcatggaaacaacatacgtctctccacaggaggtgagaaattgaatttatggggtgggtgtacgctggcgattcttggtgctttttgctcaaaacaaggttcttttgaaagtcacgttcctgctttccctgtggcttcccggtgagctcgctcgcagagcaaggaataccacccagagagcaacgtgggctgtgttccgttgtaacgccgttgcagagagaggatttggtgtgtgagatccgtaccagctccagcacactgataggaacacgttgctggccgaactgaacgatgctgggttgggtcctgattgatacgtattttcttccctcctctccccaaaacttggccaaatagtccgtggagggttgtcagtcgccgcagttgagcaaaaaacacttcttcctttgagtggctgttctggtgaaatctgtttctgacatatccacttttctctctcttttctctctctctgactgcgaagcacccacagggagaaggaattggatgtatcggatgttgctattagattttctttctccgttcgagtctctgactggtgcatactttgcaaaggtgtgttcctggcaattgccaagagttagaaaaatgcaccttctctggtggccgttggggtgttgtttcacaggcagtggtgacagggccccttggctgtggctgtcttctccagcgccgtggataaagagatgggacagattctgtgcctctgtacgatttagagcgtaactgaccgcgtccaacacccgtttttccacttacaaagctggtggtgcgacgggcttggtgtctcccgtacgggaaggaggcctttgggccgctccaaagacgccctgtcgtaggaatggcctctccatcccgccaaagtccagccaggcccccgaaatggtcccatttccttggaagcctgagtttctgttctggtcttgctgctgtccttggccacgtcagcacgtgggagcatctgtggataccgcagagtctggggacagctgggcgtttaaccgaaatgaagccgagacgggtttcaggttttggtgccaagctctggtcaggatgaaagggaaataccagagtcctctgtcctcgcctctgggtttcatgctgacctttctaacatttgttttcccctaagaacaagcagaagcctccagctccctttagctccacagttttcccggggacatagcgaggatggcacacggcagccactcccacgacacacatttcggaggcactttgctggaagccgcttgtctcctccagctttgggaggtctggggaggagagaggctttcggtggacacgtttgacattaaaaaaaaaaaaaaaaaaaaaaaaaaaactggtgcctaatttattaaagagaattagcttagcgagtatatgctgatattcttcgacacacgtgggtaagttgatgccatttataaatgttttattgaaatttgatatttaatgagaagccggttaaggaatgtagacaatatcccgtttcaaagctatgaaatgtgctatttattgaaaggggatgtggcttcacgagttcagcccattgtacgtgcaggtcccgtgggaaggaggcaaaagcccctgcttcttactttgtgatgtatgtgcatttgttatttatttttttttccttggtcggacgttcataaatatgtactattttaattatgtcgagtgtaaatttgacatcgcgttgcatttatttttatatttctgaaaactgttgctttttctttttccctcccccattgacgacatagcggcccccgcgtccgggttacaaatacatctacagatattttcagggattgcttcagatgaaaacaaatcacacaccgtttcccaaaccaacagtcttcacatttctatccctctgttattgtcggcaggcggtgaggggtagaaaaaaaacaaacaaacaaacagaaaaaaaaaccaaaaaaaaccaccctgagtttctctggtgacgccctcattctcctaacgttcaataatctcaatgttgagttgcagcaacagactgtatttttgtgacgccccgtagtatgaatgtacatcttgtaaaactgagatataaataaacttataaatatttgtattcaagtgttaaaaaaaaaaaaattctcaacctctcccctgaggacaggcttattggaaaaaaaaaaaaaaaaaaaaaatcctgagtcggccgtggctgaacacagagtgttgttctgctccgtgcatttccagggtgggtacccagtgttgccccccagccttagatcgggaggtaccattgacttttgcttgtatcccatccccttcctttactgaaacctacctccccgcttctcagccaacgtccccccagaaggtggcaaaaaaaacagaggaaaaagccctgatttgaatcaagtcagagctgctaattctccactttctttaattaattaatttatttttttttttgagactgagtctcgctctgtcgcccaggccggaggagtgcaggggcgcgatctcggctcaccgcgacctccgcctcccgggttcaagcgactctcctgcctcagcctcccgagtagctgggatgacagtcacctgcaccaccgcgcccggctcatttttgtatttttagtagcaatggggtttcaccgtgttggtcaggctggtctcgaactcctgacctcgtgatccacccgcgtctgggcccggccggtgatgtgtgtgcttttaacttttattttgttccagttttcgacagtggcacggattttccagcacggtcttgcaaggatgattgagtcatttttgagacaaaaaatataataataataaatggaaaaagaaatcgacttttaaaaatgacaaatttttttttttttttttgcatagatttttctctctttatgtaaaggaaagttcatgattggatttggccggcctgactgcttcccggctgtgataaaaaacacatgtgagctgggagggaagtgggggagggacacagctgcccacacagggttcccaccgcggttacagggtgggcagtgctgggggagctttctctgtggggggctcagagcctgaggacaggtgagcctctccgacacctccccagttgcctggagtctaaaccgtccgttgtctgtaccgtccgttcttcctgctgactcctggtagttcctgaaagcttctcttggccagagaaggggtttcagaggccgtgtgtccaggccattctgcaaagtgcaacttgaccgttcctttccttttctggcctgcgtggtctgaagctcagagccctctcttcacccagcctgtgtgtgtcttgccggacagaagaaaaatggtgctttttgcgtgttagcagaggtgcttttcatggctgacctcaacgcgtccatctccagccttgaccaagctgttttttaggggcaaacgcaggcaagttctgaatgcacacagttatttcatggttaaactattcagctttggccgggcgcagtgtggctctcacgcctgtcatcccagcactttgggaggccgaggcgggtggatcacctgaggtcaggagttcgagaccagcctggccaacacggtgaaactctatctctactaaaaatacaaaaattagccgggcgtggtggtgtgtatctgtaatcccagctactcaggaagctgaggcaggagaatcgcttggacccaggaggcggaggttgcactgagccgagatcgcgccattgcactccagcctgggcgacagagccagacgctgtctcaaaaaaatgaataataaaataaaataacaggaactaaataaaataaaacgttcagctttgttctgcaaatccactcctattgttttacgtggtttgagagactctgtcccttagaaatagatgtttgttgccaattgtaatgaatctgtttcaaaaatgaacagaatattcaaatggtttgagagatcttttcccttagaaatagcttgttgccaatcacaaagaatgtttttcaaaaatgaatggaatcttcctggatatcgcttccagatcttcattttttttgcatagttcaacctgaaaagtaagtgtctcagccctgaatttctttct

SEQ ID NO: 11815 - DNA, 26845 bp, Human
atttgagttcaaaggagggtgtctaaatatgcttgtcttgagccctgtgcattgggccttgcactgcagccttccaactttaagagaaatttcagaatccaaatccttcccgcctgcagggctcaaattttcctttgcagatcagacctggtgaagaggctatttgccgttcaatcctaggctagctttctgcctttcacctaatgtttgaggttaagagaaatcagaaaagagagaccgtaaactgatcaccactgcatgggcatctgcctcacccacctttgggagttgggggaagagccagccacaggtgctcaggtgcaggtgcccaggtgtgagcggctaggtgcagatgctcaggtgtggcagcagggagtgcacttggctcatctgccctggggagggccagctcccgacagaagtaggccagaggtcagtcccaggaaatgcttggagcagccagcagggtagggccaagtcatgatacacctaggagtgggaggggaggcctctttggatattacctggtttatcatttagctgttggggtggggaaggaggtgggaaagacagaaggctctcccaggaattggcaggcagccaggtcagggacaatggcagcccccacttgtgctagaaaggcaggcaggacgtgaccactcagatagccacatcaacaagtacaaatcacggttgccctggaaggaaatggctcaggtttttcccagtagctcaatgcctaggcacccccacctgtggtttgggcatttcactctattagctcttctgctcagtggcccattctgctagccacagctcacatttactccagttatgaaaaaggttaattttcccatattgagtttctctgcaaaagctgctttcagttgtgaccggtaagttccgttgtcaccaatatgggtacaactgttgtcactctgctattctgaagccatgatactaaaagtgtgaccccagatcagtgtcatcgccatcaactacaagcttgctagaaagaaaactctccctagacttccagaatcagaatttgcattttaacaaggcccccaggggaatcctgttcacactgagttttgagaagctctgttctaagatattactccaatccccagcaagccaaaccgaccactttcttcacataatcagaacgctcggttccagtatttccagataccagccataggaaaacacgttgttctctcatttccctttaaccttatctaaagcactcaatttcctcaacccttaagtcgtcatctgtaaaatgggagtgctaatcctacttaatttaagatgattaagttgaataataaattagaatttgtcctacaaattgtgaatcatgatcggaatattcaattttattattactctgtgtcctaactcaataactgggttataaactcctgaaaacaggacaatctcttctctacctctttctttatcttccctgtatactgaaatacagcgttctgcccagcatgaggtcgactatttgacatttacaaaaatctctcttggaatccccctgccaaaaaaaaaaaaatcgaatttcaatttatgactccaagcacaaagagatcctgtcactttgacctaattctctgaggttcatccctctaaataattgtattgtctccatctataaagtactctgttactatgacaacgcacacataattgcatgtgtaagtagttgagggtggctgtgcaagtcagactcctttccaccaggaaacacagaaaacattctatcttcccaaatgttactctctcagatttgcaccaagaccctagaagtttcttaaatttccatatactttatggacactacaaagcaattccaggaaacactgatacagtagcaaaactactgggagtggaaattggatggagatctgggtcccagttcagagtctgacacctgatttgcaacataattaggcacagggcactcaactattcagggccctaaacccttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactattcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgaggtaagattatctatacctctaactactgcaatcaccttggagtaatccttccagaagcctatggcattctgaatgtccaactgatttgccacgcatctaaagtatgactaaggaatcaaacaggagagaataaatgcattcccgtgccttctagcacagctgcttagctattggaattgggggatttatattttgtgtttgtgtttttaaatctaactcagttaacagggagttgcataattgctgttgatctctaggaaaagattcaaagcttttttaaaaaagtaatcttttccaaaccacaagctgcagctgaggaggtttatcctgttggtagcaggaaaaaaaaagcaaaatacactttctttgtaatgatgaggagctctgggtgcaatcataaaataaaactgtttgtcaaacattagaacctgtagtgagacagtggtcaactccatcaaatatagccagttctttgggcaaacattttcctggtataaaacctaaggaagaatttgtaaatttgcttcacctctactggcattaaaagtgggggaaaaagcctatagcagcttttttaaaattatgcttaccttactacaaaataaacagaaaacgttttctccacttcctacagagtaatctaaattgcaatgtttgcccatttcatcccgtgccagtctgaactagcactggaaaaaaaaactaatagaaataagatgaagcattaatgtgactagattgagaaatttaatgctaaaagttgaatagacaaatgtctttttccttagctcacaattcctcatttcccttgaaaggtatgcatttccttctgcaaaccatccaggtgctaatgcaacgtgtgcttattaaatactgtacagtaggcaattagctctgttcatccccagctactattggcagaggagagaagcacaaagtgtagaattgtaaacactggattgatagagtacccagtgatcaattaggaacctgctgtctcatttcaactggtgctggtttctccagaagctttagaaaagtcatacaaaccctataccttcatatggtttagtctttcacataagaaaacacatgatatccaccttgcaattgctttttttttttaaggaaagccctataaaacaacataggatggcaagtgctattcaggtttagttaatctgtgaaccacgatatagcaataaggtctttttagacctcaatttagtttgacctggacacaggtacacagaagtgagaattctaaatgccagcacctgttacactgagaaaagtgaactacttggaacattgggccttgacccccaataaacagctttctcataatatttgtaacttttagtgcagaggagttttgtacctcaatgtaataccacatatggaacccttttataagacagaaaaaaaacgtgtgtggtactggactattaggttgttgaaatgaattctcttctgtgagctaaaaacagtaagatctaacctaaaagctccaagttacatttttctgtggttttaaggaaatcttatttctcttgaaacaggagatgattatgtaatcctgtccacctagcataacaattcctataaattattttttttaataagaactaaaagtagaatatgaagctttggtagaaacctccagctaaatccgtgcaaatgaatccttccagcaagtcaaaataagccctgtaacgcaacatggagcaacctcacctatccagagctcaacaagacccaataaaagacactgcacacccaaaataaatttcacttaatctcataaatgctcctcatgcgggaccgacttaactatttttattttaaagttctgttgtgctatttcccagaaataagaagcggggaaggaagcagagtgttaggaagggcaaaagagaagatcaaatgcctgcaaagcaaagcagacactgacaacacacagccatctctctatcatttatcctctatcacttattctctctatcacatattctctcttaattatcaattattctctctggtttctgtagcacttattccagtctctggtctctgtatcacttactcttctacaaacacaagaagatgtcacggtattttagaacaaccgataatcatgtttatcatgatcggtcttaatcattgagaagaggttaaattatactgctatgtaagatgatgacattatgcattgtgtgttaggaaaacaatattccaatatttctttaatacaaattaattaaaagggtaaaacctgagctattgcgtaacagttttccaaaactttttattcttctggattaagaactggataactaaagtctcctgataatttacttagatacaatcctatctaacatttatatttccagttgtgtacacttagaattttaccttctccatctccacttgaactccagcaatggcatgaagacatgactgtttatgttaacaggcagctacactaattgagctaatgccacacaatgccagcaaaaccattccacctggttttaactctcttggttatggttcttgggagaagaaaccaaaacatttctctctcactctgtcatctcttatgaacctggaaagccaccgcattttgcaatctctagtgactttgaaaaacaaaaaaaaaatagacaatagtccttgatcattggaatccagcaagtactatttcagctccttctctgaccactcccagcctggagtttgtgaatctgattggtgcacatatattttcacctaagttgcagctgtgccatggacatcacatgcacaaaaagcatcagggagaagagatggtgacttttcaggtgaatctgcttgtggccaaaacccatagttgagaggacacagaaacatcctatctcctttgtgtctgctctctccccagacacaggcaaatatccggtgtcttcatccttcttaatggcctcagcgacaccatgcaaggacttctcatttcctttctttggcttcctctttggggaatccattcttatgcatccttctcccagttgcccccagttccttccctgccacctactttctacattcctttttattattttacagactttcctaccacatcctttgttctttgggcaaatgctgttagatttttcagcttccagtgcagcattcattgatattttagatattcaagaaatctcaccctgtagcttaccacaaattcacagcaatcaatccttcctatgtcaaccccataaatgtccttctcttctctactctgggagacctaacccaaaaccattcggctttttcctttattctccctaaaagtaaccaaacattgtttctctccagtagcactgattttactagctaatatttattaaacactagtatatgccatgcacagtgctaagtactcaaaataagttggtatatttcatcctcccaagaatcctctaaagttagtactattattttctgcatttggcagataatgaagttaagattcataaccttgaccaaggtcattgagtcaatgtatgcctgagtcagaattggaatcacccaggtctacccactaccactttgcaggctcataagctttctctacactgcttctatcacttttcacttctccagtttctagcactgcctatatacgctacgttagagccttcaaacttggtattttacttctaatatgattacaatcttttacattgcttaacactgatttcactgaattcctcaacattcactaaatttacatttattctttcttttatttccatacacacaaaagaaaatctccctggcagttaatagagctgaagtcaaaattaagaccaagattttttttttatttttcttatacttgactcttttctgtcagtctaatataaattcaaggcagtgtatgtattttttatatacatgccttttatagaacttcagattttttcgtgtaagataatattttcttttgctaatttaggctcctatattatttcttaaaattcgttatctgtgaattgttttaaatctcattttgagtggtttgattttgttcttacattcattcaaatagcatcaacttccagctacctattcgtctgttcatctgcaaggtctcttcgtcagtgctgctcacaagtctaaacctttccttctccaaaccctcttttgtccctcatcacgatccttaagaaactgctctcaccaaactcaaaattatgatacaacgtcatagattgtcttagcaatattcagaattaaaggttttgcaaggatctttgaaaaaaaaacaaagacagaaaaagacttccttcttaaacattttctcacattttaaaacaaaaattctcagacttctcttcactggaacccagttaataaatcctcctcacttccccaccagattcccaccacactctagaaaaaaatattggatgcacagaaaaaaaaagtgattttattatagggacaactttaaatccattctaatatattttttaaaataaaataaaaaaaaagagaacactgaaagaagagaggaaggaacagagaaaaaaattaccttcaaactccagtactttcattataagtaggacaaagtactattaataacaaattaacttgtttgtctggtgtacaattctgccttagcatctatttcatgcctaaatttacctataaccagaatagattgaactgcttaaagttttaaatacatccacattatttgttactgttgtaatattttagctctactaaaacaagtatttttatctaaattatttaagcctattttaaatgaggtcattctggttaaaaataaatatattattagagaagttaagctctctgatgaactttgtcccaccctgtattttgccaaactgtgcaaatttaactgtgccttgaaacaaaatttctcattgttagctcctttcttagtatagtgtgttgttgttgttgttgttttggggggcaggtaatataaatatttaacattttctttcaagtacacccataatacccttaagaaattactactcttgacaacctcaatgacgacctgttgagagaagggcctttcagagaaatttctcatttctctaagtttcccgattctatttggtggaacacaagatacaaaaacatggtaacataaatgatcacagcagagagatgcagggtgcggtggctcccgcctgtaatcccagcactttggaaggcctaggcgagcggatcacctgagcccaggagtttgagaccagcctggacaacatggtgaaaccccatctctacaaaaaatttaaaaattagcctggcatggtggctcatgcctgtattcccagctactcgggaggctgaggtgcaaagatcacttgagcccaggcttcagtgagccaagttggtgaccctgtactctggcctgggtgacagagagagaccctatttaaaaaaaaaaaaaaaaaaaaatggtagtagcaaccagctcttaatagagtgctttgcattggtctaagtgccggacaccattggctcattctatccttacagccattttagataaggaaactggtaaagagaagtcaactaaattactcaaattaacacactaagtggcaccgcctgctttcagcccagacagtgtgtggctttagagctcaggctttaaaggcagagaatgtacgctgtgtacagatccctttgaagaggacccggaagactcactccccaaaaatctttctttgacccactgtcctagtactagagatagcatcatttggcattaatgtctccatgtagatagcctactcagccagaccctcttattaaaatgcaaacactctgagcagggatgataccagacactagttcttctgaacacacatttgccaaattgccaataacttactcagtgctaagaatttatgtctaccctgccgcttgcatgctttcttttgatttttaagtcagcttccgcttcttgtcccaagctagggtcacttgggcagtaatttttctgctttatggcaacacagcgaggcctcctccctcggacatgcattctattccaggggcccagggaggcccattccatctcagcatggtcagacacatgcagccttggtggtgtcagctgctttaaatgtgtttgctgttctttgattgaatgtttgaaggatggcacacccagcgaaccttatacattatttaatgatgactttaacccatcgtttaatactgtttctgacccttaagaataaaaggggagggaaggacggcacaaggcaaagtggaaagacaccaaatatggcccattttgctcaaggccaggccctgaatacactcaggcacataggcacatgtatattactgttcatcacaccagacgatgctacaggttgagacagattcttgcaggactttcttatcatgaatcgaaaataaaaattttctcccattcgggaggttgtttgtctactctgcttatagtttcctttgctgtgcagaagctctttagtttaattagattccaagaaaacaatgaacaaacccattaaaaagtgggcaaatgacatgaacggatgcttctcaaaagaagtcacacatgcagccaacaatcatatgaaaaaaagttcaacatcactgatcattagagaaatgcaaatcaaaaccacaatgaaatgccatatcacatcagtcagaatggctattattaaaaaggcaaaaattaacagatgctggcgaggttacagagaaaaaggaatacttatcttctgttggtgggagtgtaaattagttcatccattgcggaaagcagtgtggcaattcctcaaagacctaaaaacagaaatacactcaacccatcaatcccattactgggtatatacccaaaagaatacaaatcgttctattataaagacacatgcacacatatgtccaccgcagcactatttacaatggcatacatatggaatcaacctaattgcccatcaatgatagactggataaagaaaatgtggtacatacacaccatggaatactatgcagccataaaaatggactagatcaagtcttttgcaggaacatggatggagctggaggccattatccttagcaaagtaacacaaggacagaaaaccaaatactgcatgttctcacttataagtgggagctaaatgatgagaacgcatggacacatagaggggaacacagacactggggcctattagagggtggagggtgggaggaaagagaggatcaggaaacataactaatgggtactaggcttaatacctaggcaatgaaataatctgtacaacaaacccccatgacacaagttgacctatataacaaacatgcacatatacccctaaacttaaaataaaagttaaattaaaaaataaaaataaaacagcatcttccctagaacaccacaggtggatgtatcaatctgcccattgcctttcagcgtcagcatgaccacatgctccacactgcttgccctcggaatgatgccgctgtgcctccttatctataccaaaatgtgggtcgactctgggagcatcgtaattccctatgataacataggtaagtcatccatctgtaagactgttgactgttaccctcaaactctctgcttaccccctgctaggctctcagaccaggctcacacctgaccgttattgccctagtaggagtttttgcctgatttcattataaagtcacccctgcgtttggagagtgatggcagaatgtaaattccaaaccttgaccttatgggagaacctgtcttttcttcaatttgaatcaccagggaaaggagccccctccccagccctcagtctggactgaggaggcttaagctttggggacatgggagcttgcacctattccttaacccagagtgtcactagttaatggtcataggattttgcatccagacacttgaattgaagaaattttttttttttttgagatggagtctcactctgccacccagcctggagtgcaggggcgtgatctcggctcactgcaaatttcaccccctgggttcaagcaattctcctgcctcagcctccctagtagctggaattacaagcatgcactaccacgcctggctaatttttgtatttttaatagggacggggtttctccatgttggtcaggctggtctcaaactcctgacctcaagtgatctgccggcctcagcctcccaaagtgggataacatgcatgagccaccacgcccagcctgaagaaattttttaaaatcacataatggtttcaaaatagagcactgagtaagcaatccagagtgttacaacagaaaactgctagacgaaacacactgtttctaacactcgactgtgagccacaccttgacccaaaagttgatttaatggcaaagtcatgctccaggagtcaaatttactagtaatgactctgtctcatttcaccctcatcccaaaaaccttattttctgtttctggggaaacaaattatagtgggagattaagttattgttgtaacttagggatgagggtcaaaggaagaacaagagagttcctggtataccaggaataggcatttcccacagaactatcacgaacaaaagacaagatgtgggcaaaatagtaaatcagtaacaatcaccaggtacactatatgccccaaatacctgggtttttttccccactgaccttggaaaaaaatcccaatgagctgcctcagaaaggtgtgggtttcccattgaagaaagcatccaagcaaaggctaaatgataagccacctggatgcttgtaaaagggactcctattgggataggaagctgggctgaaatgccttccatttctgagaaagactgcttctgtgatttagggtgattgagggaatatacaactgaattagaataaactttgtgaatactaattggggatgatctgtattacaatgtttgtagcctcttctctctctcctactcttaccattaccattagaccaaaaaaaaaattgtcctccttgacatgccctattcagtatgggcttttgatatacaagattcttcagactccaggagagaaccttaatatcatatataacctcctgacaagagactttagggtgaccctccactaccacctgcttttgccttcatgctgcttgactctctggctgctctgtcagcggacgccttccatagagctaaaaaccatagtttacgtgagtggtgaccattatatccctctcaaagaacctgtctgctgagtgaggaattttgattccacaatactcactgtaataatttaataatttaagccataaaatattctccttttgatatacattcccttctgagaaatgactcatggaaatactgaataattctaactgcagtgtgaatgacttataccatattctgtgatgtgaataaattttgaaataaggagaaaatgaaaaatcaattagcacttcaatggaggaaaaggtcatcataagaggtcaagagtgaaaagaaaagaaaaataggaaaagagaaaagaaaacggaaaaagagagaagtttgaaaaacaaagatattgttatatgtaaaatatttattcagaaacagaatacttgttcctcagtaccacaaggaaaaatgagcattcagacaaaaagttttctcagcaaggcaattttactttctgcagaaagagtgctcctcacagatggcacaatggtgacagcacacctgaacaatggagggaagtaattcgtatcccttatgcagcttgtccctgctactgtgtcctgtctccattggctggagccagacatcacaatctaagctaaaacctgactggctaataatttaaaacttttctaaataggtataggcaatagacaacaaaggaaaagaggacgttgcttgtgaaaggacttagaaaagtaataatatttccaaataaggaaggggcataggctgcaagctggaatgtacctgtgagcatgttcagcataaatatcttggttaaagtacaaggacatagaatgtacttattcctttatatctaacagctacatagaatagggcttaacaaagagttactagcacaaagtaagggggcttgaagaaagttagtctttaaaagaaattattatttctaatgtttattattattattattttcctttaacaacaagggacactttgaagaggaaactttttactttctacagatattaaccctgctcaccatgtttgcccaggcctccaagctcacctttttgctgttggtttttctagttctttaacatagaaaataaatgaactgactgcttcacaagatgttatcactgctttctaaattgtggctcagggtgattatttgcccaaggtcaccaggaagctggaatagcccacagtctattctctacacagctctatgggcagacgtgtttggtacaacttcatgctccagtgattcagtaaacacctgtgagccccctcagatgctgacatctggatcgagaggaggcagaccatgcagctggtaccactaaaataaaaccactgctgcaaattgttgtacttactcctctctaccccacatttttaagtgtcttgtgccaagaagtttatagccatttcatcatttaattctcacaacagcactgtaaggcagacataactccacccattttacaaatgaggaaacaaaagctcagaggggttcaatgatttgcacagttcccacagtttgggaatacagaaaggttcagttccaaatctatctggctcccagtcccaccacatgaatccattcaccaccactctctttcattctcattcttctttctacctttctttcctctgatatctactgtgtaaacttgattaaagaccaagttatggattcaatgtgtaaccatgagtggatgctttttcatctacatagacaggcactttacagagagaacatgggcatatgaggcatacgtaaaacaaacagagcatggggaaagaaaagagcaagatcaccagcccactggagaccaaagttacaacatccacctctacaagcagaagccacacactgtgggtgtaaagaaagacagagtccctttcccagtcaaccccaggtccctgaaaaacttcatctggcctcatctggtcaggaaagaaaagcaattctgccatggatttcagcaggtggtgctgcttatgtgttatcccgttggcttgggctgcctcaaaaagatgaatactcttagcaggaggggccaaacagattcagcacattaaaatataggaccaaaacctaaccacactaacattccaagcacaggacttgcagctagatttaagctaccacatcacaaacaagtcatatatccagatggttttaagacctacaaacttcaaaaacttaggcaatggtctaaagacccaggagagggagtttccttcttgtattcatctgttctctcattgctataaagaattacctgagactggataatttataaagaaaagaagtttagttggctcacagttccacagactgtacaggaagcatggcaggggaggcctcaggaaacgtacaatcatggcagaaggggaaggggaagcaggcagcttctacatggctggagcagaggaagagagcaaagaaggaggtgtgcacacttatagacaaccagatcacatgagaactcactatcacaagaacaacaagggggaagtctgccccccacaattcaatcacctcccaccaggcccctcctccaacagacccgtcctttagttgtaatcctccaactggggattataattcaacatgagatatgggtggggacagagagccaaaccatatcactcccaaaacagcaggatgcaaggatacccaaggggggtttttctggggcatctcagcagtacgtgtgtcaacgccactctttcacatctttttttccattattccctccttactccccctcatttatctttttttttcctactcttagtacccttagtcattatttaattctgctaagtaatttctgggcaaaagtcatcactgacccttatattgccaggagggctagaagactacaaggaaattatgttttcatcattattgcattcactttaaattaatatctatagccttggattccagaatctgttttctagtcctagttcaatctacctagttaatcaatactaagcaacatccactctcagaatttcaccgttcaatatcactttcttatactgctttaaaaggatgtttgaaaaagaaacaacctatgaaaagttagaagttgttggtgctaaattatatgaaatcagctattggacaaatgagtgttaaataacatggagaaacaaaccacatgtcgcaaaaacagcagtaaatttaacatggtgaaattgaagtatgactcttttatctggccaggtgagcatgttactgcaaagaactataattacatgagagttcgtcaaatatattatctcatggaaaatttaaagcacgctttctcaacttttgttctcacctctctgctgtaaatttgaatagctaaagctagttttaaccaaaagtcagatgtcagaatacctggtgatcttgagctaattttggacattttctttcattttaaaatattttaaaattattttttatttctactaccatgaactagcagacaaatgtaaaatgtcatctttgtatgccatacacacacacacacacacacacacacacacacacacacacacaccttggtgagctatttttcctagagatataaagatccaaagactaaagaagccaagattctgacaaattaaaactaatgtatgctggcaaaataagaaactctaaaaaattaatgcagaatttagtgaaagaatttacagcattgatattatcaattatctaccaataatattaaattatttactggagtgggtgaagaagttgagtgagtgtgtgtgtgcatgtgtgtgtgtgtaattctgtattctgttttgtgtattcaagaaggaagactgaaataccacctaatctttcttcaggctgcttgttcttctgtttttctctttcctgtgtcacctgttctgctgatcacattgcccttctgtcatctttaggtacatctctggttgctctcgttgttcctgtttccattggaatgtttgttaatcacaaatggccccaaaaagcaaagatcatacttaaagtaagtatcccagttcacaccattaaatattccactgtgacaatcaaaaccatagggttttccatccatgaaatggtttcattctcattatatgattactgttgagtgggggcctgaagtcattagccatgcagtcttctcctttagaatgtccttctttatatgtgtgtagagagagagaggtgggatctcactatgttgctaatgctgttcttgaactcctgtgctcaagtgatccttccaaagtgctgggattacaggtatgagacactgcgcccagcctagcatgcccttctttattgcagtcacaggaaaaatttctacccattctttaagacactccactgaactatcacctcttggttttactctattctgtcctcagggcatattactgttatctctgttatgtgagtttgtgttatacaatatatctaaatggctttcttagaaaatagaacatatctttcttatgtctgtatgcatatggccatttcattgcctggcaatcccattcactaactatattctagctagatgatctggatatgtatgtagataatatagatagattctgctgctcggggcaaagtaagtccattgtattccttgcttctcttgacaaaaaatgtttataatctccaaattttgttttaaatgtgaaaaggagaaaaaaataacaacagtggttttcatttgcttataccttttttaaagttgtatagagttctatacccattttctcattatcgtaacaatcataaagggaagctggggcgacattttatccccaattacaaataaagaaactacagttcagaaagttcctgatttactgaaggaaacagaataggagtagttgaatccggaagccaaatcttccaggctgtcattgaaatgggttgtctttttgttctgacaaggataattttcaagtcagaaaatcttcagactaattgcaaatggttgctacatgtcctattgtgttcttaaagcttaaagcatgggacaagcgtcagtatttccagtgggctgattgcagcctcctggcttggagtacatagaaagacaactttatcatcacttcccccagggacaaggagactgctgaggttttgtctctgacaaacatacttggatttgctttgactcatgattgctgggttcacttattcctttttttttcagattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtatggcatttagtaaatcacattgggaattttaatctgtaatatctgttgtattcctttgctagaggtgccataagacagaaccacaaactgagtggcttaaacaacagacacttattgtctcatggtttcagagactagaagtgaaaatgaaggtgtcactgaattgattctttctaagggctatgatggagggatcccttactggccttcctcgtggcttgcagacatccatcttcttcctgtgtctttcctcagtgcacctctctgtggcctggctccccttttgataaggacaccagtcattggataagggcctcctctaatgaactcatcttaactaattatatctgcaatgaccctgttcccacataatgtcacatcctgaggtgcggagtgttaggacttcaacatatgaatttgggggaaagggagacataatcaatccataacagctgcaaacactgaagacaggatcaaaatccttagcccttcatcaatcacattcatcctatttctgaatatgtcattctaaataggcccattcattctgaagtcatgcaagtccccagaaagaaaatactgactgcctcttttttgctcaaagtcttctggaccattcggcttacaaggcagatggggctcttccattgctaagtattcttattctctgagtggaatgacattaatgaaagcagttgggctgccttggaatagacaagcgttcctccagctggcagcagggtgagctcatcctccaaaggcgccgaatattaaaatgggtttcacacttctggatttggtaccgggcaaaaacaattctttttgactaatccatcgaatccacaggcagagagaacacaggtgtagggacagatgcatgtatgaagttgggaaagagaggagtgggtatgggcagcaagaagagcgcagtgtttgagtcaggcagacctgggcttgccttccaatccgaccacacactgcccgggggacctcaggcccagcattcactctttctctgagttttatcatctgtagaatggggacaataatttctaccttatagactttctgtcaagatttaaacacaacaattttttatttttatgagacagggtctcattctgtcgcccaggctggagtccagtggcacaatcatagctcactgaagccttggctcaagtgatcctcctgccttagcctcccgaggagctgggactacaagcccacaccaccttgcctggctaatttttttgttttgttttgttgttttagaaacagggtctcattatgtggcccagtctggtcttgaactcctggacacctgggctcaagaaatcctcccacttcagcctcccaaagtgctgagattactggtgtgagccacctgtttagcccagcctaaacaaaacaaattaaacaataaaacagcgacaacaaataccatatcttgagcattttctgagctgctgccctgtgctctacactgttaccaaaatcataattgaaaagggtgaaatgaaccctcttggccacttacctaacactgtggtaaatgagccaactcttcatatgcacatattaaatatatttatttatattatatacaataggtgagatgatgtataatatacattaataagtattacacttattccatagaaagttatatattgaataagcctatcttaaatacatgcattaaaagcagagacataatgcatatatatgtacttattattatatctgcttttcatgtttcacaataacaaaactactaaaacatgtgctctcttaacatcttctttaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggatgtaaggaatcatgccaatcccatttcatgataatctttgaaaaatcctggagttgctaaaacaacatttttttaaaactccccgttcctggtggtgaattgtacaaatatatgagaggaaaaagccaccgtcatattatcatgactttccaattgctgatgaaaagatggtagttttaccaaaagattctagcaaagattatttttgagtgaaaagtaatggaggccgattctctccaatgactttcttttcctcagtaataaggaaggcagaggaacctgttgggaccattttattgtgcgccttctggcattcgcccaggaactcaggatttggtgatctttttcaaaacattgtcttgatatgctttataaatataggatatttatcagaaaactggtatacaaagaaaatttaccaggctaacttacaaggaagatgtgtgtgtgcatatgtgtatatgcatgtatatatatattttaaatacccatataattgaagtggttgaagcaaaaatgttccttatgtaaagtactaggtgtagtttaagtaattcttacttctcctgtcctgtggcatgaagctcccagcgtttcccatcaggccccaccgcccactggccttcacctagttgaaaattctttctacattttcctttccaagggctgataatatttaacctctatttttacattctattttttttaataaaaaagctagtttttaaagcctcatgacattgtaatgaggaatataaagtgaaggcacgcaacaaaactaatgtaaatgttaggtcacaaaatgtccagagatatagtttggttttgtttggttttgcttttctctctctctctcttttctttttttcttttcttttctttttttttcttttttttttgagacagcccctcactctgtcgtccaggcaggattgcagtggtgtgatctctgctcactgcaagctctgcctcctgggttcacgccattctcccacctcagcctcccaagtagctgggactacaggtgcccgccaccacgacaggctaattttgtttttgtatttttagtagagacggggttccgaggcgggcagatcatgaggtcaggagatcgagaccatcctggctaacacggtgaaaccccatctctactaaaaatatggttttgctttacttttctgcttagcttcatcagctcttcaacttgccctgtgatgctgatctcctctgcactactgtcttgaatgtcattctcaaagcagaggcttcctttccagaacagaatactctgaatccactgaaaacattccatggatttatcactgctccaggaagcaggagtccaggcctaattaccttgttttctgtataataacgttgtttgatctgcccaatttggcacacagtgggatttttccaaataattacttaatgatgtctactagataagccagagaaagtggactggttgatagaacaattaagtaatgcactagttgaacactaaccccaaagaggttgattaataaaaaattaagttgaaggaatgaggaaaagggagcactcaactcggtcttgaaatttcccagttacatcagtatgtataaaaataagggaggaatctttgttaagtgtatacaatacctggaaacatattttggtggtaaggctaggattctaaatttttttttggaaaaaggagaggaggggaagaaagaaaaagggaaaaaaggaaggatgggggagggagagagggagggagggagggaggaaggcagggagagaagggagggaaagaaaaagggataaacaagaggtatagtttggttaaatgaaatcattggcataagtttaagctgagggactctcagctcaaaacagtttataataagtggcggatcttcaaattgaccacaagctcaattaaattcaatagtgtggttcagtggctttgaaaataatatatgactagaagttcagggaccaatctaaaggaaatattgatcttgagttaataagatctttgaagcaagtcattatctctctcagctgtgtatcataatgaacgttaacatttattgagcatttactattcttcacagaccatgttaggcatttaattttatctcatttaatgttcacaattgccctatgaggtagctaatattattatggccattttatatgtgaggtattagaattcgaggggtcctataaggagtattttctgtcctcctcttgcctttgtgaccaattgagaagtagaagaaaaatcagatattcagataacagaatagcactttaactatggataaaacttaattggaaaacatgacttgaatctgcaaccaaatgggcttgttgaaaccaccctttcctccactgcctcacacatgtgcagacatgtactcacacatgcatagacactgcaggtcttgcctcgcagggcagagcctaccctgatgagctgacattaaaaataagctgagaaatgcttgctatcagagaccagcagctccacagaaaagaggaattctgatcacccatcagccgagtctcttctctccgggggaaagattgaatgaaggcagggagggaatgggaacgttgttctagttcaagtccttctacagaggaccatcaaacccatgtcctggaggttgcactgcaccatgtgtatatttattaagaactagcacattaactgggatatggcggtacagaataaatcctccctattgttcttatcattgttgagtaccacgtgcagggctgaatgcctgaagaagcttgtggctgccctgagcaaatgtctcctaaagatttatgctaggtcttcctgaagtgcagtcatccctctcgccatgagtagccatagaactaagaatggtgatttctttctctaagcagcctccagtctacagaaaatgtgatctgccatgtgaatcataggttataatctctatgcaaagtaattttgcagtttattattataaaatttacttaactatctgtgtattgttttctagtttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatcgttaacaccaaaactgaattcttatgcagaatttcctagcccatagatgacaacctgactttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttctgtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgttttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggagagggggtacagacttccttcttagagagtgtcagagaatatgctcccaatggtggaaaggaagatttacagtctagcggctaagtacctcctacacatttcccatcaatcagaaaatagacaggtacactaaagggaccctgagaactcctcttgtaatttcaacacacccaaaatcaagggcctggatgccagcagctgcagcaagcaggtttttcctccctgttgagcaagacaggtgagcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgtaatgtttggtctagttgaatctttgtgacttgtgtcaagattttctcactgctcagttctagagatacaaataaggtggagtttctcagatattaaattgttctttgaaaggtgcctgaaagaaactcttaattaaacactctcataattcggtctcccactgatactgactgggattttcctccagaaaatcatacagggggaacattaattaaatactcttaaaaatagtttgacaatgatagctgatttaaaataataatgaaagtatttcatgaacttacaaatgaagccaccatcttctacgaaatggtgatgtatatacatatatatacacgtgtgtgtatatttacacacatacacaatgatagcctatttaaaataataaaagtatttcacgaacttacaaataaagctttcacctcctacaaaatggtgataaatgatatatgtatattatacatatgacatatatataatattatatatgtcacatatattatacatatgacatatattatatatatgtcatatgtataatatacacatacacacacaaagaattatggagctcttgcattaaaatctctcataaatgagacttgaagaaattcaggtcatcaacctcatttgactcctcctcaaagacatcattctcttttcaatctaggaaactctcactctcttccagtaggaaacaatttatctccttggaatatttggtatcccattgcttctcaatccttcaccttttcaaaaaccacataagtttagaacaaccgtcttcaaactgtggtgtggttacccctgggagttcatgaaattgttcaaagggtatgcaggcatggttagggagtaagtttccatttcttcaacttccagatgtataccttccccaaactgccctgcctgaaatgcccagtgtttgagttgtcctgggttctccatgtccacctcctctctcatggtcaggccttattctcaggcctaatcttactatggtacattggtcaagggtaggaacactttttaacaccaagcaaacaattcaaaatattggtatctgagaaaagcttatctttcccaatcgtatagatatgtatttaatgatttagaaatgaagtatgtgggcccatgttggaatatttgtataggtatgtatttcatgatttagaaatgaagtatttgggcttgtgttggaacattttgaatatataaatattataaagtggtctaggggagaagacaattttccattaacatgccagcacttccatcccaatatttacccacaaaagccatcacccttgagagtaaaactgtgagagcaaacaaaggagcactggttagagacattgaaagaggacacagggttttttttcctccaagagataccaaactataacaaatgtctgagccttatctatctttcttaagttggaattcagatgtgaaatggtcaacacagaggcccatgtcgctatattgttaagattgaaaagagaagtcaaaaaaatttttctgacaaaaagtctgatgtaattgactggtttctctgctaattaagaaatataaaagacatttcttgtaaattacatgagctcgatctgcagctctaaggtttaaaaaatatatttaaaacatatgaaaagcacattataaaataattgatctaaaatatataaagaactcttgaaactcaataataagaagtcaaggaacccaactgaaaaataagcagaagaatttgaatagacacttcagcaaaaaatggtactaaaagcaaataagcacatggcaatgggaggtacattcatgagaagatactcaacacgacaatattagataaatccaaattaaaaccacaataaggtaccactgcatgctcaataaaataactaaaaagaaaaaagtgctgacaataacaagtgttgacaagaatgtagattgctaagcggtacaaccaccttcgaaaacgtgttgcagcttctcataaacct

SEQ ID NO: 11816 - DNA, 7561 bp, Human
tgttccttctgatgttcagatgtgtttggagtttcttccttctggtgggttcgtggtcttgctggctcaggagtgaagctgcagaccttcacagtgagtgttacagctcataaaggcagtgtggacccgaagagtgagcagcagcaagattcattgtaaagagggaaagaacaaagcttccaccgtgtggaaagggacccaagcgggttgccactgctggcttgggcagcctgcttttgttctcttatctggtgccacccacatcctgctgattggtagagccgagtggtctgttttgacagggtgctgattggtgcgtttacaatccctgagctagacacaaaggttctccacatccccaccagattagctagatacagagtgttgattggtgtattcacaatccctgagctagacataaaggttctccaaggccccaccagagtagctagatacagagtgttgattggtgcattcacaaaccctgagctagacacagggtgctgataggtgtatttacaatccctgagctagacatgaaggttctccacctccccaccagactcaggagcccagctggcttcacccagtggatcccgcactggtgctgcaggtggagctgcctgccagtctcggtgccatgcgcccgcactcctcagcccttgggtggttgatgggactgggtgccgtggagcaggggtcggtgctcctcggggaggcttaggccccacaggagcccacggcgaaggggggctcaggcatggcgggctgcaggtcccgagccctgccccgcggggaggcagctaaggcccggcgagaaatcgagcgcagcgctggtgggccggcactgctgggggacccagtacaccctccgcagctgctggcccaggtggtaagcccctcattgcccggggccggcagggccagccggctgctccgtgtgcggggcctgccaagcccacgcccacccggaactccagctggcccgcaagctccgcgctcagccccggttcccgctcgcacctctccctccacacctccctgcaagctgagggagccgactctggccttggccagcccagaaaggggctcccacagtgcagcggcgagctgaagggctcctcaagtgccgccaaagtgggagcccaggcagaggaggcaccgagagtgagcaagggctgtgaggactgccagcacaatgtcacttctcactaggattataagggtgagccaccacacccagctcttttattacagtataatgttataatttttttctttttctttgttttttttttgagacgtttgagacggagtctcactctgtcgcccaggctggagtgcagtggcgcgatctcggctcactgcaacctccgcctcctgggttcacgccattctcctgtctccggagtagcagggactacaggcgcccgccgccaagcccggctaatttttttttttctatttttagtagagatgaggtttcgccgcgttagccaggatggtttcgatctcctgacatcgtgatctgcccgtctcagcctcccaaagtgctgggattacaggcgtaagccactgcgccgggctaatttttctattttgttattgttgttaatctctcttttttttttttttttttttttttgagatggagtctctctctgttgcccagactggagagcagtggcgtgatctcagctcactgcaacctccacctcccaggttcaggtgattctcctgcctcagcctcccgagtagctggggttacaggcacgtgtcaccatgcctggcttatttttgaatttttgtagagacaggttttccccattttggccaggctggtctcaaactcctgacctcaggtgatttgcccgcctcagcctcccaaagtgctgggattacagacgtgagccactgcgccgggcattgttgttaatctcttactgtgggtaatttagtaattaaactataagaggtatgtatgtatgggggaaaaaacagtaatatagggtttggtgcaatctgtggtttcaaacatctactgggggtcgtagaacatatccccagtggataagggggtactactgtacttgttggctcttcatgttagctctgctaggcagatgtcatttcagagaagaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaagatgggagaaaggtgattctgattctagaagcacccatccctcctaccccattccccacccgcattacctgccatcctgtcagcacagtctgtctctgaagtgctccaagttttctctaagggcccatttggactcccactctcaagactcctcacttgcccagaaagctccttgctgaccttctctgtgtcttcctctcacccattcccttaggcctccctaatatcccctcccagggtctccctatcttgatcccagaatcttccttctacaggtctgctacaatgctgctgctgcacagagctgtggtcctcaggctccaacaggcctgcaggtaggccagcccatcccaggacttgcctcctagcccctatctgccacccttagtgtcttttacaatgtcataccttgcaaataagacagttgagagagtgtgtccagggaggacagagaaagccagatcccacttttcccacctatccctggagaaactaagttccaacttaaggaaccaatggccaaccagggagaaagaagtagaccccaagccttcactagccctttcacatgaccatacgtgctactaagaccgacctctcttccagactcaagtcaatcccctcaaggatctgcattcaggcctgctccacaaatgattcatttcagccccagcgccccagcctcaccttctctggtgataactccagcacccagggatggagagtcatggggaccctattaggtctcggtgcagtgttggcctatcaggaccatcggtgtagggtaagtagggaaagtgcttcattgtcagaacagactgggtgcagtggctcacgcctgttatcccagcactataggaggccaaggtgggtgggtcacttgaggttaggagtttgagaccagcctgggcaacatggcaaaaccccatctctagtaaaaattagccaggtgtggtggtacatacctgtaatctcagctacttgagaggctgagacacaagaatcacttaaacccaggaggctaagtctgcagtgagccaagatcaagatcgggccactgctctccagcctgggtgacagagtgagactccatctcaaaaaaaaaaaaaaaattgtcagaataaaggaatcagtcctagtaaactccacaggcaacccaggctgtgacccatgttcttgtagttaccacagagttcacagtgacgcagtcttcatgcacagtggagatgaaatctgctaatctgctaccttcgcttcccagtggccaacaccgtgggttgggtcagggtgagctcaagtgatttcttcttattcttcttcattttttcttttttttttttttgagatggagtttcactcttgttgcccaggctggagtgcaatggcatgatctcagctcaccacaacctccacctcccgggttcaagtgattctcctgcctcagcctcccaagtagctgggattacaggcatgcaccaccatgcccagctaattttgtatttttagtagagacagggcttctccatgttggtcaagctggtcttgaactcccgaccttatgtgatccgcccacctcggcctcccaaagtgctgggattacagttgtgagtcaccacgcccgaccaagtgatttcttcttaatagtctcttcccttttatcttactccttccctgccaataggctgctcaggagtcaacacacatatacactaaggaggaagtgagttcccacaccagccctgagactgggatctgggtgactctgggctctgaggtctttgatgtcacagaatttgtggacctacatccaggggggccttcaaagctgatgctagcagctgggggtcccctagagcccttctgggccctctatgctgttcacaaccagtcccatgtgcgtgagttactggctcagtacaagattggggagctgaatcctgaagacaaggtagcccccaccgtggagacctctgacccttatgctgatgatcctgtacgtcacccagccctgaaggtcaacagccagcggccctttaatgcagagcctccccctgagctgctgacagaaaactacatcacacccaaccctatcttcttcacccggaaccatctgcctgtacctaacctggatccagacacctatcgcttacacgtagtaggagcacctgggggtcagtcactgtctctttccctggatgacttgcacaactttcccaggtacgagatcacagtcactctgcagtgtgccggcaaccgacgctctgagatgactcaggtcaaagaagtaaaaggtctggagtggagaacaggagccatcagcactgcacgctgggctggggcacggctctgtgatgtgttagcccaggctggccaccaactctgtgaaactgaggcccacgtctgctttgagggactggactcagaccctactgggactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtccgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaacctgcgaggtgttctcagcaatgcctggcatcgtgtccatgtctatgtctccccatgagcatggaaaggagccacctccacccctttccccacccattagcctcactgcttcagaaaaatctttcccacctttcaacttcttggatcacaactctggccttcctaagccatacccaagtacacatatagcacatttcacccaaggaccttccctctttggacactatgttacatacccctcttggcctttgaacctgtgccaggaagtgtgagctgttacagcaaggggctagaagtgaaaaaagtaattctggagacaagcactattttctcttcctaccccacctccatttctaatgcctactgccatcaaggccttgttttgcttttctttttggattgttcagagaaatgtgtgtggcatgtgtaagaaaagtgtatatactatcttatactacctctccaggttgccagagagttgcgaggagagcaaggggcacaaccgtctccctttatagttctacttttctaataaatagtctgtttaagatcataactcttgggcctggggagtgagcctattgcaggaggaaggatgcatttgtactgggatgtataatgagattagaccaaaacaaacaaaactggggaggaagacagagaggaagtaggcttgtaggttaagaagtagggcttccggctgagcacagtggctcacgcctgtaatcccagcacttgggaggccaaggcaggtggatcacttgaggtcaggagttcgagaccagcctggccaacatggcaaaacccagtctctaccaaaaatacaaaaattagctgggtgtggtggtgggtgcctgtaatcccagctacttgggaggctgaggcaggagaatcgcttgaaccaaggaggcagaggttgcagtgagccgagatcacacccactacaccccagcctgtgcgacaaagcgagattctgtctcaaaaaaaggggggcttccttctctgaggtttggcagtatctgcagggacacctaggtgattgacctcaggataccatgaagagaggagaggtgacaaaaacatgtaccctccaactcctttccccaacagttccaatgcacttggcaggaaaggcaaagggtgctaggagtttaaaatcaatattgtcttaggaggtcgtgaaagcaaaataaatcttgaggccccagaatcactaagctaaagggaaaagtcaagctgggaactgattagggtaaacctgcctcccattcaaagtcatccctctgctcactgagataaatgcatacctgattgccttctttgagtggaatacaaccatttgcctcttttttttttttttttttgtagagacagagtcttgctctgtcacccagactggagtgcaggagtgcggtggcacgatctccgctcactgcaacctccgtctccggagttcaagcaattctgtctcagcctcccaggtagctgggacgacaggcgcacaccgccacgcccggctaatttcttttgtattttagtagagatgggtttcaccatgttgcccaggctggtctcgaactcctgagctcaggcagtacgtctgcctcggcctcccaaagtgctaggattacaggcgtgagccaccaagcccggctttttttttttttttttttttttttggagatgaagtctcactctattgctcaggctggagtgcagtggtgcgatctcggctcactgcaacctccgcctcccgggttcaagcgattctcctgcctcagcctcccaagtagctgggactacaggcgcgggccaccacacccggctaattttttatttttagtagagatggggtttcaccatgttggccaggctggtcttgaactcctgacctcaggtgatccgcccgcctcggcctcccaaagtgctgggattacaggcgtgagccactgcgccccgctccatttacctcttatctacctatgacctggaagcctcctcccagcttgagttgtcccgcctttacatatattgattgatgtctcttgtctccctaaaatgtataacaccaagctgtgctccagtcacc

SEQ ID NO: 11817 - DNA, 124700 bp, Human
atttcaaatacttctgtaaggtctaggtgtaccctgctggtgtttgtgatgtcctacattactcttgatctacttttgaactatgaaacaagggaaaaattggaggtccagagctcaggattcagatattattacctctgctactcacagcagagcaagtaacttagcctgtgtggaacttcatttttctttcttttttttcttttttttttttttttttagacagagtcttgctctgtcacccaggctggagtgcagtggcacgatctcggctcactgcaacctctgcctcccaggttcaaacaattctcctgcctcagcctccagagtagctggggttacaggtgcacgccagcaagcacagctaaattttgtatttttagtagagatggggttttgccatgttggccaggctggtctcaaactcctgacctcaggtgatccactcccaaagtgccgggattataggcgtgagccactgtgccaggcccactgtttttgttttttttttttcgtgatgacaaatttaaagtcatctcataggaatagaaaatagctttttagtagaagctcttggaatttaaattgagactgaatggaaagatgaaagaaaataaacttattaacatttaatgagaaccttcaaagaactaggcatagtaccaaatggttttatatttttaaacctcatttattcctctcaaaacacctgggaaggagatatttttgccatttcacagctgttgaaactgaggctcaaaaagactaagtaacttttctcagctacacatgtggctgagccagtatttgaacccagttctgtttgcagacagaacctgggctttttcacacctgcaaactggaaacattaattggttcttaagatcatcatcgatgtgataaaacctgggacagaaattagtcaagactagctgcatctgccttttcctctggtgggtaggaaaaggaggagtataatgatttcctcaggcatgaaggtcgatgatgagcaaagtgtatactctctaatctaatgtcataattcatattgtggagtaattatctggataagtgtagggtctctgacctcattctagatattgtacattccatggctattttcattttggtccatgaactctctttgctctcatgagcaccatttttatcccaatctaatcctgtatgtttgtgtttttacacagattagtttttaaatgttatatataatttgcttctgaaacaccattgctcaatgactaccaaatctttctcattaccaaaatccttctatgccaacttcttcaagaaatttgatcacctttagatgaattgttaatgaaaattaaagctatagccagcaacatgggtatctttgggctaatggccaaccaacaggccatctgtgtgaaagaaaacaggctaacaattttggactctggtctcttggggctacattgagcattgacctcaccggtgctcactgaaattaattgcttttcaggttgtattttctcatcacggaaaccttcttttcccaattcaaaccatgtgggttaaaatgagaaaacaaaagccaaaacggcttcccacacccaaaagctccttctgtcagagatcccagtagccccgggagagctgttagaagtctgagaaggattggtcatcatcgcataccatacataggtggagggcttgttattctcagtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggtaaggtttggctttattttttttaatttagtattttaaaaaacagagttagtgatttctgggtgctctccccaaatctcatcagtgctgatgaacaaggggtggctgtagcaaaggcaccatttctctgtgagtctccagtcaatatgtgtggaaggattgaaatgcaaaggctctgtggcatgaactgattttgctagtttgtcttctgggtgattggcccctgtgttagaaactctttgaggaccgattaaatcatcttatttgaagagatccccttactatcatgcattattttcctgctcctcattctggagtgtttttcttattgatttttttttaaagaaccggttttacctgctttaaagaaaatcttcagtaaaaaatgaaattcatgctgagaaatacaggggcccaattaaggcagtgtatagattgtcactgttaaaagggaacaaagatgcttttctgtaaaaagattttatatctacatcctattttaagcaaagcaatgaaattgtaggcttttttttttttttcttgtagttagggtcagggagattggggctattagaatttttgttttattttaaaaattgtttgccatgtagtaattcataaagggtttactggcccaatgaaacaaaaatttaggcagttaccaaaatctttaacacaggagagtatatgaagcctgttgtagagtgaaggagtggttggccagtgtgttgggttcagtgtgtttattgcttagatactccagatagtggtgtgcctctgtagctcactcagcctatgtgacataggtagaaggcagtatccaaacctgaactacagatcacaaatacatttatcattgccatcagtctctccccttcggtttgaaaacattctaattttaataacgaaaatcgaattgatattggagatgaatttgggaaaattcactaaacttcatggatatagggcatattaatataatttgatttgagtatacataagtatctgctatattttctaggtgtttgaactattttattaaatattcaaaaaacaaatccaatgaaataactgagttgaatacaatttgttttatagctctcaacaaccaatattttgagaatttaataatattctttaagaatgtgtaacacaagttgctaaaaattaaaagattttaggtggcttcagtatttatgtggaaattgtttaaataatgttgacttctccaataatatgtacttcaaataattatcatgattccatttttgattttttttttctgagtgccattatttaccagtgacatgaaatctggaacttactctataccagggattatagtgatgtgaagcccaggtgtctatagtttctctgaggtactttgtaggttaatacacacacaactgttttcattcactttttttactcctaaagcaactgtgttatagcactttgcaatacaggcttagaagaattgtcataaaatcaaacaaaaaggtatgtagccaaaatagttgttccatgtctagaccttagatccctggaaaaaacagcactgcctttaaaagggagaggaccaaggagaggaagtaggtcatgttcttgttaggaagggtgacactagcaaggttagtttctgaggtaagtctgttgtcttgatcgtagcttgcattcctagtctaagcctccatgagcatgactgctcaaagcttgataattgcaacaagaatccagctagatcatgtccacagccataggagcccgttcctctagtcaaactcctggtagactatagcagtggagcaaggggcttatggcttaaaggtttatctctctagtccagtgggttgtttcttgtttcttttttctgaacccacagactgaaaaaaaaaaaagccacttttttttagtgaaggtggctctggatgacagagttgtttacccataagagggctggaggggatgtgtagctctcagaagctccttacaaatactcctagattctgttgctttccttttctgaattgagaatcattgctaacttcagctttcaaacaggttctattatattagcttttccctactcttctatcctcataaaaccaggctgttctctttaaaaagctgtatatgtagaaaactaacaaaaaaatcactgtgatttatcatagtatcttctacgtgatcaacaatgatctaataggaagtctctagtctcatgctttcatacctctttactgtgtcacttgactttttttttttttttttgagatggagtctcgctctgtcacccagactagaatgtagtagagtgatctcagatcactgcaacctccgcctcccaggttcacgtgattctgtgcctcagcctctcgagtagctgggactacaggcgtgcgccaccatgcctggctaatttgttgtatttttagtagagacggggtttcaccatgttggccaggctggtctcgaactcctgaccccaagtgatcctcccgcctcggcctcccaaagtgctgggattacaggcatgagccaccacgcccggccttgtcacttgacattttaaataacaactggattcagagatagcagacatcttgtctggggtggcagaggaaacagttgtaaggtcagggaagtgctcccagatgaaaccccctttttagggctggtctcagaaggctagtgtcaggtctgagtaatcaagggtggaggtctgaaagctgggatcggagacaccctttggaattattctcagagggaggagcttgcttttttcacagatgctcccttccaagcattgtctttattgtttgttaggtctcagcatttccctttcagccctgccctgggagagcttcctggaagagtctagttcttccaaggcgtctctccaggagagaaggagtcttctaagttcatctcaaaagactatgtgatgttctctggggaatttaggtgggtgggctctaaattcttctgaaattatcagtttgcctcctgagcctctatctccccaaaggatatctgtgtgattgtatcacctgcttattctctgtagatggcttactggtgagctcacagaatcaggatttaaatagattgttctaggctggaagggtggaaaaccaaaacaaaaagataccatttcaaaataggtaaatgtctggttctgtgtttgggttcaagaaataagttatgtatatttaatgtgggagagacctggtttgttgaaagttcttgtgaatgacacctaggttttggggatacacaaaagtcatggaagacaacataggctctgcttgctaaaaaggtactgcataagctgtcatatgttgcattagcagaaatatgaagtccaaatcagaaatggtaatcacttcactgaaatctactgctaagagcacatccatgaagcactgaagacctgagaaatttaacagcgaacatagcaggcaaactgaaggaggaaacatggattacaaagtcaaagcccaacttggataaccataagcaagttatttaatttctctaagccacatttttctcatcttttatggatgaaatacccattttccagggttgtgatgagaatcaaatgtgataatgcctgtgaaatgcttagccagtgagaactctcttaataaatgaagcttggggcctggtgctgtggctcacacctgtaatacagcactttgggaggcccaggcaggtggatcatgaggtcaagagatcaagaccatcctagccaacatggtgaaaccccatctctactaaaatacaaaaattagcaaggtgtggtggtgtgtgcccgtagtcgtagctactcgggaggcttagacaggaggattgcttaaacccaggaggcagaggttgcagtgagctgagatcacgccattgtactccagcctggtgacagagtgagactccgtctcaataaaataaaataaaataaataatgaagctagtataatcaaaagagaagtgttgctatgagaaccactgtgctagtcaagactgatctaatctgccccaggatgtaggagaaccacttaatattcatagatgctgtctctttctacaaaacctcagtataatcctgtctctcaaactttgtgctggccaattccaactgaataaacccaaacactttgccaactacccatctaccctcccctcacttatccatttatccctgtttgtatcttgtctgcttcaaccaggcccatctccacaatctacacattctttcctcttggctcttgttcatgctgttccatccatttagaaatggcatctttcatctctactctgcaaacacaattcaactcaatttgcccaggccaactcttcctcctgatgttcttcccctaagtttaggctcctttaccatgcagattgtgtctttgagctttgggcagccagatttagcccaattagcctctaaatctctcacaacagatattatttcttttctattctcattagtacatgtatttaatgtttagtaatttctgttgaatggagttttatggtcacagtaagaaaatgttggtacttcacagcggagctgaaaggaaaagagaacattgtagaaaggatctcagtaacatcgaaataataatattacattgggccaggcacgttggctgatgcctgtaatcccagcactttgggaggccaaggtgggcagatcacgagatcaggagttcgagaccagcctgaccaacatggtgaaaccttgcctctactaaaaatacaaaagttagctgggcatggtggcatgtgcctgtaatcccagctactcggaaggttgaggcaggaaaatctcttaaaccagggaggcagaggttgcagtgagccgagattatgccactgcactcgagcctgcatgacagagtgagactccgtctcaaaaaaaaataaaaaaaaatttaatattaggttggtgaaaagtagtggtaaaaactgcagttacttttgcaccaatctgataatcaattttatatatcttgtaaatgatattcactctcatcttaaaagtttagcttatattaaatgtttgatgtaaataaagttgaaagaaagtttcttctgttaggtgtgaaacataaaagatatactcataaaagtggttctaaccagggccttacttaagatgaggtattgtatgattgttgaatattacctataacatagtcgtattttctattcaatagatatttattgagttactgtgtgccaatcattcattcattcattcactcatctatcctttcaataaacaaagacttattgagggtttcctttgagccatgtactgtcctggaaactaggaatataaataaggataaataattttttccctttgctaagctcacattttagtgggaaaaatgaatataggcggatgaattgtaaaatgttgtgataaatgatttaatagagatattacagcaaataaaggtatttacaaaatctgagcttttcaagggctgtaaaagtttttattgggtccaatgatacaaaatgaaatagcaatatctgaattgagcataaaggtctggtgcagtggctcacacctgtaatcctagcattttgggagactgaggcagacaaatcgcttgagcccaggagtttcagatcagcctgggcaacgtggcaaaaccccatctctacaaaaaatacaaaaattagcctggcatggtggcacgtgcatgtagtcccagctactcgggtggctgaagtgggaggattgctggagcctgggaggtcaaggctgcagtgagccatgatcataccactgccctccagcctaggcaacagagcgagacattgtctcaaaaaaaacaacaaacaaacaaacgaaaccaaattgaacataaatatttaattaaatgtctaaaaacgtggaatgtcaactaaagaaaatgagtagtattttgaaaacaacttgtaggttgatttttctgtctttgcaagaactcctaaatagttgtgaatattgccaaaagtcaggtccagttatagttataacttgctcatagccaaatgattttgaaaccaagatgaaaaggaaaagggaagaaaggacatagagggagcaacctatataaagggggtgtgtataaaatagcagggcaggcttaaggaagctgagtgaagctgtaatgtaggatgaaggtagagaattaaagttggggtcagatcaagaagggcctcacaggccattttaagtaggttgtccctcattctgtacatgttgaaatttagcagagtgtttgttctatcatgtcatatatcagatttatgtcttgaaaaattcactctaataatagttttcaggatggattaacatggtagagaccataggctgggaccaagttggcttcctaacattccaggcaagaggactgtgaggataacagggggcttgagagagatttaggaggtgaaactgcaggagttagtgattggttgtatatggaaggttgagagggagggaggagaataagtcattgctccagcattctgatttggataatggtggtgccattcagtgtgctgaatggaggtgggctgggataaggcaaataattattttgttcatgttgattttgaggctacatgtaaaggaagtttttttttttgagactgagtcttgctgtgtcgcccaggctggagtgcagtggcacgatcttggctcgctgcaagctccacctccccggttcaagtgattctcctacctcagcctcctgaataactgggattataggcacctgccaccacacccggctaatttttgtacttttagtagagacggggcttcaccacgttggccatgtcttgaactcctgacctcatgatccacctgccttggcctcccaaagtgctgggattacaggcgtgagccaccgcacctggccataaaggaagatatttatcaaaatttggctgcccacatctgaagctcagaggaaggggattgggcaagagattgagatgtagaaatctttggtatatggtaagtgaagccacgggcatggctatatttcaagattgaaatgaaggaacgagaaagagcagatacccaaaaatttgatgaagaagaaacaggtaaggagctgacaggagaagcaaaaccaatgacattcctatcctgggactttagagaattgctgctgtagcagccatggaaagaaatttttttttttttttttttgagtcggagtctcgctcagtcccccaggctggagtgcagtggtgcgatctcggctcactgcaagctccgcttcccaggttcacaccattctcctgcctcagcctcccgagtagctgggactacaggcgcctgccaccacgcccagctaatttttttttttaatttttagtagagacgtggtttcactgtgttagccaggatggtctcgatctcctgacctagtgatccgcctgcctcggcctcccaaaatgctgggattacaggcgtgagccactgcgcccggccggaaagagaattttaagaagacagtaagatggggcagcagagtaacagcctccgggcctgacactggagcaccagcctgcaggtgtgttattttacagagagccagctgcaccggcagcatcaccaaaccagagctggaagagagcagctggcttcactcctggctttcaggaaagggaatgtctaaagttgcctcccttatttttggaattttgaactgataaccctattcttacccatctggccagacgattccttaactcgtgttacacctgcagaatgagttttagatctagctgtgacctcttcccccagccccacccccattgtccccttgtgtgccttcaggaatctgatcattcttctctcctgctccttcccaaaggctgcaggagcaggtgtgaagacgtggatgtgccagatgcagagtcctgacacttttcaacacatctgcatattagaggaagtacatacccattgcttggtggtttcatgtctaatgtggtatgagtgtgacaaagagagggagaaaatttggactagccaaagaagccagtcaggcgtggggtttgaagggcatcgtgggcggctgtcatttgctctctgcttgtcacagccccttgcccagggcttgaccagtgaggtgtatgtgctggtcacacccatctcagcagatctgtcagctttcccgcttttgttaaagggtgatatcatgcttcctggggggagcactggaagacaatgctcggccactttcctccagatacaataggcggagtcaggaaggcagtattgacattgctggggctggggaggcactcactgctctgcggccgtcagatggtgaaccagcttaaccttggcacacagggcctgggttgtgcaaggcgtctggctgcagagccaaaggggactccaccctggggacaggagtgctttagacatctgggaatctgggatgggcttcaaattctgatccctgtgtcagaaacaaccacaaaacaataagagtaccagtaataacaaaaatgactaccctaggttgaatgcctttatgtgccaagtgttaaatatgatttttaatatttcacaactttacactataggtattattatttttttaatagacagggaaaccaaggctcacaaaggttaagtgacatgtccaaggttaaaatgtaagtgaccagccaggtgtggtggctcgtgcttgtaatcccagcactttgggaggccaaagcaagcagattgcttgagccaaggagttcgagaccatcctgggcaatatagggagacccatctctacaaataatacaaatattggctgggtatggtggcacacacctgtggtcccagcaacccgggaggctgagatagatggatcgctttagcctgggggttttaggctgcatgaatgtcgtgatcatgccgctgcattccagcctgagtgacatagtgagacctcatcttaacaacaacaaaccggaaaatggcggccatccattattttggatgcctaacatttcaaactttcaagaactgccgtgctttccctctaggtgattctgatgggtctgccaatcactggtcacagaatgtcccagccaactaacaacagcagttggttcaaacagaagatgcacaacccaacagggccagttagactctttccctgggaatttatgagcactttgaaagcaaaagcctctctttcttcatagaggacactgtatccctggagctaccaacttcgctgaccacttgaaggaagctagtctttagtacgagagaatgaggccaataacaaaagatggaccaagacaggcactctgatagcatttgagacgtgggtccaaggattttcaaacacgcagccctgcctctttcagttctgtgagctagtttcttttatttgtttaagctattttgagttagcttctatcccttggaagtgaatcatcctgactgaccacatgtctcagtaggaaatgatggagacaagagttacactgaaaaatgacctgaacccgaatcctgggctctttaaaacacctcactgtgctgccttcgaactagtgtttcatggtcacctcaggttagttcctagaaaatgaagctaacagcatttcttcatgtggttttggggaagaccttttaaaaaaaataacttaaaaatacttagaacagtgccggctcatagttagcactcgataaaaatcagatgttattaagatttgcttataaatgaaactggtgtctcatatgttaccttatgttactcctttcaaagcacatttttatccacgagggcaggcaacccacattccatgcagatgaggctccctggcttcccttggtgtcctaagtctggccttatagtggggacaaggtgagagaggcttacacctgtgggttcttgggcttctgctaaaaatgtggagagtcgggtggggagattcctctctgttgctcaacgagctggcaacattgggctcccaatctttttcctgccagcccccagtttcctctcatttctgggtcgtgactgatcacgggctctaggatgatctgtcatttgaaggttcccacctcatttatcccaaacctattgattcctatttcttgacattttttttacttctagtggaatctgcctcacttgtgactaagcttgttgcatttttggacccatcctggtgtctgtgtgcacatgcgtgtgtgtgtgtgtgtgcatgtgggtgtggatgcacacgtgtgagagaaagaaatagctctccctccatttcagcacatatttgctctaattccaccttcctttagtctccattctactttgtgtccaataccccttgcatctggaaaggatgttctaatcttctggggttgatttaaacatccatctattttattaatcattgctaccacttcagaatcgaagaagacggtggtggcagtggtgattgcttgtggtcagcagcttttcaggagacagtctttgcctgcctcaccagcctctcgtggttctcagtcccacatactatgatggaagtgtactcaagtcataccagactctttgcagtttccaaacattcatgttcaagcatttatgcctttgtgtatgctggtttctctttctagcatgcccttgtcacctcttcttcacctgctttacttatttatgattagaggtttagctcatgtgttatatcttctaagaagtcttctttaacctcctcgcatggattagggccctgccttagcctgaggcgaaaacatggcctgaaggccaaggcatatgtgcaggtggattatgtgggataatgatcccaggaagcaagagtgagggactagtggaatgaaactctacaaggatgcattgtcaagctggctgcagcgacagaagcctggtgctccagactttctgaggagccttatgaaatgagacttagaacttcatccgcaaatgaaaaggggaggcattcatctattgctattccctttgttcaagggttatgtagacctaagaacctagcaggttaccataggtgaggaagtaagatatactcgactgggctctaggtgagctactttgagactgcacctgctcaaagatcagaagtggcccttgcaggagcagccagggcaaaagctgggatgaggagggtttgcactggtgcctaagaggtttcagatacaggcaccttggtacttgcctttgtcataatacttagaaaatttaattacaatgtgcagtttactggttggttttgcccgctggactatgagctgtgtttggcatttcagtatttccagtacctgacttgatgtactagctgacgaagaaatgctttaataaatagctttgctggctgggtgctgtggctcacgcctgtaatcccagcactttgggaggctgaggccagcgaatcacctgaggtcaggagttcaagaccagcctgaccaacatggcgaaaccccgcctctactaaaaatacaaaaaaaaaattagccaggcgtggtggtgcacacttgtagtcccagctacttgggaggctgaggcagaagaatcacttaacccgggaggcagaggttgcagtgagctgagatcgtgccattgcacttcagcctgggcgacaagagtgaaactctgtctcaaaataaataaataaaaaaaatagctttgctttgtattaaatgttctgagttagggttaccttaagtgtgttgtatatattactgctggcctgcaagatgatttgtatatatatttcataaataaaaatttattttattttataaatatattttataaatttatatacatattttatttgtatacatatgtatttttatatgtataaatatattttccatattatatgcaatatgcaaaattatttacatatataaacatttatttgcatctgtttatagatatatgtatatatgtgtgcatatgtatcatatcagtcatgtgatttcatgattagtcctcgttaatatgaggataagaaaaaaagttaatttaaatataatgattgatagaaaaattgcacaggtgatatgtagactcagtaagaatcacaaaagtgatccatgaatgaatgcaatttgagagacactgctataaccagatgagttagccactcgaatcctgtcctttttagaactgtgtatgtgcatgtgtatccaaagaaataacaaaagcattttgggcgtgtaattaatgctatcctagtgacataaacaaagtgaaacagagtttcacagtgatcgacctgtctcaaagcaccgtcacggattctaattttgtttctcccaggaaacctggaaagtgggtatttgttaataaaattatagacaagaccttgggcacagtgggcttcctcacaaaaggcccagctaacgagcaggcaatgcccgtcagtagagaaatggttggtcagttctactcatccattccagctagcatctactgaaccctttttatgtactaggaatctgctaggcattggagttccaaagatagttaagagagggacttgaactcaagcagttgcagtctggtgggtgagaaaccctgccctaataaaggcagatggaaacatggaaactggagtgagcaattctgagagaaaacagggatctcaccaggagggtgacatttgagaagggagaacaggattatggaagatcaggagtggaagtgaggaggaggggcattctaggcagaggggaaagcatgaaaatttgggataaaatgtttaagagacttttatgcagtggtttttgcggctacacaatgggttcattgaagaaggtggcagggattaaaagtgggaagatgggttggagaaaaggtaatttggtttgagattggccaagtgggcagggacagagacacttataagagcctttagggtataggatgaagcggtgtgaggtagtgagacgtgtctggagataagaggaggacagcaggtaggtctgggaacctacatcgagaggtaatacgggtagagaaagaggagactgatgatcctgaaaggatgtgccaaggaaggaggagcttcaactatatcaaaaattggaggaaagaggccgggcacagtggctcacgcctgtaatctcagcactttgggaggccacggcagctagatcacgaggtcaggagatcgagaccatcctggctaatacagtgaaaccctgtctctactaaaaatacaaaaaattagccaggcgtggtggcatatgcctgtagtcccagctacctgggaggctgaggcaggagaatcgcttcaacctgggaggcagaggttgcagtgagccgagatggcgccactgcactccagcctgggtgacagagcgagactctgtctcaaaaaaaaaaaaaaaaaaaaaaaaaaactggaggaaagagcaggctaggaagagagactagagaattggcagctgggtgctgttgcgaagcatttttagtgaatgggcagggcttgggcttaggagaaagtgggaagggagggagatggggcgggtaagcatagattcctttctgggagatgtctcacatcctggtaggttcctatttccatgtgctttctgtaagcttaattatagggtgagctgctgaaaggggttaggtccttctctctgccgtcataggctcaaggtactaaaaggatatgcgggggtgtaaagggagtaaggaaagagctctgccatcacaggtactctccttcccctgcatgtggtcccttaaatcacctgaattaggcgatattttagttttataaatacactgtaatgagggtaggtattttcatggagaggccacgcacagttacctggagtaacagaatactggaactgtcagagacataaaagattatctagcccagtgtttctgaaatctcttaacagaataccaattctaggagacttgcataatcttttttattgtttttgagtatcacgtggagctaatgttctatattttgaaaaattctggttcagtttaacctgctcattttacagatgacaacactgaggcccagagaagtcagcattttgttcagattcagtcaactcaatagaggttaaatttcttcattttatttattcttttgagatagtctcactgtgtcacccaggcaaaagtgcaatggcatgatttcggctcactgcaacctccgcctctcaggttcaagctattctcctgcctcaccctcctgagtaattgggattacaggtgcccaccaccacacccggctaatttttgtatttttagtagagatggggtttcgccaagttggtcaggctggtcttgaactcctgacctcaggtgacccaccctccttggcctcccaaagtgccgggtgggtggcgtgagccaccgcagctggcgaatttcttcactttaaaagagcatggaaggcaatgtaaattacagcttaatgcacgtacagtgtagtcagacaggctgagcttgcatcccagccttactactgtatcagttagttgttgccatgtaacaaactactcccaaaactcagtggctaaaccaacatttataattactcccatgtttttggctcattcaaggttcagctgatctatgcttgacacagctgagtagctctgcttcaggttgcagcagctggggcagctctgctccttgctgtaggtatgtgggtttcctggatgactctgcgcacatatcatctttcttggatcagcggatcactcagggcatgttttactcgtgatgttagaaacacaagagagctaagtagaaacaagtaaacaagtggggcttcttaaggccttggctcagaactagcatgttgtcacacccaaagtgatgtgcccaaagtcaagggacgggaaatacactctgcccacaacgaggccaaagcagaaatgtggaagcaaggaaggatggagagttggggccaataattcaacctattataacaactactagctttgcactgtggtgcaactcactcggcttcatctgtaaaatatgcagcatgatagtacctacctcatgggttttttttggagggaggagcaagtaattcaggtagttcttataaaccatttagaacaatgcttaaatttagaaaacacaaagaaaattagtgacagtactaatatttaatccatctaaccatcaacacctgtgcatatgaggtctatcccaccagagtggctataggagggttagggttgacttcgcagattggcctagtgtcagctgattctcttccagcagaagggcttgaaggagtgaccttcggaacagtccccagtcgctcatttataagtcccctttttcctctctcataactgcatcatagccacaaactcaagacccaaccagcatgggcttgcattgtgttgcctggtctccccacccgcctcggccctgtgtatctcacacccagagtcagcagtgcttttcacacaaaccatctgccaagagatgtggagctggagccagaaacacacaacagctgcagaagctcagccacattcagaagcctgtagtaatcgcctaacaggcttggatacagctctgactgctgagtaactctagagtatggaagcccatcagtaaattatgattgcagcatgagtaatacatgagttctgccagctgcttctggaatcaaacaaaagacagtgctgttgccagccaggaaaaagtcacctttaagtgcatcactgtcttctttttcaggctaggagagccggtgactaagactagcttctattagaggccccctttttctctcctagagatctttctaatgaaactcatggcttataacccctaccaagcccatcttttcaccttatgcccaggcagttgagaacacagactccggtgccagataaatctgggttggagccccattcaaaaatgtgacagctgtgtgaccttgggtaagttgtttcacctttctgtagcatgaggataacaatattaccctttaatgagggttacatgatttgaagcatgtcaaatgcttagcaaaatataggtgtataacaaatgttcaatataatattaactatcattatttttttgtatctccctgtgctactagggtaattgctcctaagagtaccctgcctccaagaatctgtataaatgttgttccattccatcccacctctctcaacacatctcatttctttccaactctttctattctatacatattttttgagcttctactctgtgcccaacactgagtcaggtactcagaagatataaacagaaaaaaacacagaaacttgcagctaaggaggtttttgttggggtcacagctagacatgcagtagattgttgttattcatggtgcttatgttctgtaaaccacgaacacgaggttagggtcactgcaagcttctggtcacgacattttcgtcaacacattaatacataaccctgctttatttgtgtcttggtgtaaagacaaaccatttggtctccgtggctgattcattaacattgaactcatagccagaggcactcctgcctgaacaaagcttacctaacacataagttttctcctaaggcatatcacagctttgtgatgtttaagaagtagatggcacttcagcactagacttgggaccattgtaaatggtgaaaatggcaataaagagcacaaaaatattaaaaactaatgcactaaatatatcacaaaaaggacacttgtttatagtatgagggctgagcagaagttctgcttcacctgggaatgtgtttatccagggactctgtgcatgtattcaaatgactgggaaagtgcttttgaggttacaaataaattctagccagtagacaaatttacacatacagaatctataaatgatgaggatacactgtatataaaaatgactatgcaagtcagactgcaataaagtttccatagaaatacagggcaatatagcacagaccagagagaaactgctccagtctagggtaatcaatcaggctccactaactgaaatgagacttttaaggacatttctgacacagaggagacagtagtgatggaagcaggaggaattaaaatatgtggctaaatgcagccagattacccagattggggccagaggatggaaggattttggcttccatcactgtacagtgtaacccagatttgactggattccccgaagcaggcctctcctcactcacacccattacaagcaagagccaacacttagagatgccaaaacaacataaaacagatgcaactccgtgatgttagctagtaacacaactttttttgttttattatactttaagatctggggtacattttgagcagaaagtgcagttttgttacataggtatacatgtaccatggtggtttgctgcagctatcaacccatcatctacattaggtagttctcctaatgctatccctccctcaacccccaatcccctgacaggtcccggtgtgtgatggcccccgcacccgtgtccatgtgttctcattgttcagctcccgtttatgagtgagaacatgcagtgtttggttttctgttcttgtgttagtttgctgagaatggtttccagcttcatccatgtccctgcaaaggacataaactcatccttttttatgaatgcatagtattccatggtatatatgtgccacatattctttatccagtctatcattgatgggcttttgggttggttccaagtctttgctatcgtgaatagtgccacaataaacgtgtgtgcatgagtctttatagtagaatgacttataatcctttgggtgtatacccagtaatgggatggctgggtcaaatggtatttggtatttctagttctagatccttgaggaattgccatattgtcttccacaatggttgaactaatttaaactcccaccaacagtgtaaaaacgttcctatttctccatatcctccagcatctgttgtttcctgactttttaatgattgccattctaactcatgagagatggtatctcattgtggttttgatttgcatttctctaatgaccagtgatgatgagcattttttcatgtttgttggctgcataaatgtcttcttttgagaagtgtctgtttatatcctttacccaattttgatggggttgtttgattttttcttgtaaatttgttgaagttctttgtagattctggatattaaccccttgtcagaaggatagattgcaaaattttactcccattctgtaggttgcctgtccactctgatggtagtttcttttgctgtgcagaagctctttagtttaattagatcccatttgtcaattttggcttctgttgcgattgcttttggtgttttagacatgaagtccttgcccatgcctatgtcctgaatggtattgcctaggttttcttctagggtttttatggttttaggtctaacttgtaagtctttaatccatcttgaattaatttttgtataaggtgtaaggaagggatccagtttcagctttctgcatatggctagccagttttcccaacaccatttattaaatagggaatcctttccccatttcttgtttttgtcaggtttgttaaagataagatggttgtagatgtgtggtgttatttctgaggcctcttttctgttccattggtctaggtatctcttttggtagcagtaccatgctgttttggttactgtggacttgtagtatagtttgaagtcaggtagcttgatgcttccagttttgttctttttgcttaggattgtcttggctatgcgggctcttttttggttccatatgaaatttaaagcagttttatctaattctgtgaagaaagtcaatgatagcttgatggggatagcattgaatctataaattacttggggcagtatggccattttcacgataccgattcttcctatccatgagcatggaatgtttttccatttgtttgtgtccttttttatttcattgagcagtggtttgtagttctccttgaagaggtccttcacatcccttggaagttgtattcctaggtattttattctctttgtggcaattgtgaatgggagctcgctcatgatttggctgtctgtttgtctgctattggtgtataggaatgcttgtgatttttgcacattgattttctatcctgagactttgctgaatttgcttatcagcttgaggagattttgggctgagatgatggggttttctaaatatacagtcatttcatctgcaaacagacaatttgacttcctcttttcctacgtgaataccctttgtttctttctcttgcctgattgccctggccagaacttccaatcctatgttgaataggagtggtgacagagggcatccttgtcttgtgctgattttcaaagggaatacttccagtttttgccccttcattatgacattggctgtgggtttgtcataaatagctcttaatattttgagatatgtcctatcaatacctagtttattgagagtttttagcatgaaagggtgttgaattttgtcggaggacttttctgcatgtattgagataatcgtggtttttgtcattctgtttatgtgatggattatgtttgtaacataaaatttttagcaggtcaaaggaaaagatgatttgtgctgtacagtgtgtaaaataaaacttaatacatgcacaagtagatatctctctgttcttatgactaatttcctttccagttcccagcctactctttctcttctcttccacagcccctactattcctggaaattccagttttgcacatacatccccatgccacttcccccttgcatatataccacttggcagaacaaaaaccaggtagttatctaagcccatctcctctggaaatcttagcaggagctctgtattgttactcaagcatggctttcagtttttactccatccttcattgagccccttccaaggggcttatgcaaatattcacccaataaaatatttccttcatattttggcacaagcaataaagaagtacaaggtcccagatcagttgcccctccctatcattgcctctgcctgttattcctgacagaataagcatttttctcatcttaaacgcatgatccatggtttctgcaatttctaaagaccctagaccaggctctggccacactggatattcaataaatgaatagatttccactaaactgatggctttggggaaagagatattgtataatattttcttccataaaactcataggtaggtttaagtattgttttcttatatatttcacagcaaagtttcataattcgtatcacataagttctaagcattgccttctaataactcttatccaatcacctaaagatattggttttgaaatttaacaaaataattatacactttgtcttgaagaataagcaggaagaatagctgaaaaaattctgaaaaagaaaagtaatgtcttgagaatagttttactggatcttaggtggaatatgctactgtaataacagtgttacagttccaggaatttggatgcacagatcaacagatgaaaggccagaaccagacttgagtttatataaaatttaaataatcttataaagcatacaaatcaatggagaaagaaataacaggaaaactaattttctgtttggaaaaaagggttgtttaaaaaaaccatctcttaccacacaccaaaataaattcaaaatggattaaaatgttaaatgtaaaaaaactcaagccatcaaagggagaagatggaaatgaatatatattgaattttcatatgggaaggactttttaagtttaaaacacaatagaagaaaccacaaaactaaaaatcagcacacttggctatgtaaatatttaaagtgtcaattcaagaataataaaaggcaaagaacaaaaagagaaaaatacttggaacaaatatggtaaataaaagattaaagtacttttttttttttttttttttgctcactgcaacctccgcttcctgggttcaagcgattctcctgcctcagcctcctgagtagctgggattacaggtgtgcaccaccacgcccggctaatttttgtatttttagtagagatgggatttcaacatgttgatcaggctggtctgacctcgtgattcacatgccttggcctcccagagtgttgggattacaggcgtgagccaccgcgcccggccaaagtactttaaaaaacaaaacaaaacaaaacctcattgaaagtgatagaaaaaaataaaaacatcaatagaaaaagagaggaacaagtaattcacaaaaggaggaaatacaaatggcttataagcatgcgaaaagtttaccctctaaaacaaatttaaatcaaatcaaaacaagataccaattttccacgtcaaactagcgaagattaaaaacaagtgaaaaggctcagtaatacatggctgaggttggtgaaatgttcactctcttacatactacacctttttagaaataaacttggcagtgtagaccaagagcttttaaaaagttatgataggccaggcatggtggctcatgcctgtaatgccaacactttgggaggccgaggctggcagatcacttaaggtcaggagttcgagaccagcctggcctggccaacatggtaaaaccccgtctctattaaaaatacaaaaatcaggtgggtgtggtgctgtagttccagctacttgggaggctgaggaggttggatcagctgagcccaggaagcggaggttacagtgagctgagatcatgccactgcactccagcctgggtaacaggacaagaccctgtctcaaaaaaaaaaaaaaaaaagttatgataaaattaagtaaaaattcgaatatgaaacagtatttggccaggcgtggtagctcatgcctgtaatccccgcatgttgggaggatcgtttgagcctaggagtttgagaccagcctgggtaacataaggagaccccgtctcttaaaaaaaaaaaaaaaattagccaggtgtggtggtatatgcctgtagtcccagctactcaggaggctgaggcaggtctcttgagccctggatgtagaggcttcagtgagccatgattgcaccactgcactcccgactgggtgacagagtgagattttgtttaaaaaaaaaaagaaagaaatttgataaagctatatatgtttgtttctgtagtttcccctctaaatagtctaggaaagaaatgaaagttatgcatcaaaatgtcagcaagggttaaaatgttcctttctaaccatttcgtactgtgtttagatagaatggatctagtgtttaaagaaggatttcacaatgatggtatatatttctaaataatttatatttggaatgttctaagacctctgtattatttttgtggttttggagacatcttttatttttattctttttttttttttttttcttgagacggagtcttgctctgtcgcccaggctgcagtgcagtggcatgatcttggctcactgcaacctccatctcccaggttcaagtgattctcctgcctcagcctcctgagtagctaggatcacaggcgtgcaccaccacacctgactaatgtttgtatttttagtagagacggggtttcaccatgttggtcaggctggtcttgaactcctgaccttgtgatttgcctgcctcggcctccgaaagtgtgatttttttattcttaaatcagtaccaattaacaggataaaaataattatagaagaacccatatttatcaggactgctattttgagtacataaaatatctaagactatcatacatgaattaatgcagtattattatggaaaaagattccagagacagtgtctttcctggatatttttattgggacaccggggcattcagatggcctattgaaatgagacaaggagagacagtgagaaatgtttctttcatagtattcagttgatttttaaagtttgggaacaaaaactataaaatgagaactctgagttatttcaaactatggcatttgtgtgctttagcttccttaaaatatacatttttctgattataaaaatagtttatgttcaggtgggaaaatgtagacatacagaaaaatgtttttaaatgtatggtcaccagagttaacaaatgtgcttctttaatgatacaagaaatctatatctatagcaatcaagagggaggtagaaagagagagagacagagaaatagagagatgacagagagagagacaggtttggctgtttggtttaaacatttggtaattattacctttaaacataaacacaattgtacatgttctgttgtatgatggtaggggtagctaaaaaagaggaaaacagtttcaaccataggatcattgactataaaccagagagatctcatggaaagtaaagtcacagaactaatccaggtcttccgaagctgccatattgttactgagtaatgcctgaaataaatacttccttcttttctccggacctcctctcatcacttagacttaaccctgaaggatggagtgaggaatggcagaagtgtgagggtaaataacagaaatgggattagaatgtcatatatacaatatttgttaatgaaaaaaatctggacaagtcatggcttatttttaggatcattaaatagttggaaaggtctaagaatttctggcatcaaaagggcatctttcaaaatgtcgtgtacttctgagtctgtcttttgcccttcactttaccattttccttatgagccttaagagccacagtcggctgagtttgagtcaggtgaagcctacagccttttgatgccctctacaatcttccaacatagcctcctttgttatgtcagtgaccatatgatgcatccaacctgaaagccagtgtcctccacttattgctattttttagtatctgtatccaaatcaattgctagtgcatgcctcatctttccgtaaatctcctattagattgcaggctagtggctttcatacttgctttatggagctcgaggggttccaaaggagatgcctgtgggactgtcatggatggtgagggtgagacccatgcctggacgtctctgggatctttacccctattttaccccaatttcaaccagagtaattatacttttctttaggtgtaacatattgtcttttacataatatttaatttggtaaaacgatgcctctgcttaaataaaaacacattggggaacccctaacataagttgcaggatttgctcagacaaagacagcccagagctggaagtgatggataggtgtcctgtgtgaggagttactggccaagccaatagtcgttagaggtacaggtttgaaactgaactgtgaggcatgggaagttgacttgtattttccactggctgtagactggaaaccagataatcatgctcgtatgtagaggctggtaatgcttagatcgaaggtttgagtgacaggctgttctagtagaggggatggattttaagtcataagctttatgacattgatttttgtcagtggtatggttaagcatgtttgctagaaagcaaagttttaggtagatgaactgttactgtattcatattaacattgtatgtacttggattagagagttaacatcagctcatttactctgtgagatatactgcccacaaactcaaggatttgtaggagtttagggactctattgagtgtacacagttatttccttctaaattgacattaaaaatttaaaattcgccactcaaatctcagcaaccaagttttcgtttcaatcacacaacagagcaaaattttgcttttctttgaacacattctacgttacacagtctaagaactaaaatcaatttaacctagtttctatctcttttatgagccaaaattaggagtatcaaaaatatgatttgaagcctagggctcttgctgactagtcatattttaaaattctgaatctagagatcttagacttcagttcctagagtacatggcaaacttcattttccagtgtaaccctagatgatacatgtatgccatccttagaaggagtcagatatcatcattaaataatccataaactaaaacttgttttcatgatcccctactagaagtcaagtccatttaaagatctaataaagagaagagaaaccttagcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgcgtaataaattgttataatcccagcactttcggaggccgaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggcattcattagcccacccttagacctcattttctctccatataagataaaaaatgccaccacaaacattagcttttccttgtgatgggctctgtagggtaggttgccaccttaggagggtctagttgtgactgttttgcaggggaaaaaaatcctgtttctcttcattagtctcaaaattttagggaatcacaaatcatcatcacctttatcatcatgtctttgtaatcatttattgaatattccactatttgccacatactgttaatacagcctccataaaatttacgaaaattttttttcgtatgtatgtatacattgatacatcctcagggaaatgcttagaaataagtaccaccagcttcattttacagatgaccaatctgaggcacagaggctaaataacttaacttgtaagtggcagatctagaattcaaacccaggatggcttgaatccctggactctgaccatgaagcttcctggtctatctcagagcagaccttaatctgatctgagataggcatagcactgcacaggcacttagaagcagagaggacgcctttaaaacatcaccatgatgaaggtgctaatataaattccaagactaaatgtgcagagcccaagtcacttgcattcctgccaaaagattcaattttaaaaatgtttatctttttgttctgtgtgtaccgtaccgtcattctgagatagccactgttaatattttctagataagattgaattttatatccttttctgcggaattcaaatgccctctacgaggtttcctctgtgaattcccagggcagttattttttttttttttgagatggagtctcgctctgtcactcaggttggagtgcagtggcacgatcttggctcactgcaacctccccatcccaggttcaggcaattcttctgcctcagcctcccgagtagctgggactataggtgcatgccaccacgcccagctgatgtttgtatttataatagagacgaggtttcaccatgttgcccaggctggtctcaaacacctgaactcgtgatccacccacctcggtctcccaaagtgctgggattacaggcgtgagccactgcgccggtccctacttacattcttgtagttacctctgacactgagctgcggcttcaattgactttactttaattcactcactcttatgcctctctgttcaaattttgtcaacccagatgtgcagctcagccttctacctcaactaaaactaagaacgggagcaatttctccacccccagacagacacacaggtacagatggacatacagccacaatcataaatacagagacacggggactgacatacatttgtgagtattgtgagtacaacacactgaactgacgactggagacaaagaagcagtttctacagaggcaatgcaaagaacttcacaagtatcagtctcccctatctgttcaagtccttcagctgcatactgtattgcttggccattctttttttttctctttccttttgtgccatccattggaatttcaatttggattatattaaatttatgaattaatttaggaagaattatcatctttccaatgttctacctttctgctaaagagaaaaaaaatctctccatgtttttaaatctttgtttatttatttatttttgaaatggagtctcgctctgtcaccaggctggagtgcagtggcgcagtctcggctcactgcaacctctgcctcccgggttcaagcgattctcctgcctcagcctcccgagtagctgggactataggcgcctgctgccacgcctggctaatttttttgtattttcagtagagacggggtttcaccatgttccccaagatggtgtcgatctcttaacctcagttgatccacccgcctcggcctcccaaagtgctgggattacaggtgtgagccactgtgcctggcctaaatctatcttttgataaaacttcatggatattttcatatgtaccctatgcatttcacattgtgctattacaattgtgatttactaatcagataccctagtatctatggaagataaatcatttaataagtcgctgaaataatttgctaatattttatttgggatttttgatttttcacatgtaaggagtagttttcttttttcagctattttaggttagctaacagaattctactagcttaaaagaatagatacctaatttaaaacaaagttcttatattacataaactcattagcaaaaccagctggccctatggatttttggtgagataagttaggctttttactttttgagttcaactttaggaatttatatttcctaataaaaatcattttatatatatttttaaacttacctgaaacttgtacatagttcccgtatgattaaagcatcttcttaacaagatttacttcgttttactctcaattttagttacaaagagatcccagaggctcactattgtgaattctacccacacctaagaacatcttttagacttctcatttttctctttagttaggtttattttttctctctgcctttcctggttgtattagttcttttgtgtccggaatttattcattccggtgggttcttggtctcactgtggacccttgcggtgagtgttacagttcttaaagatggtgtgtccagagtttgttccttcagatgtgtctggagtttcttccttccagtgggtttgtggtctcgctgacttcaggagtgaagccgcaaaccttcccagtgagtgttacagctcttaaaggtggcgcatccagagttgtttgttccttccggtgggttcgtggtctcactgacctcaggagtgaagccgcagaccctctcagtgagtgtttcagctcataaaggtagtgcagacccaaagagtgagcagcagcaagatttattgtgaagagcaaaagaacaaagattccacagtgtggaaggggatctgagcgggttgccgctgctggctcaggtggccagcttttattcccttatttggccctgcccacatcctgctgattggtccattttgcagagagctgattggtccattttacagagtgctgattggtcctttttacagagagctgattggtccattttacagagtgctgattggtccattttacagagtgctgattggtgcatttacaatcctttagctagacacagagcactgattggtatgtttttacagagtgctgattggtgcatttacagtcctctagctagacagaaaagttctccaagtccccacttgacccaggaagtccagctggcttcacctctcacttttaaaactgttgagcagagttcttgatttatttatattcaatagtaagcaaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggaacagctatgtaatgttttagattcactgtagcagttttgaaagtaggattcttagatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccactgcactccagcctgggcgacagagcgagactctgtctcaaaaaaaaaaaaacagtaggattcttattttttattgtctaaaaatcctgtctttttacttttgatttttttctgagaattaataattatttggaagacagctttaacaatttttttttttttttttttttttgagactgagtctcactctgtcgcccaggctggagtgcagtggtgcaatctcggctcaatgcatgctccgcctcctgggttcaagcgatcctgcctcagcctcccgagtagctgggattacaggtgtgcatcaccatgcccagctaatttttgtatttttagttgagacggggtttcaccatgttgccaggctagtcttgaactcctgaccttaggtgatccgcccacctcggcctcccaaagtgctgggattacaggcgtgagacaccatgcctggctgacagctttatgatttttaagaagttggttttctttttttttgttcaacaatatattgttaaacttgatttactgtgttgtggtgtgggattgttttgttgtggtttgagagtattgtatggaaaatttcttttgttgggcttcagtgagttgagagggagaggaagagagagtgtgtgtatgtatagtacagcaggagtaacaacagggttgatattccacagttgtatactagtttgtctgtattagttgttaaaagagtgaaataattgtgtatgatttggtaaataactgctgcatgggccgcctatgttccccctgtcctgccaccttggcttccccagtcccgctaccttagactctctagacttcccagtaatttagcaatgaaagggttaatgctagcccattagggtttttcagatccatttcctggtgctcagatcagtgtccattttaatcggttggtccaggttgaatttcacctttgagcaacaccaaacttatttaagttaggcaaattcaactatataattcttgatcgaaaacatgtagaaaataagtataatataaacaatgcaggtgatttcacttgccctttcacttcatatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaaaaaaaaaaaaaaaaagaaacattaatctcttccaatgctggaggaaaacctacctgtttcattggtgaataaatgatatatgtccacatttccctttatgggttattttaaggattgccaagagtccttttgtctatatacgattgcactgatctttgtaacctcgactcctatagaatgtgttgctccactggctatatatgtaattataaagacatatatcttatatatgtcttacataaagatatacatatctttataattatttaaatgttatatttgatttttagtctactttatctgtcaaaatgggagtggtgtggtgctatcttctaaaactattatgttttccttacatttttttgcttttaacagtttatcctttatatatttgatcctatatgatttggagaacaaagatacatagctgttatgcctctactgtggattttactttctagcaacataatatgagagactatgttctactttatgccttcaatcttgagttttaccttgtctgaaactagtattatttttgctttcttttctttcttcattcttttattggtccttttttcttttaatttattcgttaagttctctgcctatctctgtttttaagattttatgatttttgttctaagtgaatgttccacaagcatcatcttggaagatttaattttcttctgctgtctgaaagtatttgtctttctataggtcacttaaaacatttacctttaaatcataaatgctagtcaatcttaacttctaacatattgttttatactttattttttacactttcctgtttttcctttttggtttttgttttctttcttttgcttatttggcttatattttgtttatatttatcttccctggttattttgatgtatacatcctgttttttattttattaatggccaccttcaagtttttcaaaagtgttatttaacctgtacttctctatttctagtattaaatagtgaaagtatattttgaacactcatgtgtcaatgaggaactctgcatactgtaactttctctcatccttccttttcccttccaagtctttgctaatttaccatgaaatctgagatatatgttactttttgcagtagttattttcaagaggaactttgacttaaaatatactttcatgatgaaaatacatttttcagtctaattccattggcctttatggttactagatgtgacaataagtctattgactacttggttagcactgtagttacaatttttaaaaaatattttctcatctttagtgggaagttggaagagactgacaaggatgctagtcaaatgacattttaaatctgaggtccggacttcagaattaagtggatatacttccattacatgatgctgttaattaaatgtgacctaacattggtgtgttttaaaatcctttgttttctttaattaaaaaagaaacaggtataatgggtttggatttttagttataacagtctgcacatttaaactttatttttttgaattgtgcaaagtaacagaacataaatctctattaccattgagatttcagctgcatcttggaagagattggacttcagcagataaacatatgtagagaagggcatccttggcaggagaaataatgtcacaatgtccaggaaaggaaagcttgcagggagtttggggctaaaaagaccaaaggtaaaaatttgcagtagttgaagtgagagaatgaggatatgaaaaggaatgtgagggacaatacagagctagaatggacagacaatggactggatattagcagtgaaagagttgttgacaataacttggagtttttaagcatctgtacttgtgaaggtgaatctttacgatacaatgagagaaagagtgaaggttgagaggagagaagatactaagttcttactggacatgttgcatttgagatgcctatgtaggtgtccagcaggcactttcataacatgcatttattattgggaagacagaattagagacctagatttggaacaggtgctaagcaaagtcctgaaagttggtgagatcactgtgaaaacggaaatggggacttccgtagcactggtcaggccataatttctgggctaaggccatagccacttgctgagttttggcaaggagggtgaatgggaaatgagatccaagagaaatctgctattttagattcatagtcttacatgtggtccagagagtactcgtgtttctactgggatgatcaaagtactaaggcaaaggggttcccagtcaaacaatggatatggagaagctactgtgcccaactttgttaggaaaaaggaagagttatgaattctatcactgttccggatgttttacatttgagatctcctttagtcatcgctgttgcttattttgtctaagccagtttcctcatccgtggtatggaggtataatgtctaattcatatggtggttgtgagaactcattaaaaacaatgcatgttaaagtaactagactgtggaagttacttaataagttaaagctattgttaatgatttttgtaactattcgtgtgtcattgaaacactgctattgtgaaacacaactagcaaacacttgatagtagtgatttgcacactgctctttaaagagccgctctagggaggtacccaaagggagtgcttcaagattgagggagcatgtacaaagctgggcttctgtttctttatcaacccacaggaagcatggtgttatctgtgtgcgttgcttgaaatgagcgtaggtagacctaaaagcaccaggggagggagcggtgattgaaactagagagagcattggcaagagagggttgtccccaagaactgtggcttctgtagatggctcaacagagacggagctgggaaaataaatagcctgaccacactgtccttccacccttgtatgtcctgctggcactttctgctacctgaacccagtgggacataggtagccatcatggatccagggttgagtggagaagggaggagagcagccagggagggggcacaccttgtcagaatgaagagaagaaccgagaaacagcctggttttagcaagtgagactcatacactgtgatgttgaaatttgtgtactaaatgtgacttaagaatagagccagcccatgaccagaatatctgatttgaacatttaatgaaattgcctctctggctttcatgttttagatggcttttcctcaagtgactgcagagataggctgtgtctccttacttccagaacaacatatatatatatgtacacacgcacattgtctacataggaagataaaggagaagttgttttcctaagccattagtgtcatgaaatgcatggcagctgctgtatataggatcatggcctgtcatactgccatacctactggctaccaggtttatatagtcagtaagacataaccccttccatgtggcatctggcaggtttcccagggtagaggaaagcatgagccaagtcttgaaggctgagcaggagttagccagttgaatgtggagagaagagaagtgttggaggaaggcaatgcagacagggagtatagctcatgaaaaactggaaaagaggttgggcgcggtggcttacgcctgtaatcccagcactttgggaggctgaggtgggcagaacacgaggtcaagagatcgataccatcctggccaacatggtgaaaccctgtctctactaaaaatacaaaaattagctgggcgtggtggtgcatgcctgtagtcccagctacttgggaggctgaggcatgagaatcgcttgaacccaggaggcagagcttgcagtgagccgagatcacgccactgcattccagcctggagacagagcaagactccgtctcaaaaaaaaaaggaaaaggagaatatgtaaagagcgtagctcatgcgaagatgctatggatgattcataaagaagagctcccagtgtgtttggaatgatgttactgccatcggaatgaatatggggactggtaggggcccatggggattacacttaatacatttatacctaaagtttctcaagaactctctcttaacgaatgcgcataggcctccgactcttgagatatttaggcctgcagtttgatagaggaaaaacagacataaaatccagttggaatttcacctggcaaatgtttatctgtcgtttggaagcacacaggattttttttttaattgaggcgagggaatgtgatcagacaagctacttcccaaataggtggcacacaatcacagaaataattcacatatggcctggaagacaatagattccaaaattgtagtaaagcaattcctaaactaaatggtacaaggctggagggcctctgagccctcttccagtactgagctaagaatatgtcccctctagtgagctggagaactgtgcttcagaacctagagctcctgtcctgttcgagagggaagaaaagcaacatatagggagggaaaagagaattcttggagcaaaatattgggagagtatatttcattgtcaggttgaacaaacagaattccacaagacagtgttgccaggaatagaatatcgactgtgcacacacttctaaagatgaagaaaatgtaagtgggggttcttgggcttagagacacatatgtgggctctttgggttaggttaggtgagtggtctccctgaggttcagctggcaaagacccaagaagcaacttcttaagctcatctccaaatagccccctgatctccccaaggctgccaccacattgccaggctggttgtgaaactgcttttccagaattgcttgcacgtgcagagaactggtctcctgttaaggtcagccctgtaaaaaagggggcaagaatcaaaggactcttgaaggaaacacaggaactcttccttagctcttgatcggcctgtttcctgcccatgtgggtttgaagtgtgagggagggtaagcacacagcaggacacaaagccatgagccgtccttccttctaagggtgtcttagctccaagatgactttaaaaacagtcttcctctggggatgacacaggccataatttcacacagatttacttgatcaaactggctttgtgccatgataataccaatagtcctttacacagaaatcaatgatttagaagctatcaccctgttttacacatgaggaaactaagacagaacttcaagaccaaagttcttaatgactccactgtcctgttaatcatgtcaggcaattagtaattcacaaaatagtcacctgggtttaagatgtattactttcagttactgctagaattgttccagttcaactcatacatatttaaaatgagtagtctgtcaaacacagtgcttggtgctggggcgttgaagacagaaagctcattgtctaaggaagaagacagacatgtcaatatttaattagaacaatgtcattagattgattagttgtgtgtgccttcctataaataaaaatctttattttaaaattatagaggaaatgaaatacaaaactaagcatgcaaagcaataagtgaatatcttctatggtgctgcttctctcagcccccatgtgcctgccagttttatcagcaacaggtaacactgttatcaggttggtgtatgacttctaagcttagatgtcatcgtactgttctacatcttgttttcttcactttatatttcaaggctcatgcaaacttataataccctattacatgtatgtaccgttatttatttagagatgcttctgttgatgaactttatattgtttacagtttgtggctatatgctgcaatgaatatccttgccatatctttgcatatttttactggtaaatatgaaagatacatttttattataattgttaaagttaatatacagtataattggcttttgtgtgtatacaactctatgagttttaacacatacactcatgtatctgccactaagaacagcgatcaggatacagaatagtaccatcaccccaaaaatcttttttgtgctgcccctttgtagtcagatttctcccagccctaatccttggcagccactcatctggtctcatccctacaggcctgcctttcttagaatgtcatataaatgcagtcggacagtaggtagaagatgattttagcttcttcactcagcataatgccatgttgctgcaagtagcaataggttttttcttttcattgttgagtagcatggatatactatagcttgtttatgtatttatccactgaaggatatttgggtgcttccagtttggggtgattatgaataaatagagctgctataaacattctattttttttttttttttttttggcgggggggacggagtcttgctctgtctcccaggctggagtgcagtggcgtgacctcggctcactgcaagctccgcctcccgggttcacgccattctcctgcctcagcctctcgagtagctgggactacaggtgcccaccaccacgcccggctaattttttgtatttttagtagagacggggtttcaccgtgttagccaggatggtcttgatctcctgaccttgtgatctgcccgcctcggcctcccaaagtgctgggattacaggcgtgagacactgcgcccggccaacattcattgtatgaatgtacattttcatttctgaagggtaaatgcctacaagtgggattgttgggtgatacgtaagtgtatgtttaactttataagaaattgttaaaccaatttccacagtggctataccacccattttaaattacttccatcaatggatgagaattgcagttcctacacattctctttagcactgggtattatcaggttttcttttttctttcttctttttttgttttttgatctgttctaataggtttgtagcagtatctcattgtggtttcacttagcatttccataatgtttaatgatattaaacatcttttgtgcttatttgccatctatacattttctctggtgaagtgtctcaaatcttttgctcatttaaaaaaattgagttgttttcttactgttgagttttgagagctttttatgcattctagatgcaagtcatttgccagatatgtgattagcaaatattttctcccagttcatggtttgtccttttattttcttaacaatgtcttccatagactaaagttttaaatcttaataaaatttagcgtaacaatttcttttttattcatggtgtctatgacagctaatttttggtgtcatagctaacaatcactttctaactccagtgtcatgaagattttcttctatatacctaaagttttgtattttaatgttttacacgatgtatttttagtgaatttttgtatacatgggtggttttaggttagggctctttttttgcatattgatgtccaagtgttccagtattatttgttgaaaacaacttcattgaattgttagacatttttgacgtgagatggtgtaatatagtttaattgttgaaagaatggagtgaaaccagtccacctaaatttcagtctcagctctgctacaaattagctgtgtaacaatcaccaagtatttaatctttctttgtcatagtctccttttctgttaaatggaaacagtcatagtacctactgcctagattgctatgaggattgagttattatgtgttgacacacttagagtagtacctgacataataagtgatgaattagggttagcttttatataacttttcagttattgtagatattgcgagcacgtcctgtaaacatgttttactaattacactgcccatcaacaatatagatgtttctattcaacagccagcaccagatattatgaccctctccattctttgacaatttgataggcaaataatgagatgtctttttagtttgtattttgagatctgtggtcaggttaaacatcttttcaacttttcacatgttgtgagtatatcagcttttgatgagtaacaaggcatccaaaacataatggtaaaacagcaaacatttattatgacttatgcttctgtatgtcatctgggaaactctttggcttaagctggattggtctctcatcctctagcgggttagtcttggcgtctcctcatgatggcctcagggttccatagagcagcagcaagagtgcaagcccagtgggagagcccagtgggcaagcacttttcaagcctctgcttatgccacattggctaatcctccattgatcaaaagaagtcccatggccaagcctagattcaagagatggagaaagaaactccacttcttgatggaatgaaatgcaaaatattgtgaccactttttcatgaatctactgcgactggctgtttgtgtttccttctctgtgaattgctattggttcaacgacttatgaaatttctttatatgttatacatattaactccttaagttttacatgtaacatacgttttacatgtaacagtatttttctacttggtcatttaacttcatttatataatcttttgctgtatagaaggttttggctttttctgtgataaaatctatcagtgttttttcttcatgacattggatggccagaatgtaagctttttgaaggcagaaaccatattttattttttattattttcttgacccacagaaagcagcacagagcccagcccatagtaataaaggtttattgaatgaatgcattcactgaaggccaatctcactcactcatttatttatttattcattcatcaatgtttatggaatacctattataaaccaggcattgtgctcattgttagagatacagcgatgggcaaaattgacttttagatggtgtttagactaaagcatggtaggtagtaatggaacttattatcaatgagacataggttcaaattgtatctttctacttatgtgaccttgggcatatccctaaacattcctgaatttcagggttttttaacctataaaattgagtgtaaatgctttccttcaatagtgtgagaattcaagtggacaatgtttgtaaagcacttagcattgtgtttattatgtattatataataaaaattgtcagcttccttttctacatggtataatctcaggcctactaggaaggctaggtgacttcttttgtcaatctcctcttagcaaatataatcctgaatttcttccattatagactcgtttctttgatttgctcctccaatcgttctccgtgaattgtcactttgagcaattcttgcttattctcctctttgtgcaggcaagtcagtcaaattgccttctctgttgggagcagaagaacagggcactgaggagacactgaattttgttcagtgctgtcttggaagatagatatgcttggttgtgggtgtgggtatgtacgtctttgagcagcataagggtagttgggaacttggcaggtaattgaatcaggagaagagcccagaaaaaggtggtctggttccaaagatgcatttttcccataccgggtatcctggtgctgataaacacagtgcatttagagagcatcccactcctgagacaaagtgagtagggaagatgatgaggcagcactgccaggcttaagggaatctgtaaggtggccaaaactcctctctagatattctcaatttctctgtcctgtaccctttctagctttttagccacctctcctcaaaatcttttttctcttcccccaatttctaccaaactccaggattctccaggcgccctcctgccagatgtatatacattccatattccctcacactaaggacttggctgttaacactgctactctggggtgacagaaagggccctggagagaaatcagcacttgagggctggctctaccactaccctttgtgcaatcaccaactggtctcttttctatatgcctcagattgcctgttataaagtgtaaggcttggccaggcatgttggcttatgcctgtaatcccagcattttgggaggccaaggcaggagcttcacttgagcccagaggttcgagaccagcctaggcaacacagtgatacccccatctctacaaaaaatttaaagattagctggggggaggggtgttgcatgcctgtagttctggctattcaggaggctgaggtgggaggataacttgagcccttgagttcgaggctgcagtgagcagtgactgtgccactgcactgcagcctgggtgacaagagtgagacactgtctcaaaaaaataaggtgtgaggcttgcaccaagcagtctgtaaaacctcttccggtgtaaacaatccttgatttgatggaaccatgcttcctgcacccccactgcctcacagaatggagtttgcatataaatgaatgttcagtaaagtctcgttgtgtggatgctctgtctgttccctggaaataaaaagtttcctgccagctgactgatcctcattctaactaacacatgtgttatttggcctagatggaaaatttccggcgtttgaaggtggcgagaggatgtcattccctccagcagacagacaagggtgccatttggctggaaagcagggatgggaaacgggcatggcctttggggaaactggcttggtacaactcctgggtgagcacaggagtttgttgttagagagtcacagcccagtcacatccaggatgcccctggataactctgaactcccagctatacaataaaaatgttagcaacttcctttagttatttccagtcttgtatattttggtatcttcttgttagctgcccaatatcttcttggaaggaatcttgaggaagaagttattgctcagagacttactacatacacaaaaggaagacagagaataaaaaaggattaaagtgttggaaacatgcctgggaactggatttcttcatgggagacaagaaggcagaaaagatactgaaaatactttaacataagggttgacacagaggaatagtgctggtagttcttagggcccaacagaaagaaattaatagcaactttaagatagagaaagaacattctagaattgagtcctactaaaaactcatttttgaaaaatgagtaactactgctcagtagttaccattttggggaagatttttctgattatcttctcatctctctcttgctttgcctggctaaccccaactttcctttagactaaaagtccacaaaccctccttcaaaacagtcaagtctgataaagtttaccattatggtgtctcataagcatcttgtaattctctctcttagtacctgtctgtatttatgtgtttatgtgattagttttccatgtctgtctcctacatttgcctataagctacgagacggttgtatattcactgctgtgtctccagggccaagtgcagtactgggcacaggggaagcatgcaataagtctgcgtggtaagtgaatgaatggacacataaacaacttaatgagtgctttttgaactgaagataatttttctttttcaggacagcaaaaacaaaaaacctaaactaaaatccaaacaatttcgcaaaatatcctggatagtttgggagttgtctttgcttctttggctcattgccacggccttaattccagaaatgcttttgactcagaccttttcagttcattgccagttccctgatttctgaaatgcctttggccaaggaagtgctaattggtatttcaaatatttagaactttaagatacctacttctgttacaaagatgaaattaccatgaacaccttttgaaaaatttaaccatagctaataccaaatttccaaaaaaccatacagtgaccatacagttagttgttctgaagacatgacgcattattccaaacacaccttagcagaattccacccaatactacaattctgaggtagtaagaagcacaagggaataagcctgcgatgcaataatttaacctgcctaaaattgtctcctagcttgccaacactttgaagatcagggaactgggtaaatcaggacttgatttcatctgcagctgtatgtgaactggaatgtggaaaaaaaaagaagctaattggagcaagcatgttgtgctgcagtggagtgtattttcattgatatgtttaacctttcatccccttcatctgtgaaaaaatgaaaattgctgacctttgaggttttatgtttttaattaagcaaaatttttttctttcaaataaaatcttatatgaagcccccccccccgcaaaaaaataaaataaaataaagttgagcagctcactgggagtgggtgagggtgtgggtctagagtccattctgttgatttcacctcttccactctcagaaacttctggagcacctttttagaaaatgagaaattacagtttctttaaacacagtttaacatggctctgtctctaatttctaatgtaattaaattctataatatgggtgttgattcaggcccacaataatttccataactatttttaaataaaaatattcccatgtcttagttaatggctcattattcatagcaatattgaatacaagaaaatgtaaatataaaaactagagttaaacaacattttgagttcaccataataagatttagtgagaagacgctactaagaaagattagatactgttcaatatagaacacagaaaatacagtgagcaaaacattttagaggattgttatgcttcacttgtgatgcttggttgttaacttggtagacgtcatgccacaatgccaagtagttccttataaacaaggacacacttttatgcaaacattgaaaaagtgtttgaggctgggcgcatggctcacacatgtaatcccagcactttgggaggccgaggcgggtggatcacgacgtcaggagttcaagaccagcctggccaacatggtgaaaccccgcctctactaaaaatagaaaaaaaattagctgggcgtggtcgcgggcacttgtaatcccagctactcgagaggctgaggcaggagattcttttgaacccgggaggcggaagttgcagtgagcccagatcgcaccattgtactccagcctgggcgacagggcgagactccgtctcaaaaaaagaaaaagtatttgagagatctttgttaaggaaaaatagcattaatctctaaaacttataagatgtatgatattaaatatgcatcttgtttcagcaaattattagccttcatgatagaagtatgaattaaactattaatgaatttgatcagagccttttagatatggttgtgatgaaacaactcactatccgtccccaacatgatttggagaggatagcgctataatgtaagaaagggtattaagcagagagattgatattggtatgagcccagataggatctgtcttctggcaatgattctcaggaaatgtctctattagaaaatgtcttgagtggcaccagatatgcagtggcagccatgcctttcatggtgtcagcagcagaactctttcaagaagccacggaccacagttgtactcgttgtcgtggagcctctgctctattctttctgaaaggctgtttggctactttttttttcagcattaagttttaactcctttatttttcagcattgtgagataacatcacatttcctattattagttcaaagaagagagaaagagaaaaatgcattatttggatgtaatttgaaatttggagtagatatagggctgaaggatgagacataaagggacatgtatgtccatggctcttgattcttttccagctgccatttttttctctctctctttctgtctctcttttatttatttatttatttttattacactttaagttcttggatacatgtgcagaacgtgcaggtctgttacataggtatacacatgccatggtggcttgctgcacccatcaacctgtcatctacattaggtatttctcctaaggctatccctccctgacctcaggtgatccgcctgcctcaatctcccaaagtgctggaattacaggcatgagccaccgcgcccagcctccagctgcccctttttaagaaatgggccataacacttttttttacgtttaatttttatgtgtgaataatagtcaaattgttcaaaagccagtacacacaagcatatagggaaaagtcttccttttaccattgtgccccaactacccagttcccccgaataggtcatcgttgttcttctttttatgtgtcaccttctagaaattctttaggcagatactagcaaatacaactatagattctcattttaagaaaactaagcaggtgattttcaagactcatcctaggaagctggtaggtatgtcttcttatacccaaagctcacatagaagatccttctggtactgtaaatggggttacaaaggacagagtactggctggtggaagaggtcttccttaaccggcatgctgaacaagggtagcgaagtatagtcaagtccagactcccagaggccacaatttccttttccgtcactgaaagtaaagggagatctctgaaaggagcaagaggaaaaagaaactagatacatacctagaaataatttatacatagcttggttgtcttttcaaatcaactgcattttgtattatttcctaaagctattaaataaaccacggccactgccaccgctgggagctcagagcagatcctgtggttttggcaagactcttgactggccctagaaatggggctggattgaactggagttgaaagaattacagtgtttccttcctcttgatgactctttctggaacatgcctggaatgtgtgagtgtgagagatgaagtggtgttcactcagagtcaggcctgggtatgtacgtggaaggggaggtgtgtgctggtgttatttttggaggctgtaattccactgttaggctttgtagctcgtcgtctctttcaatgtttttactatcctaacttgtattctctgtcctgagatcttaaaagttaccaatgaggctagaagtaaaatggatgcttcaaggccaggcttgggaactcattctagtggagattttctccctcaatctcatgtaatgagttaatattacaataaaatgcaggtgtaactcctgcttacacgaagacttgactttgaaatttttctttctaatcattcagataaaggtttaatttgtaccaagattatcctcaaaacatcactgaatacagtaaacactggcaattgccattaaaaacaaattatatgaggactttatatcaggtacaatgcttgacataagtaggtgctcaaaaattctggtaaatgaatattagccttaaacgctcagcagtcattggtcacttttctttggcattttgtaaaaattgtaatgtttttttccccaaaacattgggaataatgtttttttgccccaaaacagttaaatatgggcaaggaggtcagttcagactcgggggagcacttttgtttttttttttttttgagacagaattttgctctttgtcgcccagtctggtgcgcagcactggaacctctgcctcccgggctcaaatgattctcctgtctcagcctcccgagtagctgggattacaggcacccaccaccacacccagctaatttttgtatttttaatagagacaacgtttcaccatgttgaccaggctggtctcaaactcctgacctcaggtgatccccctgcctcggcctcccaaagtgctgggattgcaggcatgagccactgtgcctggcccgcactttcatttttaaccttattattctagaattggaagccgagcaaatggatggacttcagtcaggcagatctgaaataaaatttgcccatccatccatcccattcatccatacactcatccaacaaatacttaagtcctctatatgttgagattacggagaatattccattgtaaaccaattcctaaattcctcttcctatacagaacatttggagtttatcatttagagggagagtaaataaaataatcacaaattatggtaatctgtatgaataaaacaggaggccaaattagaggtcaatgggatgagagtgtataggtattatagataaggcaggtagagaagccttctatgagaaagtggcacttaagctgagacccaaaggacaagcagaaggtggccatgccaagagtggagaaaaacattccaggcagaaggaacagcaaaggctttgaggtaggaaagagtatcttgtatccaaggaatcaaagaccagtgagcatttgaatcccagctctgccttcaatagctgtggaaaatgaaactagctgctcaatcttttgagccttcatttcttcatatttaaaattgagataatggtgcatacctcacagagttgctgaatttaatgggtattcaataagataacatgtagcttatttgaatcacttctacacaaaggtctctgagactctagttgggccctcatcactcaattgatttttctagtctcctgattgttttatgcacatttgagagccaaccatcactggagctagagaacattttccatccctgatatttccacatttaaagaggagagaatagacacagactctatctgctcatgttagaacctttagaaatcaaaaaagggaggggtggggaggggagagagagaaagaaagagaaatagtgagaaaataacatgagaggattttctttttaaaagtgtacttcctcatttacagaacaaattcataaaatttaaagtttgggtaaggttttgtttttgtttttacatttggggagagggtaaggtttggggctaagtgttcaggaaacagaataaagagaaatgaaataataatcactgagtatgcaatatataacagacagagtggttggcaagttatgtattttatcttatttaatctttacaagaatcctgatggagtaaatgaggccctgagggaaatgaagacttcacttagtcactgtctgtcacttatcttgaggtatttaatgtggaattgtgcaattctttaaaaatgagaatctataaggcataagtttatgtagttgatatatttctttagaatactttattattgtgacagtatcacattagcatcaattgataactaatagttaaatgaataatgataatgtcattattattaattcatcttaatactacatacatttcctgaatacccagctatgtctagtgcatggcttgttgggggaataatgggtagtccattgcaactagggtatgcagtggggcaggagaggttagcagggtctagctgatgaagggtcttgatgccttggtaaagagttttggattttgtccagtggaagataggcacatggtcagaatagcattttagaaagaatcctcacacaactttaagacaaggctttgtgagcaccagtttacccaatggggtcatgttaataaccttagtcatacattattgtctctctttccttttaggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaaggtaacatgcccctaagttttgggcaggtgaggcccactgaggaacacacacaccttttgtcttggcagctgctccctcaggggcagggcatgcactacctgaatgtagagcttgacgatcttgcctgtctctttccatgcatcaccgtgtctggtacatggaatgttagagataaaggagactacccagtccaaccccttaactagatactgtgcctactttgtgagatgaaatatttcatatgttctaagggcatcatggtacttatggatagttgactgttacatgtatgtaatatgaaaatcatagcaatgaaaacaagtgttcattgccaaactactattttgagctttcttatttgatttttcatgtgatacattgctttgcttgtccctaaatacccttaatggaagttaatattttcaggagaaaattaaatataaataagaattttagaaggggaatatccatcagtaacttaatttaattagttatttggtatatcaactttcttttcctttttttttttttttgggggggtggagtctcactctgtcaccggactagagtgcagtggcatgattttggctcactgcaacctccgcctcccgggttcaagcgattcttctgcctcagcctcccaagtagctgggattacaggcaagcaccaccacacccagctaattttttatatttttagtagagacagggtgtcaccatattggccaggacgatcttgatctgtagacctcgtgatctgcccgccatggcctcccaaagtgttgggattacaggcgtgagccaccatgcccggccagtgtatcaattttctattgccacaataatgctgtgtaacataaccacaaaccacagtggcatacaataatgagcatttatagcttgtgagtctaagtcagctgtgttgattagatggatgtattgaccttggttgggattccttacatatatggtgttgcctggctataggcttagtaggctggccttggctggggcaactttgctcagttccttatactatagcaggctaaggtagtataaggtcatagtgtacaattctcagcttaggttgccaggagcctcatgtgtttctatttttttgtaccactgccatctacatttcatgtacatgagatgtagacatgaggctctttgcaacctaggctcagaattgtacactatcacttctgcttcattttatcaacctaagccagttaagtagctgagcctagtatcagagtgagagggcactacaaactgaaatgacaaagagtcagggatacagggagggatgaagaattagggccctctttgcaggctaccatttttggaaaaggaccatgatttaattttagcagtcgagtacccaggtccagctcagaaaacaccagaattttgccggaggattttgaaagcctcctctaagggaggattattaagacttgctaccaccccacaaggtgatgatgtgatgaagtcttcctcccaaaataaaagtgggccttaagctaaatctttagaccagtccacctgtgtgatggcagttgaaggagatggtgttgcaaatattatttaataattgtattataaggttccagtcctggacaggcaggcagacttctggtgctcttgatgctgtctgctgggaggaaggtacagaattccagctaaggtgacctctctttgttctgcctggaatgatctggcctctcccctatcagccactttgtctgggctgctgattcctaaaatgaaggagtcttttccaaattagtatcatcacaaccacaggagctgtggactgaggacttgtcattacataaaataatgacattgtcagctgtttagggtttttttttttttttttttttttttttaaagacaagggtcttgctgttgcccaggctggagtgcagtggcacaattacagttcactgcagccttgacctcccgggctcatgctgttctcccacctcagcctcccaagtagctgggactacaggcatgcaccaccatgcctggctaattaaacgaatttttcatagatatgggggtcctgctttgctgcctaggctggtcttgaactactagcttcaagccatcctcccactatggcctctcaaagtgctgggattataggtgtgagcccaccaggcctgacttttagaaagctgatccagttaagtaacacacctctgcacattgctgattggctgtttcttttataatctaaccatctgtagtctgcattttttttagatcaatgctttttaaagttgaacatgcttacagatcacctgtagttcttgtaaacatgcagactctgatttaataggttgtttgggacagtcctgggattatgcagttctacccaggtcccaggtgatgagaatctgctcgaccatggaccacgctttgagtagcagtttagagttagcctctaacttgggtccagctgaaaatatttctttgaatttactaatggtagtaatgaaaagatttgaaggcagcaaactcattttaaggtcaaaagtaataaaattgctgttcattccaaatgaaggaaagggttttcttagcaaaactagaatgttcacctttaaatgacagcagggcaagtgggaaaagtgcacaacagaaattcccaggaatgcagctctccgttgagggaagagaggttgaacaaagggatgtgaggtgtgccaaagctatcatggctgaaagtcagctctattatttttcacatgtgtcattttggatttgacttgtataaagactaatattcttctgctgatgtttccacattctaaaggaagatgatctgagattatgccccagtcatttcgtgggaacaaaatgtgaagtgccactgtgtccttgctgtactgtcctgaggtcatccttgacaatgtataaataagaacatgtaaagcaaactggaccagaacattgggagttaaaaacccgctgtaatgatccccccaaactgagaggctaggtgatcacaggtaaaggatggcttaacttcagttaaataaggcaaaggcagacctggatagtgagaaacactaacgagaagatggcttttagaattatgctcacttgagttttaattcgttctccatcactcaccagctgtgtggcctttggcaagttatttaacttctattggtctcatttatcatcatctgtgaaatgggtataataatacctacaaaattgttttgttttaaataagttggtatatacaagaagcattgatttacacagtgaacgttgtccctaaaagcttaggtaaagcaatatattgcagaataaggtacatagtaataagaataatagcagcttgtaaatggtgggaatggcatttgatgccgagtgatctgacttcagagccagtatttattaccactacgctaccctttggatatcattctcacttaatgttagcaactctccctgattctgagctcttgttttataaagtacaatgatcctacctgaagtcctaaaaagcaacccagggcacagagtagaggtatgagagtggaagtcagacagatatgggttcgagtctacctctgcaactgagtggtgtggctcaggacaagttacttaattgaagtcatattttttcctcatgtgaaaagaaataaggatagagattttatcacacatatttggaaattaaatgaggcacttaactattaccaattacattatctgcttcacagtaaatgtttaacaactgattattgtaatttctttgagtaataggtgagataattttccgactcaattgtagaaatttttactatgcattcacatattatggagttttacacaaaatggaaaaataggtatgttctctcctgtattttaacaataacagcatctcaggctgatgaacaggttctgtttttcttgctgaccatccagtgggggaaatctggtttgaggaaagtgaaatcctttatgatgaatcaggaaaaacctccaaaactatgttttcatgtcactattaattcgttattaaaacatcatggaaactcagaaatgcctgcctagggacacagcaggataaaataaacatcaatatattcctgcttgctgctgactcgtacatctgtggaggaagtggaaaatccatttgagatgtgccaaaacacagcttaaattggctcacacactccaaacagacaaactggattttatcaatggcatcatccaaaatagtcaacagcagtttgactcaaacctccttggtgatttcatttgggggtaggaaattatatataaagtttgaaacgttttcagatccaaagacctgtttcaaactgatccattagaagaaacagagggttattttattcctactttcatttgagaaatagctttatattaagaatatcaaacttcccaaacataatttacgaagttgttagagaagagccatttgcacctaaataaccaaaggaatatgttaaaagcatcaagaaaatgggaaaatctgaaacagtttagttcatttatactttcattccacaatttttcttttcttttttttttttagacggagtcttgctctgtcacccaggctggagtgcagtggcgcgatctcggctcactgcaacctctgcctcctgggttcaagtgattctcctgcctcagcctcccgagcagctgggactacaggtgcgcaccaccatgcccagcttgttttcgtatttttagtagagacagggctttaccatgttggccggggtggtctccatctcccgaccttgtgatccacccacctcagcctcctaaagtgctgggattacaggcgtgagccagtgcgcccagccaccacaattattcttgagcctctatttttgccacatgttttcctgaatacttgtatgcctgacattcccctagcaacttcatatgtattactaacttagtctttatcaaatatatatcagatgaggacttttaagaccccactaataatagatgaggcttggctattgtaacttaacgtgcatttactagctagtgagtgttggatctgggaaggtgaagtcaggcccgattctagaagcctggctttaaccatcaccctgtgctacctttcaaaacagatgtgatcttgccctcctggaacacccaatctagtaggggatatataccatgagtggggctataatgaaaaaatgcagggtatttagggagtagctatgagggcgtctaacctgtgttccaggtgttgtgtgaggtctctgaaaattcctaaatggaaactgatgaatgagcaggagctggtgaggctgaggagaaaaggaggagaaaagaagaaagaaaactcatgacttggacatgagtgatgagatctggctgaggaactgaatacagttcaaagtggctggaattgagagctaaggatgtggacctggagaatgataagtctggagaactaggggtggaggtcttgagtttgtgtctcaacttccacatttattcactgttgataggccttgggtaagggacttagtcttccttaactccatctcccatatggataaactgtagctatactgtcttcacaggactgtggtgaaattgcacaaaataatcacagatatgaaactacattatttcctgtagtacttacacaacaattaaattgaaaggagatgactgaaattgagctcacttgtttttcatctgtgttttcacttgtgtataacttttactaccacctactttcttctccagaccttatggaataaggaattatatttttagttaagttctgcccatgaattagcccatccaaatgatcttaagcaagttatcttccaacctaggcctcagcagtatcaaatttaaaatgaggtggttggaccttaaagccttctgagtgctaacattacataatctatgaaagcatccagagcgagattccttggttcaaatcctggctctcccatgtatatgctgtgtgatcttggacaggttacctagcttctctgtaccttaatttcctcatctgtaaaattaggataattgtagtacctatctcatagggatattataaaaagtaatttttatttagttggagtctcgctctgttgcccaggctggagtgcagtagctcattacagtcttgattttttttttttttttgagatggagtctcactctgtcactgaggctggagtgcagtggcgcaatctcagctcactgcaagctccgcctcctgggttcacgccattctcctgcctaagcctcctgagtagctgggactacaggcgcccgctaccacgcccggctaattttttgtatttttagtagagatggagtttcaatgtgttagccaggatgatgtcgatctcctgaccttgtgatctgcccaccttggcctcacaaagtgctgggattacaggcgtgagcaactacgcctggcctacagtcttgatttcttaagctcaagtgatcctcctgaacagctgggactacaagcatgtgctaccatacctagctaatttttaaatattttttttgtatggagcgggggtctcactgtgttgcctaggctggtctcaaactcctggccttaagagatcctcccaccttggcctcccaaaattttgggattagaagcatgagccaccgcccccaggttgacaattaaatttgtgtaaagtgcttataacagcacttggtccatagtaggtgctattaaaaggtatttatcgtttttatggcctagtcaagtcacataacatcaatatatgtgtactgaatacaagccaggctcctgtgtcatcagaaagcccaaagtagaacatgaatgttggatttccttcgttagtactcagcagagagcaatcagcctagagacattcatgcagaggtaaactctggacagcagtgaaactctggtgtgataatgcccctaagaaaacgggagcttaaaaagcacagtcctaaataataaagagccacagagtggtggggggaaagctacttggaattgagcctactggggaaccttggttcctttcagaacacaatactgagtgagaagtcccacggtcagctaaacaattctcacacaaaggagcagaaaatataaacaaaccatatagacaggaacaacagcatgaaatggtcagaaaaaaattctcgtaggagtccaggagcatgccacagagagcaagagctgcatgcatttggaggtctaaatgaagcacttggcaacgtgagcagaagccccacaaagacagcccccctcaccatccagtcccctgtctgctcttcctttatggctggctcattttagtgctctggagaaaagtgtccctcatgctcatatcacaaatgtcagcacagcagtgttgctgtttatattagaaggataccgacctcttctaggcacctcagggcttagcctacatcacttaatattactaacaacctttgaaggtaggtatcattacttttcaattacacatgagaaaactgagatttgcagaggtgaagcagctttcaaaaagggtggcagagggtggatccaagcccaggaatgtgtctgattccagcgctcgcactgctggaatgatctaccccgtgctctctctgggtttgcccccaggtcatcatctgcaccaaaggcattcacatacctgaccaccaggggagtctgtgcaaggcacccatgctaggatccgcaggcacagcccacagccgatgaaagcaagcaggcaaacctaaagcccaggtccttctgagcatggttcggaggcatcttttgccctcacagggtagttgtctcagccagtggcgcgcacagcgcttgattagtctttctcaaaccaccatctgaaagccacggatgagatgagaatgagggcacagcgaccagctggttcatcacaaggtcctcagcaggatccctatgatcccaaggcttggtcctggtctgaatctttataggaattcttactttgggggacaggatgttttgctattaatttctaatttaggtgcattctggtcagagaattttgttattaacagagatgtgctttgtggataaacaggcaatgttctggtaaataatgtgtatttcaataactgagcaaggggttaatgaatattcaacagatctctaatagtgttattaaaatcttctaaatatttccttagtaattttcagtctttttgattaatttctgaaagtttccaccgtgttcacggatttgtcagtttctttaattctgacactttttgtttcatgagctttgaaattctgttgttagatgcatatataatttcaggattacaatatcttcctgaacatgacacgtgaataaaatctaacaaggttttatcagttagtagatggttctgttttatcattacataatgaccatctatatccctaatttttagctttataataattttttctgtataaatgttgcaatactagctttatttagtattagtttgctatatatttttatatccctttattcacaatcttatgtgccattatgtcgaatgtatacttcatgaaagagcacacagttttatgtgtgtgtgtgttttagaattgagattctagaatctaagattttctgatctgaatttgatgtgagctcctgtcttttaacatacatttggcataatgtctgccaccttatcctatcttttccacaccatgattttctctggtcctttttttctcattttatgtcttttgtttccttatcttctctcttgccctcttgttgaggaaagttagatagactgtttctcttcctttagtggtgatccttatattgttaacattggcttaacttaaagcctaaagctaatgcctccttatgtcacagagtttggctttctgcagattatgatataagttaagggaattcagaaactcttgttgctggaagaaagttagaagattttattcccatatcttgtccaataagccaagggaatcagtcaatgttgcatggcaagcttgacacagtaacagaaattttcaatcaattggcttattttattttattttttttttgagactgagtcttgctctgttgcccatgctggagtgcagtggcatgatcttggctcactgcaatctccgcctcccggattcaagcaattctcctacctcagcctcccgagtagctggaattaaaggcatgtcccaccgtgcccggctaatttttgtatttttagtagagatggggttttgccatgttggccaggctcgtctcgaactcctgacctcaagtgatctgtctacggtggcatcccaaagggctgggattacaggcatgagccactgtgcctggccttggcttatgattttgtaagtcaaatataaaataattttcccagttacatgtcagtactgtccagttccataactgtgtcagttcatacatatataattaaaaggtagaaggcaagatattagattccatccttgtctttattcttcaatcttccaatatttacaccataagtagtaagtccagcattttgctcattttatttgagcaacgcatggggcattctaaagcaattagaattatttggaacaacagcaacacaaaaggaccaggggaaaagccatttggtaaattttttttctctttcactttggggaaactcagatttcattcatgttttttttttcccactttaagaatacttgggattggagaaggatggcagattcatagttaatatagtttattgttagtatcaggacttagtttgataataggtacagtttgagtgttccaaatccaaaaatctgaaatctgagatgctccaagatccaaaaatatttgagagccaatttgatgctcaaaggaaatgttcattggagcattttggatttcagattttctgatttgggatccttagctggcataatgcaaatatttcaaaatggaaaaataaaatctgaaacacttctggtcctaagtatctgagataagggatattcattctgaactaatcaacacaaagtcctcatctccccaaccactgaatagaaaaattgtgtataggcatattgtttgtatatatttacactcttataaaggaagtgaccatccctttcatcagattcttaaaaaggtacataatgttaagaaaggttaaaacgcattagccaccactgtttttcaccttccaaaaaccatctgacacctagcaagtgccagccctcattttctgagtctcaaagctcaattgctcctggagaaaatgtgtgatcccatttttggtatttgttttctctcttttaaaagcttccttcctaccagctactttaactatgactgtggacaagggagataacgtgaacatatctttcaaaaaggtattgattaaagaagaagatgcagtgatttacaaaaatggtgagtatgtgtttcattgctttccccagtatgatgtgagatatcagataacatacaacatattgaatcattttcctattgtggtcttgtgggcagatgtttgaattaaagctgctatgatgcaagctttcaaattctgtgtatgatagaagccctcttaggtgacatatttggttacttaaggatattaaagtggaattcatatatatgaatgtacatggtgtatgtacatacaataaaaccccatcataatgtgagatcccaacttcagccatataaagtgtgagtttctttgattgtgacattgttgattgcaaggtttaggaaattaccacagtaaacatgggaagccaattgttagcagttctggcagtccaactgtgtaatccaaatgtgtctaggtcctagctatggtttcgtaccacccagtgtcagttgcctgatccagctggaatattgatggggatcattctgaagtctgtgagtggataggacttccagattggagtagcgattatagatatctcctggttaattggttagttgacagggttacctatcatttttcacctaactttgcctgccaactatgttcgcctctccctgtagaatgtaagaacttagaccacccccatcttcatgtgtttggtggtagatcccacagactaacctatctgttctatcactatgactttcttgactattgagagagtactgaatagttcagcattttcattcttctcccacatccaatatgtgagagcacattttcttgaccatgtcagggaaagctaattaagtggagaaaccagacaaggaagcaggtatgtttcagtgtgacctacggttcttcactcttccctcttactaggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagtaagtgatggagaggccaccatttgtgatggtgtagttgttaggttgttaggatttttagttgcaaataacagaaactaaccatggcttcttaagcaaaaaccaggcattggttggaggttgtattagtctgttcttatgctgcaaagcaaatgaataagagatagcaatcattagaggaatgacagagaaacccaggtatttagacctgaagacttaaatatttaatattacaaatacttgatacagctggggaaaactcagggcaaatcattttcttttctcagggcaaatcatttctaatttcacatgctctttattgagacatacctgagactgggtaatttattaagggaagaggtttaattgactcacagttcaatatggctggggagacatcaggaaatttacaatcatggcaaaagaggaagcaaacacatccttcttcacatggcggcaggagagagaagaatgagagtgaaggagagggggaagcaccatattaaaccatcaaatctcatgagaactcactcactatcatgtgaacagcatgagggcaactgcctccatgattaaatgacctcttacctcctactgggttcctcccacaacacgtggggattatgggaactacaattcaagatgagatttgggtagggacacagccaaaccataccagacggggacactaaggactcttaataaactgatgggaaagctgaaaagtggctgggtacggtggctcatgcctgtaatctcagcactttgagaggccctttgagctcaagagtttgagaccagcctgggcaacatggcaaaaccccgtctctacaaaaaatacaaaaattagccaggcatggtgatgcatgcctgtagttctagctatttgacaggttgaggtgggaggatagttcaagctcgggaggtcgaggctgcagtgggccaggctggttgaaagagcaagaccttgtctcaacaaaaacaaaaacaaaaactataaagcaagttccagaaaagataagcttcaaggaagagctgaggctcagttgtggtgggtgtggggaggtaagggagtgggctttctctctaagatgctgcttttaccatgtctcagcttcagcaatgtttctttcacttccaaattttgaatttccaggataaataatcagattggcctaacatatattagatgtctatcagcctagaccagtgagctatagacaagggtggagtcacgtactacacgttacaggcactagaagctcacatttgtacagcataatcatccatataaaaagggggatcacaatgagtaaagcagtctcactgaaacgtgtctgctctagggggatgagttggacctcttgggttagactaacatctgcttaaacattgcctcctgtaaatcccacacttcccaggtcatttaactcttatgtgtgatttttattttcagttttgaaaaatgtaagagttagaactagtaaaaactttttttctccattataactattgaagtgggggcataaatatcaccattacattttcctgtaatttttacaggaacttcacaaatagaaagaaaatgatttgccctgaattttccccagctagatcaggttttcataatattaaatattgaagtcttcaggtctaaatgcctgggcttctctgtcattcctctaacgattgccatctccaattcatttgctttgcgttatgttcccccattcatttaccaaaatgtggtggtcataactctgtgccaagaattgtgttggtgttgagaatacaggatcataagataaatccgtgtcctttgggtcattcccaatcagagtaggcacgtgtataattagctaaataaatattgaaaaatgacaatagaagtatgagaagtgtggttcctctagtttatgctccatgcttagccacctctatggacataaaatatagcaaggtgttttataggcaggactatttgggcttgagtcgaggggaatctttccacgtacccaagacctatttccttctggatgactactgtgcttgacttctattaaatgtcagagcagcctttttgtaatatgaatcttaaaaaatataatttatgatgatagcaaaactgcaatattcagcttctagtagcttgcctcacagctacctttacatgaagtttctgtggacttgggagaagcaagtgacatccccttttattccactactcaggagagtctgaatgtcaaggaagcaatttgcctttatttcatttagctagtttctctggagtctgatataacaccatgtactaggtgtactcagagggtaaatggggtacatcttctaggaaggtcagacatacctatacatgttgatatatagttgtttgagataggaaaaccaaagtgtttttcctaatctctgctctcactgaacacaacacttctgacaccaatgtgcacagattactacgccacttctagaatttctcattcagtaggtcgtggttgggtgggatctggggtttgcatttctaacagattcccagatgatggggatgctactggtcagagaccacactttgaaaaccacagctccagcctgtaaccatacctgcagctccctggacatgccatgctgtcttcccatgccttgtctttgcctggaagacactctccagccttatcttctttgctacttagttggtcctgcagattcagcttgcataccatatcctctgggaagccttcctttatgccctcttctatccaccagacagagttaggtactccttgtctttgtttctgtcgcgatttcctgtttacatgtctgtctcccatattagatgatgagcttttagagagcagagcctgtattttatctttattcaccattgtccactgaatgactgacacacagtaggtgctcaataaagatgtgttgagcgaatgcgctctactcaccacagccttgttttccttaacaaaaggatgtgaagcccagaagtggggacctgaatgcaaccatctctgtactgcttgtatgaacaatggtgtctgccatgaagatactggagaatgcatttgccctcctgggtttatgggaaggacgtgtgagaagggtaagtaaagagacttgataagtaagctgtggatttaaaaagccatcgttgctggatctagaattttagatctcgacacagatgggaatggaagctaaatggcctctgttaggtcagatggtacctgtgtgtgaattagaaaaaggtgccttttcctaaaggttctttaatgccaaccactggaaagttataataaatatacagatccgtgatgtttacagtgtgaatgctgccccctaggtttgtgcactgcacaaacctgcatgattgtgagtgatgtccctgatgtctgctctgtggggcagtttcattatcagtaaaatgggccataagggtatgttcatcctaccatgccacagctgagatttgactgtttcccatattcactagactaggagaaatgaatctaaagaattatgtatttcaaggggttgtatatttgactctgaatcatcttttcttttcctcccaaagcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggtatgcaccaatcacacccttggacagaggatgttctagcaggtatataaaggagatccagtttgctgtcaatcacaacatcggatatacctggactgcttagctacccactactggacaacaggattttgaatcatggatgtttacatccaatgttaattatactttcacagtaaaaatctagaccgcatagaaagtacttctcataactatcatctggggatctttactaaagcacggattctgatttggtaggcatggactggggcccgaggttctgcatttctaacaggctcccaagtagttccgatgttactggttttcagaccatgctttgagtaggaagaccatagaagacttgttttttttttttggttttttttttttttttttttcagtgaatcataaaatcacagctttagccaggcatggtagcacatgcctgttgtcccagttattcaggaggctgaggcaggaggatcccttgagcccaggagtttgaagctgcagtgagctatgattgcaccactacactccagcctgggcaacagagtgagacctcgtttaaaaaaaaaaaaatcaaaatcagagcttttatgtcagatccagacaggatttggggctcaaaaattgaagaagttaaaatcttacctgccgtggaccttatgcaagtagtactaacatcatctactcagagtccctctgccctttgtaaaataagctttcccatttgaccaggctctgtggagtgcatctgacatccacttttcagtatgcatttcacatctactgttgcatagtagctcaacatgaacctgcagacaaatgtgacagaacctccctaatgtatattaatactgtgaattagccagagctcaaaggcttttcagtgtttatctcacaaagtcagcttttcccatatccggcactaaaggtagctacgatggggtcccagcaacttgataacaatgctccagggcagagcagttcagtagaaatataagccatccacatatagaatttaaaattttctagtgtccacattaaaaaagtgaggagaaataggtgaaataattttgatctattaacccaatatgttaaaaacattatcagttcaacatgtaatcaatagaaaaaagtattaatgagatattttacattccctttttcatagtaagtctttgaaatttcagtttggactagctatattttaagagttccatagccacacgtggctaactgtactggacagcatagctccaggggcttggaggaggaggacaaagaggagagttacacaaaagtaagcttcagccacctgcaatacctcattcagttccctctaaatgctatgtctgccccccggaacatgcagtgagccacagcagtggagaaatcccatctggcctctgaagtgtgtatgttaaggtaaaaggtgactccaggcagggggcagatcccttgtattttaaaaaaaattaaaatgttacgcaaactatgaacactttgctaggacccaggaagcggtgcatgccagcagtctctagaacataaacttcatcagctttgtagtgaatgtgtctctgggcccaggtttttttgtttttttttaaattctttttattattattattattattatactgtaagttttagggtacatgtgcacaatgtgcaggttagttacatatgtatacatgtgccatgctggtgtgctgcacccatcaactcgtcatttagcattaggtatatctcctaatgctatccctcccccctccccccaccccacaacagtccccagagtgtgatgttccccttcctgtgttcatgtgttctcactgttcaattcccatctatgagtgagaacatacggtgtttggttttttgtccttgtgatagtttactgagaatgatgatttccaatttcatccatgtccctacaaaggacatgaactcataattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcatcatgatttataatcctttgggtatatacccagtaatggggtggctgggtaaaatggtatttctagttctagatctctgaggaatcgccacactgacttccacaatggttgaactagttttcagtcccaccaacagtgtaaaagtgttcctatttctccacatcctctccagcacctgttgtttcctgactttttaatgatcgccattctaactggtgtgagatggtatctcattgtggttttgatttgtatttctctgatggccagtgatgatgagcattttttcatgtgtcttttggctgcataaatgtcttctttagagaagtgtctcttcatatcctttgcccactttttgatggggttgtttgtttttttcttgtaaatttgtttgtgttcattgtagattctggatattagccctttgtcagatgagtaggttgtgaaaattttctcccattttgtaggttgcctgttcactctgatggtagtttcttgcccaggtttataagagtacatttcatgaactcatctcagcccattcctggctcaagaaatcaccaagattttatgaatagaactgttctaatattcttccagactcctttcaacaattactatcctgttcattccatccaaaaagcagtaggaaagcaaggagacatttctaacagtaactacttaaggacatggtctcctttaatagtccaggatttagaatagtcaacaatagattgtacactggcaagttttatgtatcagggctggtttctatctgaggaaataagcaataatagaaatttttgaagcaaatagtggggacaataaagagaacaggggaattccactgtgcaaatatgtgataattcaaagtcattcagaacactttgccaggaagaaagttctagtgtattctagaaactaaaaaaatcaaggcttcatgatattttaaggtcttctgccatcccaacagaaacttgatttcagtagtcagatttcctttatgcttattaatagttcttaacctttctaccatctgctttgagtaagaagttgtgattaagtttttttccagctttatcaaggtctaattgctaaataaaaattgtatgtagttaaggtgcaaaatgtgatattttgatatatctatacattgtgaaatgattactgctgttaagctaattaacatatccatcacctcacacagttatctgtgtgtgtgggtgtggtgagagcatttaaaattgctcagcacatttcaagtgtacaatacagtaatattaagtttagctaccacactgtctattagaactccagaacttacttatcctactgtgtaattaaaagtttttgccctttgaccaacatctccccatttcctccaccctgtagtccctgggaaccactatgctactctgcttctataagtttgactttttcagattccacttatagaagagatcttacagtattggtctttatatgcctggcttatttcacttagcatggtgccctccaggttcatccgtgttgttgcaaatgacaggatttccttcttttcaaaggctgaataatatgccattatatatgtgtacacaccacattttctttatccattcatccatggatggacgaatggtcaagtccatattttggctactgtaagcaatgctgcaatggacatgagaaaacagatgtctctttgagatagtgatttcatttctcttggatatataccagaaatgggattgctggatcatatggcagttctattttgagtgttttgaagaacttccttattgttttccataatgactgtaccaatttacattcccaccaacagcatacaagggttccctattatctacatccttgccattctagcaggcgtgatgtgatatctcattgtggttttgattttcatttccctgatgatcagtgaggttgagtatttttcatagacctgttggccatttgtatgtcgtcttttaagagatgtcggctgggcacgatggctcatgcctgtaatcccagcactttgggaggccaaggcgggcggatcacctgaggttgggagttcgagaccagcctgaccaacaacgagaaaccccgtctctactaaaaatacagaattagtcaggcacggtggtgcatgcctttaatcccagctacttggggggctgaggcaggagaatcgcttgaaccagggaggtggaggttgtggtgagctgaggtcatgccattgcattccagcctgggcaacaagagtgaaactccatctcaaaaaatgaaaaagaaaaaaaaagatgtctattcaggtcctttgtccatttttttatcaggttgttttcttgctattaagtggtttgcgttccttatatattctggatattaacctcttatcaggtgtatactttggaaatacattctcttgttccatacattgtttcttcactctgttgattgttttctttgctgtgcagaagcttgttagtttgatgcaatcacatttgtctatttgtgcttttgttgtctgtgcttttgaggtcatatccaaaaaaatcattgcccggatcagtatcaagaagcttttcccgtctgttttcttctagtagttttacaatttcaggtcttatgttgtgtctttagtcaattttgttttgagttttgaatataatgagatgaggttctaattttattcttctgcttgtggttatccagttttcccaggactatttattgaagagattatcctttccctgttgtgtgttcttcatacttttgttgaatctgttaactgtaaatgtgtaaatttatttctgggctgtcaattctgttccgttggtctatatgtctgtttttatgccagtaccatactgtttttattactatagctttgtaatatattttgaaatcaggtaatgtgatgtctctagctttgttcttcttgctcaatattgctttggctattctaggccttctgtggttcaatataaattttagtatcgttttttctatttctgtgaaaaataccattgcaattttgatagtgattgtattgaatttgtagataacttagttgtgattgatactaaaaataaagactgcattttagctgggtgaataaaatacaaaatcaaaacaaatcatcatagccccaaaagacaagcttttgcattaatttttggttagaagccttctagtaatgttacagttgaccaaaataaggacacccagttaacagaatccatttgccatgtaccaaattctaagaattgtcctggcaggtttagtgagctccaagggaaaataatgcttctaccctgtcttcccaggagcttattacaagtatcaaaacataatttgaatggcttaaatattctactataaagaaacagtcttaaaaagctaacattttaaattatcttgatttttagtttttagcagtttaaccatgatgtgcctatgcatagtttactttatatttattctgctaagggcttaacaaatttttgaatgtgtaaatttcaacaaattgggataatttaaaccattatttcttcaaatattttgtctaaccctttctctctggtccttcttggacctccagttacatgtgtgttagatgttttgtctcttgggtccctaaggattaaaaatcatttttttccaacctttttcctacttttcttctttagatgggctatctattgatgttgcttcaagtttattgactctttcttttgttatctccattctgttgctaagtccatacagtgattatttgatttcaaatattgtgtttttcagttttagaattccttttgctttttaaaaatagtttctatttccctgctgaagtttctcattgttgcatttgttatgaacatatcttcttttaccttactgagcatagttattatagttgttttaaaattcttgtctattccaacatctgagtcatcacagttggtctctatttattttcttttcctttaaaaaacgggccttaattctccatttcttctttggattgtatcttgaacattgaaaatgttacattatggagactctggaatatgatacattccttttgggaatgttgattttgttttgttttagcaggcaattaacttggtaggattcaaacctcaaactctcactgttaggaatcaggtcaaactcagtttagttcttttatctttagctgggctgctttgagtctatactgagcatgcatggatcaaggatcagccaaagatctgggacttttctctgactctttctgggttttccctctctctccagtggctgtggttttcctgactctgtctctgatgcatcaggccagtagactgcaggttttctttggagttgtagcttccatacgtggtgtcaactgtacctaacagttaggctaaaagctgaaaattgggaaacacatcattcccatcttccaaatttcaattcccctccagaatcttccaggtcttttttcttcctatcccactcttaagtgctttcaggaagttattttctaaatgtagttgtacctacaagaaagttggcatgataggagctcattcaactttttttggaagcataactccccagctttttaagttcctggtaattcagataaattaccccctaccttacacaaatcagcaaagttgatggcttagagagaaaaataaaactaaacacctgcagtcttagtttcctctcttcccctggattaatactggttttttgatgtctctgtttacagcatgccaccctggtttttacgggccagattgtaagcttaggtgcagctgcaacaatggggagatgtgtgatcgcttccaaggatgtctctgctctccaggatggcaggggctccagtgtgagagagaaggtaaagcaaggtaacactgtagtcagggccatgttcagcatgtctgaactgagctttggtagtgtaattcttgtgccggcattctaagatcctcaagcctcttttgtttccatccagaagttgggaatagtttatcctaaatcctaaagcacagcattttaattctgctctactgaccctaatagtaggctttatttgtctttgcactaggcataaaccacgtgctctttgtagcagcttaagtgatgactggccagctgagagctctcctaccttttctgctcccttctctaggaccaaccttttccctggacatgcgtaacagagaaagagcaatttgggatggatttagacaggggatatttttaaagcaatagaaagaataaaacaaatagaaaagattatgctcaaaatgaaattttatgtcattctagttcagaagttactcttcagcaggagtcagcaaactttaacccacagactaaatccagcccactatctttttttaaacagctttatagagatacattttttatattataatgttcaactttttaaaatgtaaattcagtggtttttagtatatttacagagctatgccatcattgccataatctaattttacaacatattcatcataccaaaacaaaccttgtacccattaatagaaacttccattttccaatcatcctaatttctgacaaccatttatttgcagttgaccttaaacaacatgggggctaggggtactgacccttctcacagtagaaaatctacatataatttttgactctccaaagacttaactactaatagccttctgttgacgagaagccttaccaataacatagtcaattaacacagagactagtatctgtatatattttatgccttcatgacatacctttttcttaatttttttggtatttctaggctacacagtttgtctgtgagttttttcaaattatcctaaatctccaaaaaattttccaatatatttattgaaaaaaatccacatgtcagtggacccatgcagttgaagcctgtattgttcaagggtcaaccatatcttctgtctctgtagattgcctgttcttgacattttatatgctgtaaacaagattgtataatacgtcgtcatttgtgactagcttcatttgccacaccttttttgaggtttatctatgttgtggcatgtatcagtacttcattccttttttatttctcaccatctgttattataaagaaaaaaattttggatcacagccacctccattcatttatagtatgtcgtctgtggctgcttttgtactacaagggcagaaaacatggcttgcaaagctgactgtatttgctctctttacagaaaatgtttgctatccactgtcgtagaatatactttttaaaattaaaagaagcagacatatgtattttcaaacttaataaatatgtattgctttttcaatcatataaatataaatgccattgaaataaatacatatccagtgaaatctacactcacaataatacagctatggcctttttttctgttacttttggaaatcagaacaaatattgggagtgggggtgggatgccagtaagtgttttctcaaagtccttaaactttatattttttcttcttttgccaagcctggactttactacagggcaggaatcagggagtggttagaaagggaaggaaatgccatggggctactaggggattgtattgaacgtgggcagctaacaagtttaaggatttgaattttgtgctttgttccttcccgtctgttcccttctgctgatgctgcaaaaggagtgcattctgatgggagaatctaagacaggttaaccagggtgtcactagggctttcagagagtagctcccttcccagattccactttagcccagcacatccaccttcacccccacccagcttcagaaaatacaaggggacgatgaaggaaagaaatgctttaaaagtgtcaaaacatgtttttcaattcctattcaaatagctacttaggctgaaaaacttggcacgttttccataatctttccaagtttacagatatatcaaggaataaccttgtaagtattagacctctttcccttctcctccacacctttacccatttcattctaggcctgagaagtaggatatcagtataaaatatcattattgaccccgcctcttcccaccaccgataagaaacagtctgtagttactgctgctctgagggcacctctatcgcctacattgtttactgagtgttggacaattttcaaacatgtctcacattcaattacaaatagtccacagttccctgagtccctatggttcagaataaaattggtatatttcagggttattcattctctactgtgtagatgttaggcaagaaatcctgacaccattacctttattgacactacagacatttttccttctttcaatattggcagcaacatttttgatttggctgttgagtggatactgatttggggaagttatatttcacttctttgatgtacttcttttgtgagcaactttattcaccttttcctcttagttatctgctatttgcagacttcccaatgaatgagacatctctcgtatatctaaactgaggtcaatgctgttgaacagcaataccatggggttatttgatgagtggaggaagaactagttttttgtttgttgtatttttgtaatcattcatgtaaaaagaaagagggggattgaacagcaaagtctaggggagatatggccatgataatcattttaatattgagactgttcctccctggtccatgaaaggagcacagcctcatggcaaagagcgtggactctggatttataaagatctgagtctgaatctgggctgtgagcctctgtctcctcatccataaaatgggagaccacaatatcatccacatcacaggtgtcttatgtgatgacaaaacagtaaaatatttgcaaagttcttgcccggtgcatgacttactaaagtagctatttttattattactactgctgctggctctgttaaatattagatttcacagtgctgttttcttccttcaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatgtaagagccattcttaatttgcccttcttaaagcatgagatgcttcagtgtagtaatcaccccactaaatgatagataccattcagtgcttttatcctcctaggctagtgtgttgttggctttgataaaatgccctattcctggagaggcagaactgactcactgcagcctcactgatttcttctgttggccagtactgctctgcatggttgggaatatgcctcctggggaactgacagagctgggtgccaaggatggcacacatcctgcaggactgtccagctggtatggggagaagtacgtgtcaatctgtgcaaagctttgctctcgcagtgtccccatatctctaactactcatatcaggagagtaaggtggtgttgcaacccatgaatcagcagatttacgtgctaccaagtgcaaccaggacatggagttttgatgaccggtccactcctattacgctctttggagcagcagtttaggggagcatagaagaggagagttccccagttctgaaactacaatccacgggatcccttaggtctgaatgcattcattgggtttctacccacctcttccctttgccttcattgctgatgctcacccatggtcaggtaatatcacagcagttattttttgtttaaaaggatcaagctacttttcgaacatgctttccttctctctcccaactataccaaatgcagcagagacaggagccaccccaaatttctcttgtgttgaaagtgatccttaggatattgatgtattttttaatctaaaaatttagaaatacttattatcctatttttctatcaaagatgaccaaaatcagcttgaccagaggcaggtatgagtgaccttctgagggaggaatatgtagaatgtaccattactagggtccacgtttcaatgtccctgattccactcaaacaacccatcaggtagaagaagccaattgatggcttccaaaatcttattggctttttcatgagttaatgaaagtaatggctactatttagtaaggttggccataactatatgtaacttcttacttaacattgcctagtgtctcttttttttggcggaagtgggaactggctgggtgaagttaagtaactaaggaattggtcaaaaatggcaaagagcccagatacggtgactcatgcctgcaatcccagtgctttggaagcctgaggtgggaggatcactttaggccagaaatttgagaccggcctgggcaacatagcaagaccccatctcttaaaaaataaaaaaagaattagctggacatggtggcatatacctgtagtcccagctacttgggtgaggtggggggatcacttaaggccaggagtttgaggctgcagtgaactatgatcactcaactgcactccagcctgagccaaggaacaagactttgttgtctctcaaaaaaaaaaaaatggcagaggtccatctctcttcagaaccctggatttttccagtactccccacttgacagcctctcaaacacttaggaagtcactttgtcctcccacgcagccatctctgtgttagataggaaaggaacaaatcttatgaggaggagtttaaaagaaatcatgcttcaggtgtcttgcttgtaagtgtttaccccgtactcctaaacacacaaatacaacagcaggatctgacagggcatcaatccaaaataaactttcagggctactacaatagctttggaaataagccaataattatattagcattacatttagcttcttgatctctcctaggaaacttcttattaaacaatgagatggggtcaatgttatggacctttgcgtttatgcctccctagaagtttttatttttttgtatttgaccttttcagccaaaagactttaaccatacggatcatttctcagtagccatattcaccatccaccggatcctcccccctgactcaggagtttgggtctgcagtgtgaacacagtggctgggatggtggaaaagcccttcaacatttctgttaaaggtaagttcatttcccagaaaaagggattgtgtccttgatgcattatgtttttgtattgctgcttctagacagaaatgtatgcgaccactaaaatacctttggggtaatttccaggatagtaagcctttaaaaaattatatgcatgaaactagagtgaagaaattaagagtatgaactgtggagtcacacagccccaggtttgattttgtccctaacagctcataatcttgtgggtggccttgaccaaatgaagttacctttttgagtgtctctgtatttgcaaatgaagcataatttaggtacctcttagggttattgtgaagccttgttaaacacatacaatacttggagttgtgtcaggcacaacatatctggtagtgattatatttcacaagaaggttagcattgccgttgtgacttcctattcattattgtagagaattatttggagaatccctattttgaggattactcacttaataagaagcccaggctatgctatataattaacatgaatgtcttttcacattcagggctgtgggcatttttcctgctataaattagtatttcaaaattcaaattaatctgagtgtttgtgtgtagatttgtggcttgagtggaagaactaaaatggaggtaagtccacgttaacttggctggtgtacgtagctacagcaaggaattttaaatccgcaagttacttaatcacctgtttagacaagaatacctaacagctctctggcatatattctaggaaagatactaggctaagattacttgtaatttctgatacattgtaaatgctctgtaaatagttgctatcctgtattgtttagagaataatgagaagaaaaaaagtctgtacatgttcagacacaatttgttttctgaatatttttgatccacagttggctgatccacagatgtgaacccacagatacaaagggtcaactttatacagtagcacacattgtaagcacaaatcttagtattaaacctggatcttctgactccaaacccagcactatctcttctggaccattttgctttctgagtctcttgtgttacagaggaggagactgtgaggtgaccaaagttgatttgtatttggccccctttcgttacttcattagtaatctcttgggagatctcagaggtaacttctataaatgaaatgctgtaaatactcagaacataatctgttttttaaaggccaataacaacagtagcgtaaatgcaaccccatagatttggattctgtgccctgagaatccatatgaaccacctcagaatcctccttcttattattacttttggttataggaaagagcccaaatctgttttatttggtagaacattcacgtgattaaaataatttcttgcatcttgaatgttcttggaagaaaggaaatgatatgcagacaagaaaaattaccctacttttaagcttctgggaatgtttgctacccatggacatacgtccaaaacaaaccatgtggtgaatacacagaagagtcactgggtctagtttttagtttgtagtgaaagacacggcacacaacatcaatgtgtagaagcttctccagtcgtaagtcactgctgtctctttgctgtcacattgactggcagccataaaatgtaaatagccattagggaatttaatcaatttaatcagcatcttttattatagtatttacaaaaacagatactaggctttaacaccagtgtacagattgatacagtcactttggaaaactggcaacttgtactaaacctaaacatttacttagcctgggaaccagcagttccacccctaggtatatgctcaaaagaatggctgtattatgttcaaaaaagacatcttcaagaatgttcagagcagttgtattcatagtagccccaaactgaaattaactcaaatgtccatcaacattagaaaggatacactaatcacaaattgtagtatattcatatgtattagtttgctagggtgccataacaaaatactacaggctgagtggcttaagcaacaggaatttattttctcataattctggaggctacaagtccaagatgaaggcatcagcagagtttatttcttctgcggcttctctccttggcttgtagatggccactgtctccctgtatcttcacagggagattaaattaggacacaggtacagggtcttccctttgtacttgtgtcctaatttaatcctcttacaaggacaccagtcatattggattatggcaaaccctaataaacttattctaaattaattacttctttaaaggccttatgtccagatacggttacatcctgaggtactaggggttaagactttaatgtgtgatttggggggaatacaatttagcccataaaatcatgcagaggaatgttaaacagtaataaaaaagaattaatttccgcaacagtatggatgaatcttgcaaacatgataaccagtgaaagaaagtacatgctttatgattccatttatataaagctaaagaacaggcaatactaatcttcagtcacagaagtcagaatagaggctacctctgggtagaggatattgactggaaaagggcacacaggtgccttctggagggctgggaatattttctatcttaatctgagtggtggttacatgggtgtacacataggtaaagtcccttgagctaaatacacttaagatattcacgctttacaatatgtatgttccatctcagtaaaaatgattaaaaggcaaaaaataaaatagtagattactaagaggaagcctttgtagcaatttttaaacccttgtagaagtatcacagactgacattaatggctgtaataaaatgtgcatctgctggtttaaagaaaggggtggccttattttatcatacaaggaaagcattacttgaacaaatttacttacagcactgccctcctttctagcctaagtgaaatgtgtactcagacttatctaacttaatattggcatgatctgcctccagttaggggatactgcttcttactggctttattatcctgaccttggacaacttcctaagtcgtcacttagtcaatagaatttactttaggcctattatgtttcagcccctgttctaggcactgggaatagagcagtgaataatacagggggaaaaagactcaccatggagcttacattcccacagggagataaacagtgagcaaataaataagtagaatgtacagttcacgaaaatgctgagtgtcttggagaaaattaaagcagaaatgggggtagagaatgctggggcagggctggagtggtgactgtaattttaaatagggtaatcaagccttcctgagaagatatttgagcaaagacttgaaggttatgtctaaggaaggtgagccaaagcattgagacagaaagaaaaggaaaaattactgaacattgcaatgtcctctgaaatctgaaaggttctgcattgtataatacacactcttggggaggaaaaacaaaacgagttatgcatttctaagaaggctgggccaagggaactatagagctcattggaaattcacttcacaaacaataactcagcacctagtcggtgctggtgaacaaactacacagtctttgccctaatggaatttagagtgtagtgtggtgtttcacaacctttttattatcatcccactaaggagctcttttagaaattgtattccagaactctccctcatcaccataagattttattatcacagatgtactttatatctctttatgtactatggctctttggcgggctgcaacccattgtaatatctaaaatttttgcatcctccaagaaccaattttcattgtttctggggcgctgtcatccccattgagaagatgtggtctttgagatggggagattgttctagattatctgagtggacccattccaatcccttgagtcattcaaagtagagaaactttcctgacaatagtcagagatgtggtggtcagagaaggatcagagaggcctgatgttgtagactttgaagggataggaaggagccttgagccaaggaatgcaggcagtctctagaagctagaaagaacaaggaaacagatggtctcctaagcctccagaaaggaacacagccttgctaatgccttaattttagcacagtgagatgcatgtctgacttctgacttctagaactataataaatttgagttgtttggctgaaagagagagatatatatatatagagagagaatgaattatgatctagaagaaagaccaatatcaaataatcaaataatcatactacaaagagtaataaaccctaaaaatcaccatgaaggaaaagtagaggttctgtgaaagtatacaataccttaattcagtttctatgatagccacctgtgaaatattcacatcagagctaagaattaactgggagaataatgggaggtggagcattccttgcagaagagagacatccacaatcaatctaaagaaaggaggttcgtgctttgttagttggatgaagtgaaaggtcagtgggactggagggtactaggtgaggggaagaggaggctggagagtgggcaggggcttaatcactcaaggcctggctggtcacgatatgaatttttggttttatcctacatgtgatgagaatccattgaagggtcttgagcaaaggggcacatttattttaaggaagcactttgaggataatgggttggggaagcaaaagcaaagcagagagcttagagagcaggtgatctcactgagtctgagcagaaaactttaagaggactttgttggacatgtaaaacatatcttctacctctacctaagaacaatcacaaaacctcaaagccgaaggactaatctgccttctgaaattgtatttagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaaggtaagctttggacaggatagatgccagctggggatgtggcaccaggagaattatttttctccaaatctagaaattcccttctccctgcctcaatcctctacctcaaggtggtggctgttgcagaggattctgtttcagagtattcaagagagagtgcagggggcccctgagctctggggctaactttctgaagtcactgtgtgctctagaacacagaaccagctcacaccatgagttactatctatatcaatatttctttttggatctccagtcctgtttttagttattctatcttggctggtcatggggaaaggcacttgtttatgccatgaatatggtagcaggaaagtccagagcctgctggaagggcagagaggcttaatctgcctaaatcctgggggtgattgttgctgctgtattgagttgtttattccttttctcatttcatgtcttgccctgtcctgcagactcttaacacagagagatttttgaaggaatttgaacctgcaaagtttgggctgtggcagactggaatgggctcgggggaggacaaggacaggcaaagggagctacagacccctcccctaacttcctgaaagaaaaaaataattgaacaaaatgtgacaaaatgccaaaagttcatgaaaacagttgaatttattttgaaacacaaattacaattatatttgttgtatgataatgtaaaatcacaattttaaaaagcaaagagcattatcagtgaccatgctgcttcaattggactattctgtaaaaagacctgccactaacatgcttgtaggcagcatgtcctcctccgcccatacctttgtcttactatgcctatgatttccttaaaatgaccctctattcactatatggagataattaagaaaactatggaaaaaaaaaaagagaagaggaggagggttttgggctgaataacactagctgacctgggtagaccgaataaaatggtattattactgagtccttcacatactattgtagattctatcaaaattcagaattccagggatgtcaggctgatttgctgaattgctgtttccaacatcaatggctaggtcttttgctgtcatatggtggtaataatccatcacctttgtctacaagtggacatccacaaagtggtcttctaagaactgttaaacacatcccagttttttttcttaccaagtaggaatttatcatatgataaggcagaaatttatctttgcagtatccatggagaaacagaggctgactaaagcaaataggtaaggagaaaagagacagataccatttgtttatgggtgctattttcaaggacttcagaatgcttcattgtaatagtatgaccattgcaaatcagttttctggtcattttgagcaaacctcctaagcatctttttctctcgatagcttgattgcaatcagtgtacatacttgaaaacagtagcaattaaattattctaattgagtattcccccaatctggtattccatatagatttgtgaggttttattctacaaatgaaaagacaaaagcaccagagcagaaatgtgtaagtggcacagaaatacacactttaatgtgtacattgtaacctggaaacatttcaaaagcctaattttcctcatattaggaaggatgaggccttgaagatggaattgcctctctgtttcactaagacgtagttttgaaaacctaaaattagttcacatcgcaataacaacaaccccggcttaaggaatgtaagagaatgccaacttaagtttcctggacgttttctcttctcagtgacaaatgagattgttacactcaactatttggaacctcggacagaatatgaactctgtgtgcaactggtccgtcgtggagagggtggggaagggcatcctggacctgtgagacgcttcacaacagcttctatcggtcagtggaagccaacaggcatttattcatgagctgggtgggagggggaggaaggggaaagaggaaggaagaccaggaagggtggtggtgggtgagtgggtgggtggggatggaggtggcaggagttcgcttttgaatgggtgggaaagtgacaggaaggctagcaacttcaagccaaactgttcctttatttgggttggactcctggtctgtctccctgggggaggaggtctgcagcactctgtagggacagagaaggaagcagatgagccttcaggaaggcagggcctcccctaggagctgggatttacacagcagcaactgtgctgagcttcagctcctgcattttatcactggcttcctgtttccatcttaagggcccagaccaggctcttgccacaggcatattttagaagtcccagtttatttattttcaaaaataatttccaatttttcaaagtaattcatggtcagagtcatgacatcaaatagaataagaagcttttatctaaagaacagcattctcctgctccaccctccacctcccagtcctgcttcctataggtagccactttcatctccttaagctatttcttatatttacctcccttttctaaatcagtggttctcaaacctaagtgtccatcagaatcactcagagagtttgttaaaagatgtttctgggcctcatccccagagtttcggattcaatggttttgaggtgaggatggggccggggttcaaaaatttgcatttctagtagcttcccaagtgatgctgctggtcctgggtccacacgttctagataacatgtgtaaaattacttctggacttctcagtggtgtttggtattgactggccttctattgcgttaattaactctgtgaagcctccttgatgctaacctgacctccagcttcctgttacccaggtaccctccattgaaatactggagtgatcttttgtaaggttccattcctggttctttgaattgttcactgtgtataaccattctgttactctctcttggtcagtactttatactttcaacttcatatatatttgatttatatcacctaggaaagtaagaattatcatcttccctattttacagattgaaaagtagagactcagagtacttaataacagtaagatgcatcaccatactaaatcttcgggcttcatatctttgtcttttagagccaggatcttgctctgtcactcaggctggagagtgcagtggtttgatcaacactcattacagcctctatctcctgggctcaagtcatcctcccacctcagcttcctgagtagctgggactacaggcacaccaccacatctggctacttcaaaaaattttttttgtagagacggggtcttgctttgttgcccaggctggtcttaaactcctgcctcaagcagtcccccagccttggcctctcaaagtgttaggattacagggatgagtcaccactcccagtccaggctccatatccttttgtttctccaattattatttctacctagaatcccaaaggcaccagcttattatcccagttcacatatttgcctgtgttttactccatttactaaaagtagaaggatatgttatgattgagtgaaaaaaccaggaagaacatccacttttcttctgcagagattgtgcacccttaacagaaacatccttccttcacaccacccacctagtttttatgttactagcagcatccttaaagaaccaaatgagactcaaaagctactctgagacttatagaagcattacacacaagtaagaaatggctgcttggggacccacctggttgtgaatataaaaaataaacccagaaactatatagagaggaaaaagggacctctacaaccatgacccaagggatccctgatatgtcatcatgttactgctaaaaggcaaatggtagttaattctctctcaagtcactgttggtgagtcaagaggggaagagcataaactgactcagatggaaagtatttatggaacagaacataaaacacttcacagccccacactgtactgtcttcagccctcagaatgtgttgcagccaggaggtctctcagaatatttcaaagtagttctcaggggtaggcgggaaggggattattgaaggttcttcttttcccatcatttgaattttgctgctgtttgcttttcatttcgtctggcagttgcactgtttatgtgtgttgattgagatggtgaaggccagggagtccgggaggggaaggaagagaacactttctgaacatagtgcagaaaggggcagacagggaggcgtatggggtaatcatgttcccaaagggcgggaaaaggggaaatgactatttattgagttactcttctgtaccaggcacaggattaggaggtgtaaatgtattctccaaaatatcaactccccattctcctttgtcattgcaaacctgcctaaaccactctgggtggctattttggaggttaaacttcagaggttaacaagaggagatggcatcacctctctccatttgcaaaggttacagagaaagggccatcagaccttttgcataatgccaagaaaatgcatgcctagctgctggttctcactagtctgagggtagtcagaaccaggctggtgggacttaattcccagtagatggaaacagacccttcctctcacctcgaaccaagagtaagagcagtgtttctcaacctttaaaaaaaaatgtattgctcatccccagtgagctgtttcagatacgtttatcctagtagatcctgcctcccgtgaaattttaataccacagatatgctctatatctgtttctgtattatggtcctctgtaaacaattgtagtaatctgaaattttctcatacactaagaacaaatttttttgccccataggagtgattgtgtccctactgagaatgcatgaattagaggatctctatcctacgttttggaaggacttcatatctggaatttaaaaatcaatttactattattaactgaaaacacactatttcctcctttgtccagtgacataagacatctcgaaagaaggaagggagggaggaaaccagtgttaatagagcccctaacaccttccaagcattttcacatccattttctcacttattactcctgagtctggaagatggatattttaattttattttacaggtgaacttggagagattatgaatttgcccaaggttgcaaaagtaaagtggcatgttcctgtctctctgattttaaaacccatattgtttctattcagtgatgtcttggtagcccaggctcctgtgggtgattatggccaggcatcacgtagtcatagcggataccttgatgtgatcagagcaggaataggcctggccctgccaccacagctgtatgatttctgaaaatcttgctaaggggaaggaacccctaaattgctttacaatgtattgctcaaaatggtaacagaaacggtaaatactctcccataatcccataaccttggcaaatctactgttttgatttttatcagtttccttcctatccttcaccattgtagacataacttttagcatgcctacatgtacttgaagtctctttattgggctttcatacttatcctagttatctatttttccactgaatggctatatcataatttattaaagcagtttcctattttgagtgtttaggtttcttccaattgtttgctgttataaataatgtaatgaatcattttggtagggaaaaaagtatcatatgggccacttgcttgtgtttctttgatagcttatgaggttgtatcttattctagaagccaaggttactcttaaaaggtgccctttagcgctgtcattgcctccacccttgtattagtctgtacttgcattgctataaagaaatacctgacactgggtaatttggaagaaaagaggtttggctttttaccaaaccaaacagtaaaaacagtaaccattggctcatggttctgcatgccgtataggaagcatctgcttttggggaggcctgagggagcttttactcatggcagaaggcaaagtgggagcaggcactttgcatggtgaaagcaggagcagaagagtgagggggggcggtgctatacactttttttttttttttttttttttactgtttcataatttatttatttttccatggaaattatttaacattttattttctgacaaagctcctgtttattttattttttattttttattatactttaagttttagggtacatgtgcacaacgtgcaggttagttacatatgtatacacgtgccatgttggtgtgctgcacccattaactcgtcatttaactttaggtatatctcctaatgctatccctcccccctcccccggcaattgaacaatgagaacatatggaaacaggaaggggaacatcacacactggggcctgttatatactttcaaatgaccagatttcatcagaactcactcggtatcaggaggacagcaccaagggggatggtactaaaccattcatgggaagtcacactcatcaaccaatcacctcccaccaggccccacctccaacactggggattacatttcagtatgagatttgggtggggacactaatccaaactatatcagccatatataaaaataatgatttttctggattctcctaggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacagtaagtaattcatgctgctccagcctcatctgagcaataaggggctaccgccatgcagacttagctaacatcactgcaggactattggaaattatgaaagaaagttagttgtgagagaaggctaattagtgccccccacctaatcattttaataacttgcaatatataacatatatttggatttgcaataattcaggcaggtctgtgctaaaatttaccttcccttggtgtgcagttgtttatttagtaaattagtaacaagaagtttttctagggcttgttgaaccatttatggggtagttttgaagaattatcatatatctacatgtacacagatgtcagttaattccagatgggtcttacctaaccataaaaaccaaataactttgcttgaaaccccttgaaaacaggtaattttaaaagttaaaagatttatctaggagtaataaaatcactttttttttccaaagtattttgcatttcaggcttctcaatttcagattggtcatttaaaattaatgggaatttcttgggtttctttgtagtattgaaagtctattcattactaaactaagcagagagttttattttgattcactgaaattagaactgtgtgcatttggaacccttggaaaggtaaactatttcttggccacacacaactaccactgaagtcaggatcatgtggtctatggccttaccaccctgaacacactggatctcattgatcctggaagctaagcagggtcaggcctggatgggagattatgtggtcccttgccacctcccagagtctgaggctgtctttgcagctggttctccacttcctcaggaacaggtgtggaagctggctcagtgtttctttggccactcttttattgcatcagtgacttatgaaagtctgaattgttttgtcagtgtttaggaattcttcatatataatgtttaattctgtgaaatttccaaggtgcagaatcatgctaacagtaacacaacgaacaatcacattcctcccatccagaattaacaactgttaacattttgtcatatttgctttcagcatttgttgttgacttatgtaataacccactacaggtgtatcagtatctcctgcaactgttatccctatctatttctattcccctctcccaagagacaaccaaaattatgagtttgttaagtatattttaatttaatgttgtatgtatatattttttgagacaaggtcttgctctgttgcccaggctggtgagcagtggtgccattatggcttctgcagccttggcttcctgggcccaagcaatcctcccacctcagcctcctgagtagctgggaccacaggcacacgccaccacacctgactttttttaaaaatttttttgtagagatgggatctccctatgttgcccaggctggtctggaactcctgggctcaagcaatcctcccgccttcgcctcccaaagtgctggaattacaggcatgagccactgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcatagacaggtgtgagagtttttctaggaacaagtccggtggtggaactcatgggctatttccctctaaagtggttagtcagtgtgtactatgttcaggagtgtatgacagtgccattttccttatacccatctctatgtctatatcctttccctatatcactcgatagtgtcacacctttttactttgcgtatctcaaaagcaaaatatggtgcctcattgttaatttcaattttgatttccttgatagctagcaaaggtgagcatctttttatgttaattgtcctcttttttgatatacttattgatatactggatgtcctcttttttgatatacttattgatatcctttgctcatttggaataggttgtctttcttactgatttgtaaaaattatttgtgtaatctaaatactttgttatgtgtattgcaaatatgttctcctaatccctttattgtaaccttgtttgtggtggcttttaacccacagacacttgacattttgatgcagctggacctgtcagtatttgcctgtgtgatttatactttttgcattttggaattattccctatcccaaggtcataaacatattctctgtgtttttcctagtagttctagtgttgttttgtgtatttaggtctttaagatataaaaatgttattttggggtgcagtatattttaatatttttattttaatcttatttattcacatatggcatgtcagtggtcccaatgccacgtattgagtagtccccatggtgagttgtgatgatttctgtatcatatgccaggttctcatattcattttgcatctatttctggatgttctgttcccttccattgatctgtttgttcctgtaccatttccagcatattaactataaacttgtgaaatgtcagtaactatgggatgaatcactatttcctatttcaaaattatctgaggtgctcactcacctaaactacataagtttcatcctcattagaatgatacactctcaaaatcacactatcattatcatatttataggattaaacaaaaactagttaatagtcactgggagtcgacttgccttggatgattgtatgaagtttgatggagggtcaatgctggtggtggtagtagggatgtgagattggcagggtaggagttgatccctatagggtcaggaaatccgaggaaggaggatgtgaatgagaacatctcatttttacctgaaaatatttgttaatatgctgtgttgtcattgatcatgtatgttcataagtaaaattaatacttccagttataaagtttgtgttggtttccagcctagcaattacatctggtccaggggtaagaagtggagtgaattagatttggcgtatcaccccaatcatatgttaaaaataatatatgtgtgttatgttttcctgttggaaaacatttacatggggagtatttgacccttacaatgactttttgaggaaagtagagtaagaatgattatcacagttaacagatgaggaacctgaggcacagaggagggtaagtgacttgcccaaaattatggaactagtacggcatggggattaggattctaatccacattttagttctatttttccccccaccatgctacaaatgtcttgcacttgtctctttggatgggcgacccactgcttcaaagcaactatgcttctagaggttctttaagtagtgatatcccgtttctaaattgtttaaggtctgattagtgtttcctaaagcattttagaatctattgtagagtcacccagagaacctgctaaaatgtagattgctgggtccagacccgctgaatttaaatcaaaggtttattgagctatccctaagaatgactcctttcaggcataaaatggtaagttggtagatgcaaatttatgatttttagttggcacaaaaattatattcattatttttctaacaagcttctaaaagacactgctgctttttgtgacaggcttagaagaccactggtttatgaagttgaattttttgagccacaactatacaaatattaactatgtgatcatagtaatctgaaaatgttggtatttctattactccttcaatctcctgtgggaagaaaggctattgtatatttttataaaaatatacaaaagacttggtactggatgtaaagaaagttaagacatactgttgattaattgtgatttttggatactgtaccgtctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaatttgtttataagcagtaactttcatgtggaaaaacaatggtgtatggaatgaaacagcctatgtctactcttcgcctactgggacgagtacaaaccccttaaacttttgaagtctcagttttctcatctctaaaatgtggatcataaaaaatctcagtactgtgtggttatacaagtcaagagagtgtctgcatgtggaagcacattgtaaatagcctcataaatgtaaggtacagttactattaaggacaagagctcgaatccattcttttcctggatcaaataggcttagcctttattggatcacgaacttcccttctagcctgtgccctttagagtttgagtgagaatgtagtgatgctgcggtgcctgtcatcttcacatgtggaaaacctcaaggcatctctttctcatcctgcccgtgtccctgaatggaatgtgattccacttttccccaaatccctataatactttgtctactaaaagttattagcacattttctcatgtatacactgacctgcctgctgctccataaatttagggcaaggacagaccacatgacactaagactatggactacagagccagactgccaggagttgaatcttgtttcttctacttaacagtagtgtcaccatggctaagtcacttaatctctccagacctcagcacttacagaaagattgctatgaagaggaagtgagttaatatatacaagagactagatcaatgcctgacatattgtaagcactatataaatgccagccctcagaagctttccattcttcccagcatcaagaatagtaagtacaggtttgtggaataacagaatttctaaggccttcatttagtgtcaagatgacagatagatgatatgtgttgccatttctctgtctgtgccactctttcaagtctgtgtggagtccagtagccactaccaattgattggggtaccatatgagaaaacatttgtttgcctttcatgagctgacatgaactctatctcaaaagcataatgatctaggccatggtagtatatcttaagtgaatcttttttctttttaatttctagttcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaaggttggttgaatggacaagtatttacataggattaccgtgcagccctataggcagctggtttatcaggacaggcctgtgagatgaaagcctatgaaaagtcggtggttgaatggacaggcatttacagagaggtccttaatatcaaaatgcctctgagaaggatccctgttggtccgttttctattattgaaccttagaatagatcagtctatcagcataccccatccagcaatctaagaagaaagctctgaggaatatgaattttaattcctaggagaaagaagaatgtgggagctgcttatagaaggcaagctatgcaagagctccagtaggaggctccaagaaccatgctccattcttcctcaaacactcctttttttagcttggatgacattgtgcaattctgagtcttcttctactttactgatgcaggttattccatgtccaccactaaccccaaccccaggaaaagtatgtgatttgagctagatagagatcctctctggatgccatactgtgcccaccatttgtgattgataaagtctgttgagtgtaattaagtgaacaagggtcccatgtgggtggagctgcagcaggaggattgacttcaagtctgtgcagaggcacctcccggctctctgtgttgtgtacaatgtgtgccagagaatgtagatggaggcacgttagaggcaagttttgaaaatttatgatttggattatagtctgtttttaaagaaaatactataactaaatctgaaaacttcttggttctcttggaggattacctagaccttaagaaacaaaatcaaacaagtcgctttaacactgctgattctttggaacatttttgaaatgttcaaggaatgaagagtctgccaaatatagaaaatcatggttttcaggtcacactcttagtgaatgccccatttttgtaattacttgtgttttggcgaaatgtaacttcctaaattcaagctatacataaaataccaagagaaaacttttaaaacaagacaaaaccaaaagtttctcaccattctagacatctctgtatctgtacatatatagagatagaagaaaagataaatgagaagagagggatacttttaagaggacgagatcatgttctatgtgctattgctaataaaaatatatcgagtttaattttatttaaataaggaaaagaaatagatttgaccatagtctttaatagtttattttgacctgagccctaaatttaatttttcctctgtcttttcctgtcttcctccctccctctctctcttcttctattgggtatcattaggttttcttcattaactcgttaaaacaagacaaacaaaacaaaatatctgatagactgtaagctcttagcatcattgaactttaaagcatttctaggtggggaaattgaggtttagggaggtttagtcactctctcaaagttatacctgtagtaattctccctattattcaacattgttcatttgcttgggattctacttggaaataaaagttgaacaaatgacaactaatgattagcatattgctaattgtaacagcacttttgcatgtttttttttttttttaatcttattacaaccctgtgagtcagactcatctccactgagtttggaatataaatgagtagcccgaggtcatatagtggttaggtggcaggattagggctgctgttaagttcccattacactgtgtcttctcccacatacggtgtgggtctgtttctctatgtaaactaaactacctgcttcacctctgtcttcctgcacagcaccagcggacctcggaggggggaagatgctgcttatagccatccttggctctgctggaatgacctgcctgactgtgctgttggcctttctgatcatattgcaattgaagagagcaaatgtgcaaaggagaatggcccaagccttccaaaacgtggtagtgtctcatcttcctactagctaataagggcaagtccaagtacaggcagaaccttcactttaaagatatggaccaggaaatttacttataaagtaaatatttcccttaggcaagcctcatcttctctttggctttcattatgaaatgggagataaaaagtatgactttataatttcttatccaaaccagaacaattttgagagtgaaaagggtgctcttagtaaattatgcaggaaactaggtctgcccctgcctgctgaaatgagacatatggtcatcctagtagtaagtccccagagatgatatcttgcaacagaataaattgaacatttttggtaaggaaggacagagggtaaccagacctcagtgagataggtaatgacgtaatatattagacaagttttcctcacatttgcctatttccagttcccatttctttctagtaagtccctcaatcttatcacccctcgtatgtgtaagaattatatatacctgtgtgtgtcttccattcctgtgtaccctcagtctgaagtcagagttcctggcacttggtactgcctcattttttttttcatctaggaattctaaccagtagcaaaggcctataaaaatcacactttaccaagaggcatcttatttgagttcttttggtatactaaagcctgaaaatgtatctagtttgtgggttcaggccctgtaaaattaatttgaaccagactttatcaattctgtatataatgcattgagtgcaatgattcaaatgaggtgtaccccatgtgcatgagtccccgagtttcccttccacggaggacaagaggaacttcactatctgactccatgccagagctggctcaactcaggctgtcgctggagaagaagggccagcaagggggttgggagtgctggagcctgtcaaaataccggtgctttttcatggtagcaccagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcaccctgtggctgccccacataggctctccaagttagtttccaaaccagaactgaacgcttgctcatttcacaacactgtagggaactcacgtacaactaacgcaaggatggcaaacacatggaatatgtactgttactccttcctccgtcaccctttacagacattgctaatcaacaggcttttctggggaggcccagaattgtgcccgtgcagccctgtgggcagctggtttatcagggcagtcctgtgtgatgaaaacctatttccctttccagtctagaattaaatacagtatttcttttttcatctggtgtggatgccaaccagaagacattatgccccttagaattatgaaaaatcctgacacaaaatgatgaaataattatttttccagagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaaggtcagtggttgaccagatagagtcagcattgcgtgagggtgtggagaaaacttgatttcctgctcattctttcctctatggtcttacaaaaaattggcatggtatcagacatagctgttatttgcaactgaaggttatgcttcctttgaagttgagcctgtgatagtcaggatatcaatacaaaggcaggagccatttaaacatcactgtcttgattcattgggatgagatactatagattcttggtcatatatggctaacttttgcggagcatcattgtttctcttaaagcagtgcttctccaaattgagtgtgcatcagaatcacctggaaggcttgtttaaaaacaggctgttgggccctaccccacaatttctgactcagtctagggcagggccagagaatctgcatttttcattagttttccagtgatgctatcttgtgggtttggggaccacattttgcaaaccacagtcttcataggttaactgtatataagttcctggggacactgttagaaatgcattcacttgggtttcttctactccttgactacatctgagtttcttgggtagcatatgaaaatctgtgttcttaagtggctttctcaatggttcctctgtacactcaggtttgcagagaaaaccactgacttaaggtcataagaactaaatcttttccagctttgttcatctcaagactgtttggtacctacccatctaataatatttgataatatcttcagagaaagcagcatgactagttcactggcaaattagctagctgtcttctcttctgcatgaaagagcagtttgtataagacttgactgtgaggctgcactattgattttacaaaatacaggcttggaatgtggtgcattaaagcagagaatatgatgaactattatcattgtgcagctccatcttaagagctctctaaggatgctggcagatttttctttttttttggaccacactattgaatctatgaattacctctaaatcttattaaatcatctctgctttctgcattgttaggaagactaacaaaacaaaatattatctatgattagaaacagcaatatgtttctttaaaaacaatacaaactacttgcaaaacagccacaaatcccttttctgttttgctactttagtcacagggagttttggggagcagtgaggatagtgagaggagaggggtgtagaatcttatgaaggcagtttttattgggatctattgtgagcctgattttctaccttgtgcccatgtgaagagggaaaatagcttaataaggcaccagggcagataaatcctgcaggcaaagcagtgcatccaaagaagggcagttactgaagtggacaacctcactataaagaactttaaaaaaatattcccaagatattgaccctccatgaggcttctgtagtatgaacagagcacttgacttatgagtaccattagtccctcatgagatgattgtcacagtttctaagcatgagcagccatgtttatggccaccagcacctcactcctttccttgccacccaatgtgtgtttttttttttaaagcagccatagctcattgtccctgactcaagactgatcagtttatgcaccaaccaatagccttctcttcattctggtgcctgctgtgttctccctctggttaaagtgctagtggagagacaaggcaaaaagaatagaagcagatgcaactcagtttcctgattcccatgcaacttccataagataccatttggatttgatttgtttagctcaatcaaccagattgagactggtttgtaaaaaataagttacagttagtgaacaaagaggcatgcattattggtgatgtttcatggaaactttggttctattcctcagttgtctctggatggtagatttagctggaagagctaaaatctaaaagatgatacagctccacctctaccaagtcatttacctgaggatctgggagcttcaacaagaaaactttagagtagtggttctcatccaggggtgattttgcccatgggggcatttggcaatatctggatacatttttgattggctattggcatctagttagtagaggccaggatggctgcaaaacatcttaccatgcacaggacaggcccctgcaaaggaattatcagcccagtgtcaatagtgccaaggccgagaaactctactttagagtaatctctttggttgtatacagttgatggtgactgagggtagctgaaggttcttagggggcaggacgggacagctgattctgaaaaggtgtaacaaagaagaatcacaacccttgactttcttcccagaatatgcctccaaagatgatcacagggactttgcaggagaactggaagttctttgtaaacttggacaccatccaaacatcatcaatctcttaggagcatgtgaacatcgaggtaagatgctcttttcctgtctttcctgccagagtttttataaaacagacaaattccatatggatataaggaaagataatgatcttaagaatgttgcctattttttttaaagttgcatcttctatctgaatgtctgtctagtcccatttatagactgtgctgtggtttgccttgtttttggagggaggtgccgaggctggactatttagcctctgatgtggttcagccattactgcccaaaggtattcatggctcctacctgccccatccttggccatgcagaggttttctccactaccactactattatagtaggggagcccccaccatcagcttcttaattgcctacctttacatttttcctggaaacccagggaattggtattctgaatgttaaaagccatgaatgccagcaatctagtgtaatatgaaaactaaggatggttggattttaaaaataattataagaagctttcatgcgatagtgctttgtttttatccagaatgctttcatgtacaattacaatggagctttacaactatcctgtgttgcacatgcatttaaagttaaatttatgttattaattcaaatgtttattgagtactttctactgtaatgcatgtaattactggtgagtgagtaggtaacaacaaaaatcctctatgggtttacctctgcatgcagcatggccttgtagttctgaatctctgcttaaacttcacttctcgtggaaaagtttgctcccacaaaaagctccatgcagtaattatttacaaacttgacagcctcttgttgactttgcagcacaaacaccaacaatagaaaagagactacttccatttcctcaatttattaaactaaaaatactggtgcttcaaacaatttatcattctatgatccaataagggtgtaattctgaaagccagatcatgtcccttaggttaaataatgaagtaatgacatttattttttgagctacttcctgaaaacagtagtgagcatggcacaggagtgtaaatgaaagttacacacacacacacataccacacacacacacacaccctgctgtccttgctgatagcactcccacaaacatggtgagtgttcttaaaacccgcctgactttctgtacaaaccctacaaatgacacagtacaaaagggcaaggattctctggatgcccagggaaagtggtgttatgacaggaagccaagtggccgtggtggacagactaaaccagttttctggaaaaaggctaaaactacaaagaagactgtgctgaggctttagtgttgaccccactgcagatctaagagaatgctggctcttaagggatccaggcactttgcactaggaggagataagaagagaaatggccagttgatccagttctaagtttcagcttttgttttattctgaggacaataaaatcttgaggttacgtttacttcatctggttgcagttggtctttagggagagaataaaccatgatattaatgcagcttccttcttgggaaaaaaaaccacaacaacaaaaatatatcccttaaaattttgcttcgtcatcacattagcacatagctggctcttaaaattttaagataggccgggcgtggtggctcacgcctataatcccagcactttgggaggccgaggcaggcagatcacaaggtcaagatgtcgagaccatcctggccaaccaacatggtgaaaccctgtctctactaaaaatacaaaaaattaactgggcctagtggcgcatgcctgtagtcccagctactcgggatgctgaggcaggagaatcgcttgaacctgggaggcggaggttgcagtgagccgagatcgcaccactgcacttcagcccaggcgacagagagagactcagtttaaaaaaaaatatatatatatatgaatatatatgtatgaatatatgtatgtgtatatatatatatgaatatatgtatatatatgaatatatgtgtatatatatgaatatatgtgcatatatatgtatttaaggtaaattacctttatctttattaataaatacatatttaaattattttaaaataattcagtaaagatgtgagaaagcacatgtataccataatttaggtctaactttcattatagtgcaacaggtttcaatattacttttcttttttgctagaatttcaatttcttagaagatctttcaagcttttttttttttttttttttttgagatagatagatagggtctcactctgttgcccagtctggagtgcagtagcacgatgtcagcccactgcaacctccccatccctgggctcaagcagtcttcccacttcagcctaagtactcccaagtagctgggactacagggatgcaccaccatgcttggctaatttttattttatttttattttttgtagagattaggtctcagtatactgcccaagctggtctcaaactcctgggctcaagcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcatgctttgactcactctactgttattactgagtgggtaaaagcatttcaggaagccctctgtgtgagtgcaggtttggtaggaatggagagggggtgggaaggagcaaaaccaagcgttgcagcctggccccttttgagtattgcaggagggtgtcacccgtcttcctcctgtcccccagtgctccctgggtggtgttgctagatgtgttttttagacaaaatggagtttataggcaatttccacagcacatctcttaaatgtcatagctgttcagggccactgatgagtcgatgctctcttccttccctccaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacaggtttgtccggaggacttcgctttggatatctttcctgtggagttccctctaaagtcagtttcaatatgtttgtagggtctgtcaacctctcttctttaactccttcttaaaatctccctcattttaatctctctgtgaatagtccatctatttaaagaaaaattagtactgacaatatgtttatctagcaattttcataattatgaaaattgtataattttcttctatctaatttcatatatgcaaattttataattttcctaatacgtagcgaggtaccttaagctctcttagcctggtttgcctctaaataatgtgtaataacagagacacactacattacagctggaggatttaacaacctgtgttttttatttgttcgttttctgaaattcttctgccaagatgtggtgtgtcatttggcagaatccattaccagggaattttggaggggaactttaagggaactggattgtgactgtttaaaatccttttttatactattgttttctttcctgttccccaaagttttcagccctggggctttcattaggctgaaaatacataatgttttcaaaaatttcagtttatccacagggatctggctgccagaaacattttagttggtgaaaactatgtggcaaaaatagcagattttggattgtcccgaggtcaagaggtgtatgtgaaaaagacaatggtaagtgccagacacagacactgatcgcatcctttccgaggtactcccctgtctcctgatgttgcttctgagactgtcagtgctctgtggtgactgaagcatctgactgtatgtcccagtagatactgtgtgccctgggaaacattctttctaaatgttggttcctaacatgattgcagcatctgcattaattaataatgaagaaggcactgtcatgtgtgaccaagtgattgaatgttcaaacctagtggtttggggtcttggttctatccagtccagaccccaaggcatctcactcaggaacctctgaggagcttgcacaatcccctttcatgcacagctgacacagcaaggaaaaaaattaacatattttccaaaagtcaagaagacaaactaaatggtttctaaatcaccaggaggctctacagagaaattcataacttctacaggctcatctaagatttctctcttcactgaaacctcaatggtcactattcaaacccaaataaaatccactctcccaaacagtaatattttatctttaagtacaagattgcaggagaacctaaccatacagtcttagaggaagagagatactcattctgcttttggtgcccagtctagaatcacatagtcctagaagtaccgcatccctgcatgttacagctgtgtggatgaaatgtcaccatcctctcttttccttgggtgggcagaatgcaggggccttagggatgacaagccctgcagcctttccatgtgtctggcagatctactctggtggatggctctcccttttttaggtctgatgaacattacttggtcccagctttcctgggatggctccagttgtcataagatatagacaatctttttgcttttgtgggcacaccaaattgtctcttagcaaggctcaggttccggcatttattctcaattccaggcttctttttttcccatcatacttattttagttactgagaagataaagtaaaacaatactcaagaacattttgaaaggaaatcacccataattcaccaccttggcatatatatttttttcattttggcttattgcctttcacagcatacatccttttacatagctacaaccacagtgaacgtaatcattttggatctttccactctcctttctgatgagggtgtgaagctgggtccctttggctcttcgagggccctgcatgcttatcaacatcaacactttcagaagccatgtgtgcctccctgagggctggcttccaggtgatgcttttctccctaaccttttcaggcacactcaaagcagatgcttctctggagcaggggtgggcttgttttcttaaagaagcagaatccatcactcacctacctactccagccttcccaactcctccctcaccacctggtgtcctcaaatctccttcctgaaatccttttccctgctttcctccagcacttgggggatgtgggtaccctgggtgagaaggtggagggataacacaggataactccacaatctacccattctatttggatgctctcctcagcctcccaagactagcactggtttgcttggcatttcataaagggcagtgatttctgcaatattggggttatttacagggggagagcacctatcaggtctcaactctatcttacaatagactaaacagggtaaaggtgttctttagcaccttggggctggggaggaaagggccaggtttgagggaagggggaagaaagaaggattggagaggagcaagttccctgcaagaaaggtgcagtgtggcaagacactcctagagaacacagtggctaccttctctggcagccaattttaaaatcagattttcaattctcattgtacttcaaagcatctgcattttttaaagatccccagatgattgagtcctatcctgtggatattctgattcaattggtctagggtgagaaccctgcattagggttttttttttttttttaagttacccagggtgattttaatactggaagtattactgcaaactactatactaagcaatttggggtttcactatcatagattaatatatccatcccgtcatcatggatttgttagtacaatgtttcatgcttgtgctagattttggggtaacataagtcagacacagtctccaccttcaaagagctcgtagacatatgactcaggattgtaacagttgataaatgcaaagagcaaggaaagcataggtgctacgggaacacaaagaaggtgcactgaaccaagctgaaaggaagttaaggagggcttcctggaggaggtcaaatcctgagtttcatagtaaatgttagataggcagtgaggatgtgagaataagttggatgagctggaggacacagtacatacagaacccctagaggaaaaggaaagcatgaaacctttaggagatgtttaagtaattcactatggctgggggtgtattgcagagaggaagggagagttaaacttcagggttggaagaggaagcaaggataaagtcctgaagggccttgaattccagctaaggatttgggatcttggaaccatagggacattaaagaattttaaggaatagaactacatggtcaaatttgccatttagcatgatcatcctgactacagggtagagaacagacaattagggagggagatcagttaggcagagagaccaggagagattgttgtcatcaggtgtggtatgatggtggactgaactgaggtgatacagtagacagaagtgacgagatccaaaagaagtcaaataaaaaaataaatgaaaaagtgcacaaggaacttaacaattaggaggtgtgaggttggaagccagcaggctgggagtgaatgagggcaaaaagaaaacagataacactgtagagagagttagaataacagctgggagatggggtggtgtggacagagagtgaagggaggaggtgtggatgtggaggagaacaataaataggtagatgtgagaaaaaatacttccatacttgaacctaaaagtacaaaattaccatttagaatttatgtttagaaatgtatgcatcagaatattgccactccacaaagaactgggagacaattgcacattcaggaatcgtccttgggatctagggcagggctggtctcataaatgcatgacctaggagaacacctgctctggagagctgagaaaggtccctcaagtgctcctggttttgttccacccactggctaatctaggtggagatgccactgtgaaagtctggacaaatctctgggagggagggatcaacctctcaatgaccaaccctatgattcttgaatgagtagataggaagggagccccaaatcatagagactttgaggaaactaggaataaaactttaaagtcaagctttacaatgtccaggcacatctcattttgcctagcctgggatcagtaaaacaagatatggggagagcctggatgcagtcaggaccaggcatcgaaaggatcagtatgtctccaaacccaacataaactacactagctacaaatcagctcaatctctactgttacacatgcacactgttccccttgtccagagatgctctttcctctcccatctacctaatgacacctaaacatcttatagaaccatgctgggatatcccgtcctctggacaatctccctccatcatctccaggcgtagttgttctcttcaccctaccccagtttcccttttccaccctgcttcccttttccatattattaatacagttaaattctcactcagtgtctatgcctgtctcccctttcaaacctcggagtgcctctgagggctataaggtgaataaggaatgaccgactaccatgcgtgcacactcacacttccattcatataacgctgctggaccccgaaagataaataggacttatactatttgcatgttttgaaatttgaaaacacatgtagctgggacatacacaaagcaatgatttctgagtctacccagcaatcatttgtggagccacagctcaggcaggctgagagcctcttaaagaccctgtcccagttaagtgaaatctcactttgttctctccagggaaggctcccagtgcgctggatggccatcgagtcactgaattacagtgtgtacacaaccaacagtgatgtgtgagtaaacttcttattgccaagggatttttttttccctcccagaaacatatatatttgacagagattttaaaaagatacaggaatgtcctgtacctctcgggaacaaaggtaactaaaaagctcaggaaataaattagcagaataaagccacagagtagacagtttccagaggagtgcagaatcacttgcggcaggttttgggtttccctctgcatactgaagttgtgtattccgcatgtgcttcaagttgcgaattctcggactcaacaggaagaagggacataccggccttcctgtggctcctctcccagacctagatcagaggaagcaacccagaatagctgctggggacaaaataaggccagacagttgggggggggtcgtctctgcttgcagcctgcagtgatgcatcagaggctggtggtgaaaggaaggattggcttgagatttaggtcatcttgcctcgtaccccatttccaggaggaaaaaccaaggccccgagggtggtggtgacttgtccaaggggttttgctgatgtctgggcatgaggagggggtgggcaattgctgtgtcctcactgtatgcaaggtgctttttatgtttctctgcataattttgaggcagggattattgtccccacttttggaagaatacactaagaggtcccaagaggttcagcaactgtttccaggtcacataagtattgggtggcagagattggatttaactcagatctgtcaagctccacaacaaatttcatctgttttggacagtaccaccttgtagtctctagttaaagtgatttgggggctctggcaaagtgaacactgtttctttgttgtaacccttccattgagctaagaggagagaaacctacactgtgtgcaagggcctatcctaggatgtagacatttaacatctccttttctcagaaagggtgggtctccctggcttttggggcaggaaaatgagtggtgactctgtttgctgattgttggtttcacacttgtccctcctgcagatggtcctatggtgtgttactatgggagattgttagcttaggtgagtatctatgtttatctaccaggtgagactctaggcaaagtgagtggaagcctctagcactcccttgctgcataattccacaggatgccgtttgtatgtggttctaccagatgtgacttggaaatagaaacatagtgtatttattcccatatttttctttttaaaagccttatacctaacgtcatatttaacactaatgacctggaggccatgaactttattatatattaattggctccgcttgtacaagttgccaggttaacttctaaaactcttagattatgcagctattaaaagtcacatttttgaaagccatttaatagcatgtgaaaatatgtaataatttcatgtataccctgatcctagttttatcaatattgcatattttaaaaaactggaaggcactacacagaaaggtaataacatttattcttcatgctttttaatgtggtacatatacaccatggaatactatgcagccacaaaaaagagaggaatgagttcgtgtcctttgcaggaccatggatgaagctagaaaccatcatcctcagtaaactaacacaggaatagaaaaccaaacaccacatgttgtcactcataagtgggggttgaacaatgggaacacatggacacagggaggataacatcacacactagggcctgtcagagggtagggaacaaggggagggagagcattaggacaaatacctaatgtatgtggggcttaaaacctagatgatgggtcgataggtgcagcaaaccacccaccatggcacatgtatctcagaacttaaaatttaaaaaactgttctacaataaaccaacatgcatggcttttgtaattaaaaaactggccataactatcattgataaaatatgagttataaaactatggacttccaatcagaaaaaaaggttaatcttattggtataataaaggttaatcttattggtataatagatgtgctttgtgtggggagacttagaacaggcactaaggaagcctgtggtggttccttcccctgaagcaatgatcatgctttggcatagtctatagtgtaagcccagctttgatgtgcagtgagtttgccaagggaggcatgcaggatgctcaccctctcttgccataccatgtcttcctcctggccccttatatttagaaaccctggacaggaagcattgcttttcatgccagagaggacttagagtggcactgtttgtcttccaggaggcacaccctactgcgggatgacttgtgcagaactctacgagaagctgccccagggctacagactggagaagcccctgaactgtgatgatgaggtgtaagtcaggcctcatcctggggctattttgtcttaccttccccctgtgtgtttctggggccagctgactctagcaaagtcagccggtatacactatacacaaacacctacacacagagatcccaaataggaacccctccccttttattcacctaatactgttatataatacacaagaagtattagctttacaggcatagaaattcaggaggaatttaatgactcttgggaaggttgaaatgaggaagggcaacaaatgcagaaaagctctgaaacaaattctttaaacatacaacactatccttggggataaagatttcaaagctgttcattaagattaagaaggatacattttcgggctggcaagatggctgaataggaacagctccagtgtgcaactcccagtgagatcaacgcagaaggcaagtgatttctgcatttccaactgaggtacccggctcatctcatagggactggttagacagtgggtacagcccatggagggtgagctgaagcctcacctgggaagcgcaaggggttggggaactcccttcctagcgaaggagggacggtgccatgacgaatggtgcattccagcccagatactaagcttttcccacagtctttgcaacctgcagaccaggagattccctctggtgcctatgccaacagggccatgggttgcaagcaccaaactgggtggccatttcggcagacaccaagctagctgcaggagtttcttttcataccccagtggcacctggaacaccagcaagtaagaactattcactcccctggaaagggggctgaagccagggagccaagtggtctagctcagtggagcccatcaagctaagatccactggcttgaaattctcgctgcaagcacagcagtatgaagttgacctgggggaggacgctccagcttggtgaggggagaggcatctgccattactgaggcttgagtaggcggttttcccctcacaatgtaaaaaaagtcacagggaagttcgaactgggtggagcccaccgccgctcctcaaagccactatagccagactgcctctctagattctttctatctgggcagggcatctctgaaagaaaggcaacagccacagccaggggcttatagataaaactcccatctccatgggacaaagcacctagtggtaagggtggctgttggtgtagcttcagcagacttaaacgttcctgcctgccagctctgaagagagcagtggatctcccagcacagcacttgagctctgctaagggacagactgcctcctcatgtgggtccctgacccgacccctgtgctccctgactgggagacatctcccagtaggggtcgacaggacatcttatacaggacagctctggctggcatctggcaggtgcccctcggggatgaacccaggcagcaatctttgctgttctgcagcctctgctagtgatatccaggcagacagggtctggagtggacctccagccaactccagcagaccttcagcacaggggcctgactattagaaggaaaagtaacaaacagaaaggaatagtatcaacatcaacaaaaaggacctccacaccaaaacctcatctgaaggtagataaatccacgaagatggagagaaaccagtgcaaaaccgctgaaaattccaaaaaccagaatgcctctcctcctccaaaggatcacaactccttgccagcaagggaacaaaactggacgaatgagtttgacaaactgacagaagtaggcttcagaaggtgggtaataacaaactccttcaagctaaacgagcatgttctaacccaatgcaaggaagctaagaacgttgaaaaaaggttagatgaattgcaactagaataaccagtttagagaagaacgtaaatgacctgatggagctaaaaatcacagcacgaatacttctagaagcatacacaagtatcaatagctgaatggatcaagtggaagaaaggatatcagatactgaagatacacttaaagcatgaagacaagattagagaaaaaataatgaaaaggaatgaacaaagcctccaagaaatacgagactacgtgaaaagaccaaacctgaaagtgatggggagaatggaaccaagttggaaaacactcttcaggatatcacccaggagaacttccccaacctagcaagacaggccaacattcaaattcacaaaatacagagaccaccccaaagatactccttgagaagagcaaccccaagacacataaatcgttagattcaccaaggttgaaatgaaagaaaaaatgttaagggcagccagagagaaaggtcaggttacccacaaagggaagccaaacagactaacagtagacctctctgtagaaaccctacgagccagaagagagtgggggccagtattcaacattcttaagagaagaattttcaacccagaatttcgtatccaaccaaactaagctacataactgaaggagaaataaatcctttacagacaagcaagtgctgacatattttgtcaccaccaggcataccttacaagagctcctgaaggaagcactcaacatggaaaggaaaacccggtaccagccactgcaagaacataccaaaatctaaagaccatcgacactacaaagaaactgcatcaactaatgggaaaaataaccagctagtgcagcataatgacaggatcaaattcacacattataatattgagacccatctaacgtgcaaagatacacataggctcaaaataaagggacagaggcatatttaccaagcaaatggaaagcaataaaaaaaagcaggggttgcaatcctagtctctgataaaacagactaaaccaacaaagatcaaaagagacaaagaaggacattacataatggtaaagggatcaatgcaccaagaacagctaactaactatcttaaatatatatgcacccaatgcaggagcacccagattcttaaagcaagttcttagagacctgcaaagagacttaaagtctcccactattattgtgaggagtcttaacaccccactatcaatattagacggatcaatgagacagaagattaacaaggatattcaggacttgaattcagctctggaccaagtagacctaatagacatctacagaactctccaccccaaatcaacagaatatacattcttctcagcacctcatcacacttaaagctgaccacataactggaagtaaaacattcctaagcaaatgcgaaaaaacggaaatcataacagtttcttagaccacagtgcaatcaaattagaactcaggattaagaaactcactgaaaaccacacaactacatggaaactgaacaacctgctcctgaatgactactgggtaaataacgaaatgaaggcagaaataaagatgttctctgaaaccagtgagaacaaagacacaacataccagaatctctgggacacatttaaagcagtgtgtagagggaaatttatagctctaaatgcccacaggagaaagcaggaaagatctaaaattgacaccctaacatcacaattaaaagaactagagaagcaacagcaaacaaatgcaaaaactagcagaaggcaagaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctacgcaaataaactagaacatctagaagaaatggataaattcatggacacatacatcctcctatgtttaaaccaggaagaagtcgaatcccagtcgaagaccagtaacaagttctgaaattgaggcagaattaatagcttacctaccaaaaaaagtccaggaccagacggatccacagctgaattctaccacaggtacaaagaggagctggtaccattccttctgcaactattccaaacaatagaaaaagagggatctttcctaactcattttatgaggtcagcatcatcctgttacccaaacctggcagagacacaacaaaaaagaaaacttcaggccaatatccctgatgaacattgatgcgaaaattctcaataaaatactgggaaacagaatccagcagcacatcaaaaagcttatccaccatgatcaagtctgcttcatccttgggatgcaaggctggttcaacatatgcaaatcaataaacataatccatcatctaaacagaaccaatgaaaaaaaccacatgtatctcaatagatggagaaaagccttcaaggaaattcaacaccccctcaggctaaacacgctcagtaaactaggtattgatggaacgtatctcaaaatattaagagctgtttatgacaaacccacagccagtatcacactgaatggacaaaagctggaagcattccctttgaaaaccggcataagacaaggatgccctctctcgcccctcctgttcaacataggattgaaagttctggccagggcagtcaggcaagagaaagaaagaaagggcattcaaataggaagagaggaagtcaaactgtctctgtctgcagatgacatgattgtatttctagaaaaccccattgtctcagcccaaaatctctttaagctgataagcaacttcagcaaagtctcaggatacaaaatcagtgtgcaaaaatcacaagcattcctatacaccaatagcagacaaacagagagccaaaccatgagtgaactctcattcacaactgctacaaagagaataaaatatctaggaatccaacttacaagggatgtgaaggacctcttcaaggagaactacaaaccactgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatactacaaggctacaataaccaaaacaggatggtactggtactaaaacagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccccttccttacaccttataaaaaattaactcgagatggattaaagacaaacgtaaaatctaaaaccataaaaaccctagaagaaaacctgggcaataccattcaggacataggcatgggcaaagacttcatgactaaaacaccaaaagcgatggcaacaaaagccaaaattgacaaatgggatctaattaaactaaagaccttctgcacagcaaaagaaaccaccatcagagtgaacaggcaacctacagaatgggagaaaatttttgcaatctatccttctgacaaagggctaatatccagaatctacaaagcacttcaacaaatttacaagaaaaaaacaaccccatcaaaaagtgggcaaaggatatggacagacacttctcaaaagaagatatttatgcagacaacaaacatgaaaaaagctcatcatcactggtcattagagaaatgcatatcaaaaccacaatgagatgccatttcacaccagttagaatagcaatcattaaaaagtcaggaaatgacagatgctggagaggatgtggagaaataggaatgcttttacactgttggtgggagtgtaaattagctcaaccattgtggaagtcagtgtggcgattcctcagggatctagaattagaaataccatttgacccagccatcccattactgggaatatacccacagtattataaatcattctactataaagacacatgcacacgtatgtttattgcagcactgttcacaatagcaaagacttggaaccaacccaaatgcccatcaatgataaactggataaagaaaacgtggcacatatacaccatggaatactatgcagacataagaaaggatgagttcttgtcctttggacgggcatagatgaagctggaaaccaacattctcaggaaactagcacaagaacagaagaccaaacattgcatgttctcactcataagttggagtttaaggatgagaacacatggacacagggaggggaatatcacacgcctatcggggggtgggggctaggggagggatagcattaggagaaatacctaatgtagatgacaggttgatgggtgcagcaaaccaccatggcacttgtatacatatgtaacaaacctgcacattctccacatgtatcccagaactgaaagtataataataaaaaaataaagatacattttcttgcctagaaccttgcttctgctaagattactttcaaaagtaagatttattcgaagggtaagaataatgaactgtagtgataccagcattcccagaactatccgtggtagaagctaactggcatgtttgaagactgcaaggctctaggttgagcaaataatttattgtctaaatggagctacttctaagagtgaaggaggttgttaatctcactggagcaagaagcatacataccatcctggaaaaacctggacatagttggaccatcactagacagtccctaaaattctaccttttgagattcacttcataaggggtgagaagattttttagtctttaagaaacttatgttaaagtataagctgttctgggatctgtgacaccctaagccaatggttgatagccttccatgcacataaggttccccagagtcatttgttcagcatgtgggctcttggtccccactgtcagtcattgattctgtaagtttagggcaggttccagaattctgcattttaataacagagtagttctgagcacaactgagtaagcactgtcttaggtcagtgtttcccaaactatgttttcacgtgttgtgcaagatataaatacatgatgcaaggggaaaggagttctgcggtcaattactttggaaactttgtgttaaacctgttgtcttagtcatttccggctgctgtaacaacataccataaacatggtggcttataaacaacagagatgtatttctcacagttctgaaggctgggaaatccaagatcaaagcgctagcagatttggtggccatgagccatttcctagctcatagatggccatctttctgctgtgtcctcacgtggcactaggggcaaaagagctctttgaggccttttgtgtaagagcacgaatcccattcatgagggttctaccctcatgacctgatcacctcccaaaggacctaccttcaaacaccatcacatggtttcaacacatgatttttgggtggcatgaacattcagtccatagcacctggttaaacaggcatttttttgtttttaatgacagtgcttctaaaagtcctgcctcttaaagggactttatgtgggtggcattttacaagtttgagcatgggccctttaagagacactaacattttgaaatatgcagcattccaaggcaaatgctgctctagacacatacccagttctttctagatgattgcaatagctgagaccaaggtcctgcagaaacagtaccgagggtaggaactaaatctatggggagttgaaatgagactggcttagggaggtgggagtcctcatagaaacttcctaggggctgtactttggttaagcttcataaccatgcattgggtggcttcattctctcctctcttttcctgccgtgcctaggactgaagcacagttatagaattaaccctttaattctttgctttcgaaggtatgatctaatgagacaatgctggcgggagaagccttatgagaggccatcatttgcccagatattggtgtccttaaacagaatgttagaggagcgaaaggtaagtattaaagtcaggcaggagatctttaattggaatacctgatgtgcccagggtggttcataaaaaacattgaaataattgaagaagttcttcttggcatggccctaagtattatagaaacaaaggatgtccctccacccccgcgactttgaagaagttacaattttggggggaaataagatttctatacaagatatagtcacgtacacactagaataacatacagaattagcctattagagttggaaggaattttcgtcatatagcctgaccctttaattttatagatgaagaaacagactcagaagtgggtgacttgaccaaggacacacagcaagtagacaacagagcctgacctgcaggttactataatgagggtcaggaactccataaaaatttctagaagtaagttggctgtaccgatctgggagtcaaaataaaagtaaatacagtttaaagaaatagtcatcaaaacccaagtggtaattcaactagagatgcaggtgagatcacacagatgtgaaaatgagattcagacagaggaaggaacccagaagaaggaaccctagggaagctgaacacattaggaggtaccaataagacactgtgagaaaggcaagctcagaaactgaggatacagtatgaaatcttacttgcagaacgcaaggggatgcattttaggaagaaagtcatcaaatacaacagagggactgaggacagaaaagtatcccccaagtgcttagtatatgagttgcaacaaactaagaaaaccaaggtattgctgtaactgccgctggcagaggtggaatcaaagcagcctatgtctctgaaccattttcattcttccagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcatccaggagtgtgtctcatagctattgccacatgtccttattatactttaaagaaaaatcgtttaaattatccatccctagcacctagagtagtgcgagtatactccaccagttacggaatctgaagctcatcagattgaaaaggtctcctagaagtgttctactgcttatttctttttcttgcaacaggcagtacacctttgggagtgttccagtgtgaaccaagggcttagaattggaattccttttaattgtgttacaatgttaaataaagtcctcacacaatgtcattgataggtttgtggaaactgcagtactatgtagtgaaaccaattttaccatagagtaactcatagaaacgagatgctatccccatcaagctaccattgactttcttcatagaactggaaaaaactactttaaatttcatatggaaccaaaaaagagcccacatagccaagacaatcctaagcaaaaagaacaaaattggaggtatcaggctacctgacttcaaactatactacaaggctacagtaaccaaaacagcatggtactggtaccaaaacagatatatagaccaatggaacagaacagaggcctcaggaatgacaccacacatctacaaccatctgatctttgacaaacctgacaaaagcaatggggaaatgattccctatttaataaatggtgttaggaaaactggctagccatatgcaaaaaactggatcccttccttataccttatacaaaaattaactcaagatggattaaagacttaaacgtaagatctaaaaccataaaagccctagaagaaaacctgggcaataccattcaggacataggcatgggcaaagacttcatgactaaaacaccaaatgcaatggcaacaaaagccaaaattgacaaatgggatctaatcaaacgaaagagcttctgcacagcaaaagaaactaccatcagagtgaacaggcaacctacagaatgggagaaaatttttgcaatctagccatctgacaaagggctaatatccagaatctacaaagaacgtaaacaaatttacaagaaaaaacaaccccatcaaaaagtgggcaaaggatatgaacagacacttctcaaaagaagacatttatgcagccaacaaacacgaaaaaaaaagcacatcgtcactggtcatgagagaaatgcaaatcaaaaccacaatgagataccatctcatgccagttagaatggtgatcattaaaaagtccggaaacagcagatgctggaaaggatatggataaataggaatgcttttacactgctgctgaaagtgtaaattagttcaaccattgtggaagacagtgtggcgattcctcaaggatctagaaccagaaataccatttgacccagcaatcccattactgggtatatacccaaaggattataaatcattctactataaagacacatgcacacgtatgtttattgcagcactgttcacaatagcaaagacttggaaccaacccaaatgctcatcaataattgactggataaaaaaaaatgtggcacatacacaccatggaaccctatgcagtcataaaaaaggatgagttcatgtccttcttagggacatggatgcagctggaaaccatcattctcagcaaaccaacacaagaacagaaaaccaaacaccacatgttctcactcataagtgggagttgaacagtgagaacacatggacatggggggatgtgggggaggtgggcatcacgcagcggggcctcttgaggagggctagcattaggagaagtacctaatgtagatggcagattgatgggtgcagcaaaccaccatggcacgtgtatacctatgtaacaaaccggcacgttctgcacatgtaccccagagcttaaagtataataaagaaagagacaagagttaagtgtctgtagcatacagtacattatttcacttaagtcagtttccaagaacctattgagaacattgaggacat

SEQ ID NO: 11818 - DNA, 17020 bp, Human
agggcagagctgtggccacaaaccatccaggtacacagcagaagcagcctcaaaaagcttggaagctctgcatgatgcaggaaagtcataaaatcattacagtggtgacttatgtgtttatagcccctttactgtctataatctgcaaatgaactcacacagcattgggactttggaagaattatcacccttaaggtttaaattaaactgtgaatttcagaatttctaataaggacacaacaaagagtgaaagcattgctatgtctattctgcttgcccagaatcttggtcctaaaaaatgaagagtgtttgggtgtggggaggagcttcagtgtgcatgtgcatgcaaagtacctactctaaggagaagaatgagagggtaccctaattacctgttaatatgtcccataggacaccaaaactctagttagctgtttctctatgatcctctaagcacatccccaagtatggctggccagtgatgtgtatggttcaaatgttgggatctgtgcagttatcttggaattgtatagtacagcagtatatcccccccaaaaagagtgtaatacttccaattctggctgcacaatacttgccccatagtccatggtcaataaatacaaatttgagttgtttttgctcatctttcccttttgacttcaaatcagtcatcagaatttccccaaatgcctttcccctggatcttgggccagtggaatgagtacaatttaacttaattgaatttgcttatctatttggtttcctgttgtgaacaaaagttctctgaaaaggaatttggaagaaagagactttgttctagtgaacagtttgcaaaccagggagttacagcctctggtacgcaatgaaggtgagttccacagaacacaaggcaggcaggtttcacggcaaaaagttccttcccaggttcccaatcaggtccatttatgcaaatgaaggatggaaacttgcttagttcttattggtcactgcagctgcattctgattggttgatgaagctgagccctgagtggctgaggtgggtgagctttaattggttggttcaggtgagcgctgaaaatctcaactataaaaaggtacaggttttcaggatactcagagtaaccgtgtgacctgtagtaagcaaagggccagttggctctattttaaatccaggcccagttagccactcaagatctatcttacaggactggctctttcaggttcacactaataaaggcctgtccttggggaagacttctgttcacatgcgctccagtgaatttccctttctggtcattctctaccccagcacgccccccacccccgacccgccccacccacccacctgttcatttccttcttagcatgcttcacgatttctaagttcctgctcatgtgtttaaattgtgagtctggctcacctcatggcgcgtgctcgtgtggtgggctctgctgcagcctcaagaccccacactgtgctggactcaataaatattgttggacgaaggaatgaaacacatgatacaagtgagcaggcagtaccgggggagctgtggagtgggcactcttacaggtttccatggcgaaagcgggggtacagttgtgttcttttctttctaaaaggctttctaaaaagccttctgtttaatttctggaaaagaagcctaacttgttcactacatagtcgtccttcttcctctctggtaacacttgttggtctgtggaaatactaatttaatggatcctgaggttctggaagtactttgctgtgttcactcaagaatgtgatttgagtatgaaattccagccagttcaactgttgttgcctattaagaaacctaataaagctccaccttctttatctctgaaagtgaactccctgctacctttgtggactgacagctttttatagtcacgtgacacagtcaaacattaacttggtgtatcgattggtttttgccatatatatatatataagtaggagagggcgaacctctggcaggagcaaaggcgccatggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggtgtgtattggagtgggacttttacatgcgtatattctttcagatgtattactttggatcgattaactagccccagatatatgctgagcaagcattctgagataatttaaaatgccctcttttgttaatttttgactcctaggtttgagtctgtctttggcatcatcttctggatgatttcttggtatctgagatttcgggaaagcattccttggacattttactctgtgtgctccagtggatagtaatcaattagaaacaacaagctgttaaatgccataggcacagaatgctgggtttggggcaccctgcagaaaactcagttgaagcctgcaccttgccctggattcagtcaggcaggcaatgttcaggactgatgaaatcattctttgatgatgatagatcctggaaatgaaagttgcctttgtgaccctggttaaagctccagtttctaaatattctgataagaagctaaatcctgcagtccgttctcttctaatgagtgaatcaccagacagtcaggttctgacatgatacagaaaggttgtaggtttcattctcaagctattaggtttatttttcccctacagagtttgaagtatgcaaaaagtagcattcacatcctcatcgaaatctcagcagaggatagaaaagaacaggagaggctccttcagatggagcgttagggaattactctttgaggaggtgacatttcagagagcgttcattcacttatcctgcaaagattggctgaggatctactggcagcccaggcacttcccaggtgctgcgtctggctcccattaaggggactgatatcaccttcggaggtgaccttatttccactatacctccaatgtgatttgtattttattttttttaattttctgtgcattttccttcatagcacatcaaatatggcagccatttcacttagatagttgttgattgtccgcttcacatcatgagccatgtggggacctgtgtgactttgcattaatcacatccactgtatgcggcgtcctcaacacctgccaatgggtctgcatgtatttggcgccccataaatctcagcacctaaggcacagaataggcacccaccgaatatgtgttacattaatgaatgagaagaaaggtgccaaccgaggtctagttaatgggtcgagagtaatccacaatagctctttttagttctttgtactccagctattacataccaatatgtatatagaaacatatgtaaaattttttggttgctttttctacaaaatagagtaacagtgtattcccactgcccacttaccgataatgtcatggatatcactccagttttaaatgctattactttttaaactatgaaatagtatttcatggtacttgtgtaccacagtgtattctgctggagatctagtctagttccccacagaggaacattacaatttgtattccaggagttttgttgttgtgacctcaaacacttcctttaaaaagataagctattttgtagtttaaaaaacatttgttctgtttctttctcattcatcttttcttaagtattttacacggttttttttttttggtcactactgtgaatgtgttatttttttgcatttctatctctagctgattatctactcattactcagctatctcatcaaaatattgattttcataataaaaaataataggcagtcatttgctgataaagaaattttggtttcttctcttataaattccatgccaaatatcagggctattgaatttattagaatctctaaaaacagttgaataattctggcaataggaaagatgcccgtcttgctgctattttagtggaaattgattatcatttcattattttgcattatgttagccattgttttctgaacaggctttattgatttagataatttccttctttgcgtgaggatgtttgtaggagaggcaccgaactttatcagctgcctttctggcatttattgatataaccataaaagtctaagtggtgaactgtgttgactacatatttgttgttgccttgtttggtgcagtcaggcttaggtgtgaaaatatgtttttaaattgtaccttttagtaacctgttttgtcttgttgcatgttttaatctgaaattccactttttggatattaatattaccacttctgtattatttttgtttacatttccctagcacatctttagtactcctttgtcttcaagctttcttcctttttaaacaacatggcactggtatttttaatccagtcaggcagttgctttaataagtgcattttgcctatttgaatctaacaattaatagatttgattgtaactctctcagtttactttatgtttagttgactttgccattctcctttttccggatttctactggttggtcaagttactgttcttattttctctttcttcctttgttaactaaaaatgccactctgcactaccattcctcttgtgttgatggtcctattctcaatactcttgataaaactcctgaactttaagaataaagataaaacttttattgcacaaagaagtccatagagaaagcacaacctggcattggcgtgtctttggtgtgtctgaaggaaaagagatagtggaacaacattgggagaaaaggaatgaaactcaagaattccaagatgttcctcccctgccagggtaagatagcagtggttcacagacaatcgcaatgctgggtctgagaaaaataactaaacagaagattagtgaggaccaaggcttcgagatggccaggagaggaaagcttgggagcagggaaggttgagatatatgtgggttactgggaatgcgtgatggtgaagtcacagatgacccacatggtgtctaagtgctaaagaagaattctgggaaaatgaaatgcatttgggaagggaaaatctaattaaaagcctaaactaaaaatacaaaattcttggtaaagtttaggagttatgttaaatgtctcattttggctggtgaagtctcatcagaacagggaaattctctcattcaggggcatctcatcttttctttgaagggaatcaatggtgggggattggagtgttattttcagttaatatgttgcttcactctttggtcattccggtaactgtgaagtcagggtgaagtttaagggaagctttgccaagtaggggatggacttcacctttattgagcctcatagtagctggctcaggtaggagttggccgtgatgacaacttctctgcagtttgccctgcgtgaatctccagatgaacttttgtgccatttaaactttcgtgatctcctgctatttaacttcgaatgtttatggacctgtgggttcaattttgtgtgaatcacatcctgctgattgctgagtgggcgtgtgggagggtgtgcctggaggagaacttagactcggccttttccagatgagcttcagtgtaagagtgggtttcatgaagagcaaaggtcctaggaaatttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagcccaagggaaaaggcaaagacaaagcccttaagagccagaggactcacgagggcctggggctggtgagagtggcggggagagagggctcaccttgggagaaggatggtcagtgtctggggctttcctggtcatgttccaaatcaggcttggcaggagtcctgctgtgcaaattgcgtttgctgagccctgtcagaggtctcctgtgtctcacatctagggtgaccagcatcctggcttcctcaggactgttcaggttttagcactgaacatcacatgtcctagggaacccctcagtttgggcaagccctgccacatcacacaatcatattagtgccctcagtattctttgcaaacataaaaccatagactcagtaatcccattactgggtatatacccaaagaaatataaattattctactataaagacacatgcacatatttgtttattgcagcactattcacaataacaaagtcatggaaccaacccagatgcccatcaatggtagattggataaagaaaatgtggtacatatacaccatggaatactatgcagccataacaaggaatgagatcatattctttgcaaggacatggatgaagctggaagccatcatcctccacaaactaacacaggaacagaaaatcaaacaccgcatgttctcactcataagtgggagttgaacagtgagaatgcgtagacgcagggaggggaacaacacacaccagggcttgtggcggggtgaggggtgaggggaggaacttagaggataggtcaataggtgcagcaaaccaccatggcatatgtatcccagaacttcaagtaaataataataataataattaataataataataataataaataaacccataaagccatttgagagattcttgggggattcattggaccactgaaaatctacagtgagaaaagaattgccatgttgatgaaacaggaaaactttccttgtccccctcacagagcatgtgacagcgggaggggctcactttctcagtgcgccactgctcaaacctctaggggagcatacagacgggcaggttgtggggctctgacctcaccggcagtgtctagaggtggatgtttacagctcctgaagctccagtgggcgtgggttatggccttcttttagttttgccctctatagtcagcttgtgttaaccagctcaattacaccctctaccttgtcgcaaggacagagggctttctgtatcctgggggcttgccttggtgtaccagaagaatcgaatcccacctgggcttggagaatgagtgcaaggatttattgagtggatgtagctctcagcagatgggggaagccagaaggggatggaatgggaagggtttcccctggagtcagaccgctcagtggcccgggctcggtggcccgggctcggtggcctgggctctcctccgactgcctcagccaaactccgcgttgttctgctggtcagtggcctgccggtgcctgttggtgagttcttctcaatgtccagctgtccttgcgtccctccgctgatgtgctcctcccgatgtccagctacctgtgtgtctgcctgctagggtcttggggtttttataggcacatgatgggggcgtggcaggccagggtggttttgggaaatgaaacatttaggcaggaaaacaaaaatgcctgtcctcacctaggtccatgggcacaggtctgggggtggagccctcgccagggaccacaccctcttctacccagcacttcccttccctacttccatatcatttaaagggaccacgcccttcccagctcttcccttctgtatcactgatgccttgctctgtgttctctaagtggaattatcactgtgtgtatgtacaggtgtgtgcatgtgtgtgcatgtacctgtgcttttcttttggaaaactagcacattacctggattttgcatctcaaggataattctgtaagcaggaacccttcctcctttagaaggaagtaaaggagaggaaaatgctgtaaaacttacatattaataattttttactctatctcaaacacgcatgcctttaatcatagtcttaagaggaagatatctaattcataacttactgtatgtagtcatcaaagaatatgagaaaaaattaactgaaaatttttcttctggctctaggaatttgaagcctacattaatgcttctggagaacatggaattgtggttttctctttgggatcaatggtctcagaaattccagagaagaaagctatggcaattgctgatgctttgggcaaaatccctcagacagtaagaagattctataccatggcctcatatctattttcacaggagcgctaatcccagacttccagcttccagattaattctcttaattggaaccttagatttggcttttccctgccacttcccaactattaatccaaaggttttttttgttgttgtggttgttgtcattgttttcaatttgactctcaaatactctattaaactatgatccaccacactcagaagtatcattttctctaagagactcaaaagtgtattagggagaatttatttaaaaataaaataaatgggatattgtttcttcatattaaatagaagtatttctccaaaaagctgttggttagaacactgaatttatgtcttacatttctgctcttatagttctgcatccacttgtttcattaagcaaactttcccttaaagtgcaggaaagtgaaaaaatcctaagtgcacagcttgataaattatcacaaattcacgtagtgcatacacccttgtaactaaacctccaaaacaagatgccggaagttgccagtcctcagaagccttcacagttactgatcctcccactctgttaaagactgttccttcagaggacccctgttttctagttagtatagcagatttgttttctaatcatattatgttctttctttacgttctgctctttttgcccctcccaggtcctgtggcggtacactggaacccgaccatcgaatcttgcgaacaacacgatacttgttaagtggctaccccaaaacgatctgcttggtatgttgggcggattggatgtataggtcaaaccagggtcaaattaagaaaatggcttaagcacagctattctaaaggattgttgagcttgaaaatattatggccaacatatcctacattgctttttatctagtggggtatctcaacccacattttcttctgcaaatttctgcaagggcatgtgagtaacactgagtctttggagtgttttcagaacctagatgtgtccagctgtgaaactcagagatgtaactgctgacatcctccctattttgcatctcaggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaaggtaagaaagaagatacagaagaatactttggtcatggcattcatgataaaattgtttcaaatatgaaaacatttacgtagcatttaatagcgttgtttcaaatataaaaacaaatacataaaaatctggatttttatttcttctttttttttttttttttttttgagatggagtcttgctctgtcacctaggctggagtgcagtggtgcaatcttggcttactgcaacctccacctcccacgttcaagcagttctgcctcagcctccgtgtagctgggattacaggtgtccaccaccacgcccggttaatttttgtattttttagtagagaaagggtttcaccatgtttgtcaggctggtcttgaactcctgacttcaggtgatccacctgcctcggcctgccaaagtgctgagattacaggcatgagccagcgcgtctgacctggatttataaataagataatttagaggttattattcactttataaaaggattctttagtttctatataatttatcatataatttatttagaattttatttcccccattagatttaaaactccaatttacataaaaagttgccataatagacatctgatccataagtttcctgcacagaaagaaatactccattataagaagcatagtatctttaagagaaaaacaactcaaatgcttagaagtacagctttttgcagcactggaacctgtgagaaattttgtccatggagtttatgaatgaaggagctataagatatcacagacaaagtcttagaataagagcaaaggaaaatttgctcaaatgtggccctgaaaacgattcaaagggcaaatgatttctggattaaagttagtatattactgtcaagctcactggtaataggcttattagaaccttatgggaagaagtggtggccagtggtagatttcatccgacaatagatactgtgtgcatatgtgcgtgtgcgtttgtgcatgtggctgtgctcatgtgtgggtgcacacgtgtgcattcatatgcgtgtgtgtgtgtgtgcgtgtgtttatgagagtgtccattgctttctcccatggttacctcctttagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccctgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataaaaagaagtggaaaattttcaaacatcagtttatgctgacaaccaggccataataggtgctcaattactattgaatgaatgaatgaaagttctggccaggtacggtggctcatgcctgtagtcccaacactttgggaggccgaggcaggtggatcacttgaggttaggagttcgaaaccaacctgaccaacatgaagaaaccttatctctaccaaaaaaatataaaaaaattacccaggcatggtggtgtatgcctgtaatcccagctatttgggaggctgaggcaggaaaatcacttgaacctgagaggcggaggttgcagtgagctgagattgtgccactccactccagcctgggcgacagagtgagactccgtcttacttaaaaaaaaaaaaaagaaggttccaagaaaattcatcttaaggtttatgtaaaaggaagatgatatttaacatgattcatggccaagtactaatattacattataataatgtttccaaataacattatagatatgtttaaagacagtgtattaggctgttcttgcattgctgtaaagaaatacccaagactgggtaatttataaagaaaagaggtttcattggctcgtgtttctgcaggctgtacaggaagcttagtgctgacatcacttggctgccgggggaacctcagggagcttttactcatggcagaaggcaatgcgggagcttgcatgtcacatggcaaaagcaggagcgagagagagttgggggggaaggtgccacacactttttaatgaccggctctcacaataactcatgaaaactcactatcaggaagacagcactaaagcacaagggatccgaccccatgatccaaacacctcccaccaggccccatctccagcactggggattacaattcaacatgagatctgagtgtggacaaatatccaaactgtatcagtcaacagcgatcataattagtcctgaataggagtgcctttttttttctttcttctcccttttcttttctacttcctcctccttttccctctcctcttcaatctcctcttcattcctgtagcaccaagggttgaagcacctaacccgttttggattgagatgttctgattgggcaatgaacactgtccagaataaacagaaatccattttgcactaagtggctgcacagaccctgcctcatgctaaatctagcacccagatagtttaatgtttcaatgactgaattacaaatatatcatcaccttggatttggcacttacaaatggctgttaatttggccagaggtggttgtttacaacttcaaataggagactattcataatttctgacgtgacattttcctttctttattttactgtatgaaaatataatgaaatttctcacaaaatatcactaaaaagaaaagaagaagagtaggaagcaaggttaaaatatttctaaaatataattttggtctttctttttctcccttccttcctccgtccctctctcctttcctctctccctccctccctccctcccttcctcctttccttgcttccttccctccttctcttccttctttttcaagagatcaataacatttattaagaataagtttcttaattataacctttcaggtgataatagtaacacagcctgggcaacacaataagaccttgtttctacaaaaaatttaaaaattggccagacatagtggtgcatgactaattccagctactctggaggctgaggcaggaggatggcttgagcccaggagttggaggctgcagttagccatgcttgtgccactacactccagcccgggcaacagggcaagactctgtatctaaaaacaacaacaacaacaataatagaaacaggtttcctttcccaagtttggaaaatctggtagtcttcttaagcagccatgagcataaagagaggattgttcataccacaggtgttccaggcataacgaaactgtctttgtgtttagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacacacacacgccttcattgcgtgtgcatgcataaatgcatgagaaaagaaaaataaccagtaatcacatcgcccagaaataaccccagttacaattgtggcaaatacacatacttataaatattgcagatatattaagtatacctagtatttgctaacactctttcttctactctgtcatgaagattctcccaaggtgtttttgtataatatttaattcattttcagtggccaagcagtattctacttcatggatataccaggatttatttaaccataacttctggttggattcactcttattattttgtttaattaaaaaaaaaagacctcggctgggcacagtggctcatgcctgtaatcccagcactttgggaggccgaggtgggtggatcacctaagatcgggagtttgagaccagcctggccaacatggcaaaaccccgtctctactaaaaatacagaaaattagccgggtgtggttgccagcacctgtaattccagctaattgggaggctgaggcaggagaattgcttgaaccggggtcagggggttcggaggtcggaggttgcagtgagtccggatcatgccactgcattccagcctgggtgacacagccagactctgtctcaaaaacaacaacaacaacaaaacaacaacaacaacaacaacaaaaatctcactggacatcctagtagctaaggctttccacatattcatgattacttctgttggaaagtgctttacaacaaattgctagttgtctcagtctgggttcccctgagatgaggattcaagggccaggagtttatttaggaagtaaaggaaacactgatagaggagtggcagagtgagaaggggtgatggtcatccacagctggctctcttgtggtcaatcggagcttaatcctgctgggtgactctgggagccagtggagaaaagacaccccagacttatcccaatgaggaacacggctgttgggtgcctgagtacttgcctcgtcagggattgaaacgtactcccaggtagtagtaatttctctgcccttccattaggccacaaagggggctctgacagagagagctgacgagaaaaaacacacgcccttgtcactgaagaggtacacaggggatctgtgtggggcaccacctgcactgctaccctggacaaatagcttaagaaatccccacactgcatccccaaacttactatcagcgtgtgagggagacaggttcccacaccctcattagcacaaagtactatcttgaaaaagaaagcctgtcagtttgataggagaaaagcaggatcttgtttacaatgtgcttttattattgttattattagagattgtatttcttttcaagctgatgagccgtctgtgtttattttttggaggataccctttgcccactttcctattggagtgtattaccctgaggatttggtaagagtgcttattgcattcaccagaatgtcctttttgtcatttactgtattttctctacttttttttttttgccttgttttactttttttgttttgtattacaagcagaagttttaaatttgtaagcttcaaattggagctggggtggtgcagagcgaagatttcagctggttccctgaccccagctccatctccttccctaggcagtggctggaacacattctgtccactatttccctctctacatccttgaggctgtgcagtcacccctcaactacgttcaccctccttcaaagcccttcctggtccacccggggaccatctcccggcctcactgcccctagctccttgacgccccaacctctctcagggaccccaagttgccatgacctctagccagctcatgttcatttgcaccttcgtgtctgcagcactgaggca

SEQ ID NO: 11819 - DNA, 7509 bp, Human
  misc_feature (1)...(7509): n = A,T,C or G
tccattctcatcctgccatcttagtccaagtttgttctttttttttttttggagacggagtctcattctgttgcccaggctagagtgcagtggctcggtcttggctcactgcaacctctgcctcccaggttcaagtgattctcctgcctcagcctcccaaatagcagggattacaggcatgttgccaccatgctgagctcatttttcgtttagtagagatggggtttcaccaggctggtctcaaactcctgacctcgggtgatccacccacctcagcctcccaaagtgctgggattacaggagtgagccactgtgcccagccttcccccaggtttaaaggattctcctgcctcagcctccccagtagctgggattacgggaatatgccaccacacctggctgatttttgtatttttagtagaaatggggtttcactacgttggccaggctggtcatgaactcctgaccgcaggtgattggctgttttttcatttttaactgctactcatccagactttgtttacattcatatgtatttgacatggtgtccttagcatatgtgttttttttttgttttgttttgttgtttgagacagagtctcgctctgtcgcccaggctggagtgcagtggtacaatctcagctcgctgcaacctccacctcccgggttcaagcaattcttttgcctcagcctccagagtagagtagctgggattacaggcgcacgccaccatgcctggctaatacttgtattttgtaaagatgcaattttgccatgttggccaggctggtctcaagctcctgacctcagatgatccacctgcctcagcctcccaaagtgctgggattacaggcgtgagccaccttgcccagccatatgtgctcttttcaagtttacgtatatttgaagtttagttcattgccatatagataatgctcagatgaacttctttgtatgcttggactttgacaaaaattctgtcaaagtatttaatcagatgtcccagtattagattactagttcaagctctgcctcctgggttcacgctgttctcctgcctcatcctcccaagtagctgggactacaggtgtccaccaccagactggctaattttttgtatttttagtagagacggggtttcaccgtgttagccaggatggtctcgatctcctgatcttgtgatctgcccgtctcggcctcccaaagtgctgggattacaggcatgagccactgtgcccggccaaaagatttttttttactttaacataaaatagcctgccacagttgttttattttattgtcattgatggtgagaacagtgcttccccatttctgtcctaaaagccctctggcaagactggaacaaagctcttgtgaaattggagggtttttttgggttttaattttggttttggtttgtttttgtttttttttttaatcttctgcttccttttgttgtctaagtaatgctttgcttggcctctcatacttttttttttttctcttaaataaagagacagggattgtactttgtctcccaggcctgcagtgctgtgacatgatcatgcagccttgaactcttgggctcaagtgatccttccacctcagcctcccaaatagctggcactgtaggtatgtgccaccacacctgggtaatttatgtttttagagatgaggtcttgtgttggtccagctggtttcaaacaactgggctcaagttcttccatctcagccccaagtggctgggcttacaggcgcaagccagcgtgcccagctctcctatacatcttttgaagtgggtcagctgaaaggaaaaaacccctaaaactagaatgaggtgctcttctccaacattctcatttttcttgagcattcagttatatgtctcatatgctgctaacacttgatatattagcttccattcatcccctttctcctttcttactttgtttttgtttgtttgtctagagacagagtctccctctatcacccaggttggagtgcaatggcatgatcttggtttacaacaacctccgcctcctgagttcaagcaattctcctatctcagcctcccgaggagctgggattacaggtgcctgccaccaagcccagctaatctttgtatttttagtagagacgaggtttcgccatgttggccaggctggtctcgaacttttgacgtcaggtgatccgcccgccttggcctcccaaagtgctgggattacatgcatgagccaccgtgcctggccacttctacttgtccacattacttatttctttctgtcctagggccacctagcctccttttgtggcactgtgtgaggaatgtgggttagatcagctgctcagaactccagggtccctcattgtagggcttcctgatagttgtttgaccatcagtaagctcctgacctttgagccttcctcatttgtaaaacggtttttataggtgacatcaaggttctgtgaagtaacggaaaatgtttggcagcaccaaagcgctttctaagagatgaatactgccatgttcaaaaccctctttcatagtttgtagtccttttttttttttttttttttgagacagagtctcgctctgtcgcccaggctggagtgcagtggcgtgatctctgctaactgcaacctctgcctcctgggttcacgccattctcctgcctcagcctccggagtagccgggactacaggcgcccgccaccacgcctggctagttttttgtatttttagtagagacagggtttcaccgtgttagccaggatggtctggatctcctgacctcgtgatctgcctgcctcccaaagtgctgggattacaggcgtgagccactgcgcccgtcctatagtttgtgctcttttttattcaaatacagagtgagccacgatgattgctcttatgctaataggaactctaagatactttctggcccaagtatagatggaaaaaatacaacaaataccagcctaacagaattttgggatgtaccctgaaggtggcaaaccaatacagagggtgttaattcagcctcagccaagcatggatgcttggacataggtgtttttgtggtcctgataggaaaactggttttatatggacacagggcccagttgtgacaaactaggtagaaatgtgatgacatcttcaggattggtgtcaagttatagccctcttacctaacttagattgatgcaccatacatagaaagatccattggcttggggaagcaatgtcaggttggcattttcatagcttatttctcaaaagcctagtagtgaatgtatattactggttgtatcctaacattttctccagagagtggctgttaattgctgcatgtctgtaagcatgaactggaagggtcttttccatctgtggcagtatgtatgttttggaagcagctctttggttctcttggaaacattatttctgcctgggcatcttggaacaaccagaatcttgcccataagaaatttagagaccttgacttaaaaccttgaggcatggtctgtgagtatttttcttgtgctgcaaaccttggacatcactgaccctcgcaagatagggggaggttctcacttgaggagagtcccctggaataaaagtgtttgattgaagagcatattacaggctacctgcctgcctcagagcaactcaagagtccccaagatgggagagggtactgtgtaggaatattcatttaacagtatgcaatagtataaggccagacgtggtagctcacacctgtaatccagcactttgggaggctgaggcaggaggatcaccagaggtcaggagtttgagaccagcctgcccaacatggcaaaacccaatctctactaaaaatacaaaaaattagctgggcgtggtggcaggcacttgtaatcccagctacttgggaggctgaggcaggagaatgacttgaacctgggaggcagaggttgcagtgaactgagactgcgccactgcactcaagcctgggcgacaagggcgaaactctgtctcaaaaaaaaaaaaaaacagtaggcaatagtacagcctagggaaccatacaagattgtaggtgatcatggtaccaagagtaggcctgctcacaatgaaaaggccccttttgatatgagacagactcaacatcttggaagcattttatcaagcgccaatagaggctggatatatgactaaacaccgtggggtggagggggccgggagagtgggatttgccagggagtaaatgagctccattattgtgagggcagacagattgtgataattgggcatcagtatatcttagttacacatgccagaatgatggtttgcatgacagaagtacagtgggccttgtggaggttatttgtgatgcatcctggggcaaaagttcgggggtggaagagccatcaattttaaggaagaaatcatttagaaactgaaatttgggctgtgaaggtgctaagagaagaaagatgtgttccaagtattggagggagacctcttgggcctcaaagggcctctgtacagaggatgtttaacatggagtctggtgataagaatggggtagcagagctgggtgcagtgctgggcagtgttgaatgggacttgtattcagagcccaggcatcagtttacccttctaccacaggagggtgaggatgtacccggatgtgaaaggagtactctctcaccttacgtgatgcattatttcagacatttcttgagtagtaaaggcacagccaaaagggctttcctgtcatctcaggccttgcctaacagccagcatggtgtcttttcctacctaccaactcaaaatacagatttgtttccatggtttccacattatagcagaaaatttacttagtcttgtatcttcctctctcgcctgtatgcctggtaggatgttatttaaaatttgatttcttccctcctgtctgctttctttcctagtagaatgttatttataattaaacacttttataagctacagagttatttttgacttgacattttgaattatgccacttggttcagttctagtatctgttttgtttttttgtttttttcctaattgagtcaaggtctcactgcctaggctgcagtgcagtggcacaatctctgcttactgcaacctccgcctcccgggctcaagcagtcctcccacctcagtctcccaagtagctgggactacaggcgtgcaccaccacagtcagctaatttttttttttttttaaatggagtttcgctcttgttggccaggctggagtgcagtggtgcaatctcagctcattgcaacctccactcattgcaacctccgcctcctgggttcaagcgattctcctgcctcagcctcctgagtagctgggattacaggcatgcttcaccacgcccagctaattttgtattttcagtagagatggggtttctccacatttgtcaggctagtctcgaacttccgacttcaggtgatccgcccgccttggcctcccaaagtgctgggattacaggcgtgagccaccgcacccagcccacactcagctaagttttattttatttattttttttttttttagagatggaggctcgctttgtcgcccatgctggagtgctggagtgcagtggcacgatcttggctcactgcaacctttgcctctcgagttcaagcaattcacctgccttagcctctccagtagctgggactacaggcgcacgctgccgtgcctggctaatttctttcgtattttagtagggacggggtttcaccatgttgcccaggctggtctcgaactcctgagctcaggcagtcagcccgcctcagcctcccaaagtgctaggattacaggcatgagccaccgcgcctggccacactcagctaatttttaaggtgtttttgtagaggtgggttctcagattttcaattttgagaaatttcaacctaaaataatttaaatatactctcatttgagcttgatgctcataaaagtgaatgggattcggccggggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaggccaggcgcggtgggtcacgcctgcaatcccaacactttgggaggccgaggcggacggatcatgaggtcaggagatccagaccatcctggctaacacagtgaaaccccgtctctactaaaaatacaaaaaattagccgggtgtgatggcgggcacctgtagtcccagctacttgggaggccaaggcaggagaatggtgtgaacccgggagacggagcttgcagggagcagagatcgcgccactgcactctagcctgggcgacagagcaagactacatctcaaaaaaaaaaaaaaaaaggaaaaaagaaaaaatgtaaatactcctgtgttttactgttttagaccgtctgccatttcaatggtctgccatttcaatgtactatggtaagtgtcactttttctaaaagtgggtggggggattaaccttgcactcttgtggttgtttttcccattacaggtagagttggctttgtgggacacagctgggcaggaagattatgatcgcctgaggcccctctcctacccagataccgatgttatactgatgtgtttttccatcgacagccctgatagtttaggtgagtggccctgcaccctgatatttgtcactgcctgtgtagctagttggcatctggtttctgggcatcaagtggctgaaaagcagacatgaacttcagagaagcaatcatcgtcagtggccggagtcctggagtttgggattgtagagcgtgggccttgggtccctttcagcctaggtctcccatgggtactgtatttaaaatgtatccacctaggcagggcacggtgcctgacacctataatccctgcgctttgggaggtccagacgggtggatcacctgagggtcaggagttcaagaccagcctggccaacatggtgaaaccccgtctttactaaaagtacaaaaaaattagccaggcatggtggtgcacgcctgtagtcccaggtacttgggaggctgaggcaggagaatcgtttgaacctggtaggtggagattgcagtgagccgagattatggcactgcattccagactgagcaacagagcaagactctatctcaaaaataataattattattattattactaaataatattaaatgttatttaaaaatctaactgccttgtaaactagatgaattccagatacaaagatgagtaaactaaggctggtgcggcggctgacacctgtaatcctag

SEQ ID NO: 11820 - DNA, 192700 bp, Human
cttgtttgcttaactgaaaactgaagataataacacctatttacatggttgttataagggttatatgaataatgtctggcaaatagtaagaactcaagtaactgtttcactctttccagaaggagattggctgaaaaatatttggagtctcctccagccatattccttggtcagcttctatgatcctctttggagcttaattcttaatccctttattttcacttgcttgttgataacaaagaagaactaattattaatttatttcaaaatgcatgtattatatttgatgggccacactaacagttataaaccaaacaacagattgggaatggggaagtggatgtggtgagttcaatcacatgtctgggaaaagtcaatagtgaagacagagtctcacaattttttgtcataatggagagatgaaaacacaggtagaggatttcaaacaacagagtggatggtgagttaaaaatgctgaaattctttcctggtgtctaacttaatgcaatgtggtttatctctttgctcttttctctactattcaaatttaggataataaagattaaatgtttctaaatcttactttacaatatcaagaaaaaaaggtatgcttttgcccacggaagggcaaagcagagctatgaaaacctgctgaacacattctttattttcaacacaggttcttgtctttccatcatgaaatgcacattttatttgtactgtatttgggtgaccacaagtcaacaacaagataattcacaagacccttgccttagatgtgtcggcaataaagtaatcaggccaaaatttttactttcctttgaatttttcaattcaaacacaatgtatgcttgcttttacacagtagggttcagggattagagggttggctctttaaaaaccgtcagagacacaggcaatcctacacaaaattctcagaaggaaggcgcctacgcctgggaatgcccagatgcccctcagagagttgaagatggcgtttctctgagtcaggtcaaagttaacacattaccttcgcttcaaagactgcttggcttcctttcggtggattagtcaagatgttttgctgactgagactaggaaatctataggagggcgggttagtttacattgttccttgtcattatcgctaaaacactccaaagccttccttaaaaatgcgcactgggctaaaaaggatagacaaggaacacatcctgggccggtaattacgcaaagcattatctcctcttacctccttgcagatttttttttctctttcagtacgtgtcctaagatttctgtgccacccttggagttcactcacctaaacctgaaactaataaagcttggttcttttctccgacacgcaaaggaagcgctaaggtaaatgcatcagacccacactgccgcggaacttttcggctctctaaggctgtattttgatatacgaaaggcacattttccttcccttttcaaaatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattgttttgaaagaaaatgtgggtattgtagaataaaacagaaagcattaagaagagatggaagaatgaactgaagctgattgaatagagagccacatctacttgcaactgaaaagttagaatctcaagactcaagtacgctactatgcacttgttttatttcatttttctaagaaactaaaaatacttgttaataagtacctaagtatggtttattggttttcccccttcatgccttggacacttgattgtcttcttggcacatacaggtgccatgcctgcatatagtaagtgctcagaaaacatttcttgactgaattcagccaacaaaaattttggggtaggtagaaaatatatgcttaaagtatttattgttatgagactggatatatctagtatttgtcacaggtaaatgattcttcaaaaattgaaagcaaatttgttgaaatatttattttgaaaaaagttacttcacaagctataaattttaaaagccataggaatagataccgaagttatatccaactgacatttaataaattgtattcatagcctaatgtgatgagccacagaagcttgcaaactttaatgagattttttaaaatagcatctaagttcggaatcttaggcaaagtgttgttagatgtagcacttcatatttgaagtgttctttggatattgcatctactttgttcctgttattatactggtgtgaatgaatgaataggtactgctctctcttgggacattacttgacacataattacccaatgaataagcatactgaggtatcaaaaaagtcaaatatgttataaatagctcatatatgtgtgtaggggggaaggaatttagctttcacatctctcttatgtttagttctctgcatgtgcagttaatcctggaactccggtgctaaggagagactgttggcccttgaaggagagctcctccctgtggatgagagagaaggactttactctttggaattatctttttgtgttgatgttatccaccttttgttactccacctataaaatcggcttatctattgatctgttttcctagtccttataaagtcaaaatgttaattggcataaattatagactttttttagcagagaactttgaggaacctaaatgccaaccagtctaaaaatgcagttttcagaagaatgaatatttcatggatagttctaaatactaatgaactttaaaatagcttactattgatctgtcaaagtgggtttttatataattttctttttacaaatcacctgacacatttaatataggttaaaaaatgctatcaggctggtttgcaaagaaaatgtattacaaaggctgctaagtgtgttaagagcatactcatttctgttctccaaaatatttcataaggtgctttaagaataggtatgtttttaaaagttaagttcctactatttataggaactgacaatcacctaaaataccaatgattacaaacttccttctggccttctggactgcaattctaaaagtgtaaaaaacatattttctgcattaagttaggcagtattgcttagttttcaaagtggtaggctttggagtcagattattttgattcagatcctacatctactgtttagtagctctgttgcctgaggcaggtcccttaacatctctgtgtgtgacttgacctttaaaatttggagactgtcataggggttaatcccttgagaaaatgaatgtgaaaagttagcctaatgttaactgctattattatggattaccatattttcacattcatcacagtacatgcaccttgttaatataagatgctcaattcatctttgagtataattttgtgactctcaatctggatatgcaatgagtgggcctgtatgagaatttaatttatgaaaaattgtgtttcacatggccttaccagatatacaggaaacacgtcacatgtttctattgtatgttgttaaatgccttagaatttaactttctgaataggatcccttcagtttgagagtcataaaagagtaaaattattatggtatgagttatagattgtattgaatatctctttatatgtctaggttttgtcattggaaaaccaaaaagtttggaaaaaaaatctaagttatttcttactttcttaattttgtgtggatttcacatcaagtataaaatttgaagaacatctgaactatcataatccatatatatatataaaataaacataatctaagagagaatttcaccatgaaaaattcaggtagttcatgactatcagagcaaacaagtacattaaattgaaacttttatgaaaataacatttatgaaataggaagctatttttaaactagaagtgatatattagcatataatttataattcatatacaagtgggattgatttataaatggtcaccaacagagattgtgctatttaatttgggaaaattttttaaatttacattttctcacaacttttaaggtagttattcagtttgttcctctctgtctcttctctcatgccctgaatttttcatatttcgtttagttgtaagagtgtatatcaaaccgtgtgtcacatgacataacttgaattttcgtcgtgatatctgtgctatgtctaggtctatactgaggaactgtgggaaccccacagaatccaagtatacagtgccactgatttcttacaagggatgtggggtctcctgtaaactctgcagttagtctcaagtaagaccaaagagtaaaatattgttaggatctaaggtggaaattcagcaaagaatcacatagtctaagtctcgagtttaacagtaagataatttgagatacttttgtaattattaaacacaaagtaatgagagattttaaaacaaacaaatacacctgaatttatatatcagaataggtatggtggttcaaaatagctatctaataaaaaccacactcctattctaaacatttgcctttgatcaaaataattttgggtctcttattatgaaattgcctttctaaataatacataaatttcttctcataagtatatattagccacattattttattgttattgttttatattcatagcttgctttagattaaaaattatattacccagactggtctcttggacttgcttccaagtgacttttgactgtatcacaaaatcaaattcactctgaaaatataaagatttttcatcataatttcctttgttaacagccaagtgctacctaattttaggtgttttcattaaaaaaaaatgcattgcaaactttaaagacaattcttttgtttgtttgtttttaaaagacagagtctcactctgttgcccaggctagagtgcagtgacacaatcataactcactgcaacctccacctcctgggctcaagtgagccttccatcttgcctcacgagtagctgggtcttcaggtgtacaggtgtgtaccaccatgcctggctaactttttttttttttaagttatatagagacagtatctcactatgttgcccaggctgctcttggagctcctggcctcaagttatcctcccactcagtctcccaaagtgctgggattacaggcgtaagccacctcaccctgtcagcctaaagacagtgcttaatgaagagaaatataagtgctttgagcaatggaagtataattaaaattatactatgaaagatttataaagatgaccattttgaatgggaccacacttatttggttatataaattatgatacactattaaaaattcatcatgatgattttgtatttacattttatttacatgtttgcaatttgtgaggaaagctaaaattatggctaagccataaatatttttgcagtttgttgagggtgtttgtaaaagtgttgccaaggaagaccagttggctacccaaacaagggtttagtctaggtctgatcaatacatacacattatctcaggtttgtctatcagaaaaaccttaggttatccaaatcaaaataaaatagatgcataaaacaaaggccaatatgtgttgaacaattatattgtgatatacaactgccaagcattcccgattaccatgactccatttagtcagtccatgggcaaatgccatcaatgaggacagcccagggtttccatattctctcttggctttacatcctataggaattggaggggcccacctctgggataggagcccttctgtcttgaacaatgttgtctgaacactaacaaatgttgactttctacaccagtccctcaatagtcttttctatttatccttttgctgaccatgttttgttattacacagttgagatttttcagctgggaatctgtgttaattttgtattaattttgattagcttaactctcagagttctaaaagtacctcctgtacctgatatatgacaaaaattataattacatttatttatatataaaatatctttgtatatgtaaaatatctttgtatatataattatataattgtttcttttaattttgcaaattttaaaaagttctcctttgttttgaagtttattcctatagttttttatatgctagttaaattattaatcacttgattcaagtaatattcttatatacttataaggaatagtgtagttttaatatttaattccttgctaaagagagaagtggaatctatttttcttagctacttcatcaatattttatgtttgatgtgacagtcaaaatatccctcagagctaactgttacactagggaaatcacggttttccagttttccatttatgtgttatgggagggagtggaacttagtgtaataatattcaatacataaatgttaacacttgtttaaaggtccttgagtgagtactgctataaaatgcattattattgctagtgtcatttcacaagagcctataatttcagtgtgatagagctacaatataagtatagtattgcaaaaccatcaggaagggtgttaactatttagcatgcagttatgtgttggttgtcaaaacgttaaaaacatctctgactcagcagcaattttggcaattttgatcctgaggcatctgtgtagggcatcttcctggagaaaaacctctgagatgcaatgaggtcaaaaggggaaaacagactatgataaagatcaagttgtttggagatcttgtagaaagattaatttacaaatatgtcaagtgcattatcatggaggaaaacattgctatttctgttggttctcttcagagctctagaatcaatttaccacatagttgtttcagtgtgaaattagcattacagagtggctttacggctttactgtagggcattgtgtcagcaaagagcttaggcttcttttagcaagaagcttgtaaaaatttaatttactcttagattgcttgatgtagagaattacattcctacagagctctgaaaaatcttttttcagagtttttcacagctgtattcaagttgcaaggcttgtcaactttgctatttttctgtgcagctctgttaacttattattatcttttgacataaattatgattccaaattgtaaagctctggatgtcagggccttttctaatttgtttagtatgatattcagaccatttcaagactcttccgtggaacaatttaataaagatttttttgtgatgttaatgagttcatggtgatcaaccctagagacctgtgtctattgtagatcgatgacattcaacagtcctgcagtgctggcatcattttgataaaaaggggtcaaagcaagtgggactgtgggcagatttttaatgcttagaacaattattccatcgaagttttcttgtgtcccttctgccttagcctttgtaggatagcatgcttgctaatttcttgctcatggggtaaggaaatgaagatttttgctaggtccgtaggattattaggactactcaggcctgaagctatgcctggatatagccagaaaactctcccatagcttgctccaaggagctgagatacagcagtacttcctttgtaggtcatgattctgggtaacctggaagatgacctcattcatattctgtattctatgtgagacgttaagaaggtagaggtggccaagaaggaaattgttgctgcctttatggaacaaattatctgaaacccagctttctcgagggcttcattgaagtactcaactggggcacttaacccagtctaaggctggtcaaggaaggcttgctgggggaagtgtcttttgtattcacacctaaaggaggttattcaattagaattatccaaagagggtagggatgggctaggaaaaatttaaacaggtagtgtggaggactgacaggataagtaagcatggcaccttcaaaatatcctgagaagttccctatgacgggaacataaaatatgtgacagagatttgtgggagatgggtctggaaactctagcaggggccagatcgtaagggggctttgtaggctttgtaggctttgtttgggctttatcatactggaagtgaaaagccatggcttttaaacaggagagggacataatcagttcatatactgttgcagttttgtaaaagaaaagatgagctgaaagagtggccatggtggaggtgggtggggtgggggggagggggcggggagagagagagagagagagagatttgaaagacatttaggaggtaaaatcaactggtttggtaatcaattagtagttgaaggtgaaggaaagagaagagttaaggataacatctatatttgttgatttggataatagaggggacagtggtgctgcttattgaatgagaaaatttaatcggagaagaaggcatggagcaggagtgcagacctatgtgactctacttctctcaaaaccagaaacggaaatgatgtatatggctcagggttaggtaatatggttatttgaaaatgtattaaagtgatttagagcttagtcttaggtaagagatataagatgtctgaggtgacagttttataaatatgtagagtgcccacttgtttggccttattgtggcatagtgtgacctgagagtgttaggaagaagcagctgagttctagggacagtactggttaaattctacttagaaattatacttagaactctcctatataacctgctaactgatgtctgaacctcctgataacttcactcctttaggcagtgcttttcacatcacgggacacaacatatgagagatcatagaaattcaatgtggtatgaaaatctgcttgggacttcagatattgtctccagtgattgaataaaaataggagctcacctactatgatgaggtttctgtgtgtgttaaaagaaggttttcattacttttgaaaaggttatgtatccttgttttatgttaaaactttgagctttgttaaatatgcagagttctctttcttagcatggactacagaggtgcaactacctcctacctgacttcacatctactcccaaatgcctagtgaaggcttaataatttcaaaaagggactctagaatttcatttgataccagtcagacaaatgtgtgaaaattaagcataataggcagaatcccaggggtactgacagctgtattaagaggtgattcaagggctaaaccttagagtccagcattggttatgggtgtgacaagaaaatgaagcctatgttggctgggattagcaaccacagttctagaggaagcaaggtggagaaactatatagggggctccctttgtacgttttatttattttaaacatctctataaactctagaaattaaaacaacaataccaacacaaaagcatcactttttcgaccaaagaccattgctatacttttttgtgtaaagggctagatagtaaatattttcagctttgtgggccacataagtctctgcaatagacaatatgcaaacaaataagcatggctgtgtttcaattaaactttattatgaacattaaaatttgaatttcatataacttttacatgttgcaaaatattctttatttaaattctattgcaatatgctttaaaagatacagtttttagtctttcttagtttaaaataaaatctagaaaaaattttaagtcttctataactttttttcggtaactgaataattttaaaagtaagtgaaacatttagacatgcaaaatggacttttcagaagaagaaaatggtagcttaacagttattagattattgtccagaataatttttgacttataagtctctgttgaccatttcattgcctctttttttggaatatgcatcttttaatgtgtccttcaaggcaaaggctctatcttatctatcttgtgtcttgcattttcccagggcaatgtttttcacaatttttttaaaaaacaatactgtaatcaattttcaaataaaattttccatgggaccgcagtgtatacaaatagcagtgacaataaaagataataactctcccataaatacaaagaaacagttaacctagtgctctaaagtaaaggctacagtgattttgtataacatttatatgtaattttcttgatcctacatggttgtgtttttcacagtgttatgtttctgaaatcgagatgccttttataattgatgtcaaaagaaacttgtcagccacaaggcccaggaataagttgtaatatgggaacttagcaatacataaaggtatatatactcctgtgacctcagctgaattatttgcattggttgcatcccacaaggttgactcttaaataaatttagtttgttgcttgaaatttcttgggataaattactttgtgatgtagttttgaaaaaaaaacaggtaatatttagtctgaagtttgtctgacatactaagcaatgtaattaaagtagaagtcgcctaagctcagcactttattatgccttgaaattatactgcctgtcctacaggtgaaggtgttatgaatgcagtttgtcactgtaactctattcatagctctgaaaggctgagagtgactcagaagaatatttttgctctgaatatgaagaacgcttagactaaaactttaattacgatgctgaagaagaaagtggtaggtgattgcatgaataagtatgtaatattgttaatttctaaaaactgtgtatagttaatgtagtgcttctttttggaaaggctattgttaaattgatggtaaattctataaccaatatcaccttaaagcaagtacgcatgataaagtattataaaaccatgataatatcatatgtggcttattattgttccctgagtgttgtacaactctgttatgctgtgatgaaacctcatgcaaacaggtatgtcaaagatatgatgggctgttaactgagcttggcccacatatggtgtagtgacatgctcactaatgcagtgcagagataaccaataacagatcataacaggtttaaatatgtgcaaggagatgtcagcagaagctttcctacatagtgaatactaaacaagcctgacagcccaggatcatgttcggatcaatctagtgtgctaaaattaacatatagtcctacatttgagaatgtgtgattttcttggttcctgtctataaaataatattttaaaatacatacatttcaaatcagaagttggtgaattcactgaaatatttctagagaacactaggtattggggctcatagtgtgaaaaccactgacttaattcttcccccatcttggttgttcctgatcttcccttgtgtccccattccagccatttgtatccttagaaaatgatctcatattctacttcatctttatcttcattgtcaactgtcaggtagcaatatatgatggaagaagcatgtactttggaatcagacagacctggctggaatcctaactctgtcacttattaacaatgtgatcttaggcaatttacttaatctctctgaacctcagctactctcgtcagtacaatgagttatccttatctttacatggcacagtattattatgatatcaaaaattcattgagtatttactctgcatattagtcaaggttctccagagaagtagaaccaatgatacacacacacacacacacacacacacacacacacacacacacacacaatttattataaggaattgacttacatgattatgatggctaacaagtccaaaatctgcagtatgggtcagctggcaggaaacccaggagagtcaatgttccagtttgagtctgaaggcagtctgttggggaatttcgtccttctctgggaggccagcctttttgttctatacaggccttcaaccgattggatgaagttcacctttattagtgagggcaatctgctttaaccaaagtttactgatttaaatgttaatctcatccaaaaacacccacccagttgacacataaaattaaccatcactctctgtaagcactttctatgcattaagtgatagcaaataatgccagacatagggcgtctttaataaatggtaagcactgttatcagcaacaacaggattattataattagcaccttttcatctttctgtctgggctctgagaaagtacctctcttctctaaatttatccctcctttcctatgaattagacccagtgctttctctgaattatgaaggtcacactcctacaaatgccccttcccaattgcacatctgtcggctttctttgccattgacttttatctctagcttttaaatttacaggcatatgtcagttaacaatgggaatgcgttctgggtaatatgtccttaggcaattttatcgttgtgagaatactatagagtatacctacacaagcctagatgtcgtatagcctactacacacctaggcaatatgacatagtcttttgcttctaggctacaaacctgtacggcttgttactatactgaatactgcaggcagttgtgacacagtggtatttgcatatcggaacatgtctaaacacagaaaaggtgcactaaaaatactatgtagtgatctcatgggaccaccattgtatatgcagtctgctgtagactgaaatgtcatgcagtgcataactgtatcttaaatactcaaagtatcacctttgtttgtttgtccccttgtgtgcatcatcctaacgtggaatttctctgttgattagggccagcgtattagtttgctagggctaccataacaaaataccacaaatttggtggcttaaataacaggaatttattatcttatggttttgaagactagaagtacaagatcaaggtgttggcaggtttttcttctaagggccatgaggaagagtctattccatgcctttcccctaccttctggtggtttgctagaaatccttggcattccttgacttacagaggcatcaccctgatctctgttttcatcttcacatggcattctccctgtgagcctgtctctgtgtccaaacttctttactattaatataaggacaccagtcatattggattagggtctactttagtgacctcattggaatgttattacctctgtaaagatcctatctctaaataaggtcacatccttaggtaccgggggttaggactcaaacatacctttttttggggaaacacaattcaacctataacaattgataacactctttaggagcagaatgcgatatggaagtaatttgagaccataaagtatatacatgtagggagttaatctatgaaacctattgaaagccatatatacctcatgtatagtggtccataaatagcatggagacattgcagaggatgttaagtgatatgatacaggaacaatccaagaaggtcataagaaaaaggaccttttgctcttgagaggactgaagaatgactttccatttatgaaattttggtacatgtccactaaaaataggatgaaggccaaacttaggaagaatattttgataatggagaaggttgcatataaaaacattttattgaggacaattaaataatgttggctggaagttttaggatgatcatctttaggactcagaaaaagagaagaaacattattaaagaattgtccctgaacaagtataggcaccctcacatttgcattgcatttactatagaattgaaaaatgttttgaccttttttttttggcttttaatatatttgaccaagagtaacagctaagcaatacctatttgcaatcagtgtcatcatgtgggctccaaacatatcatgtttgtgtaattaattgattgacccattaatttgttcaatttctgctctgttccaggcactgaacaacatgatggagataaaagataaatattacacctgccttgtcctcaagaagttagtcttctgagggaaagaaattagcaaacaaattgtaatctcagttatgtgccatgttccatgctgggcacaggggatacagtagtttaaaaaaaacacaagatctataaggtgtttcttcttgtggaccttacagtctagggtgcttggaaacatggggcgttggcagacaagtaaatacacattttgtggtaaaggctcaggtagaagaagtacaggatagaatagagcacaccatggggaattaatctagacttcagagaggctcacacatacataatttatgtgtgactatttcaatgcatttgaggtttcttggaaatagaggttaggttttattttaaggaagttaccattttttttttcagtgtgatgtggttgaaccaaagaatgccatgcccagtgatggtaataggataatctttttaaaaattaagagccacctaataaatcaatagtttcattcagcgggagctcctgcagagttcaaaaagaagagaatctggcacagcgtttcctttaaagttcattttcctagagtgtgaatggaagcaagagattataacattttgaggtcaaaaaaattctgaaatgcctataaaaattattttctccaaattatcatcatttgtgcttttaatgacctgattgcaaagatgaacattttgaattcttaaattgcttattaggattggttaatgaatcaattatctattactgtatgttttgctattggaaaaaatagcaacttaagtgttttgcagacctttacttaggtatatgttgcttttatgaaaaaaaagatgtaaatattaagtaaaagggatttaaagcaaggcttttgaggtagagtcttattaattccttggtaaaccttgagccaattgttgtctatgttctctgcctctgtcttgctccttccttctgggattcactgtgggaatgcgggattgttaatctggggatgctgtccaatcctgcctctctcaagctttgctattgatctccctcccagtgataataaagcttgaagaaaatgaaagtagcgttagtattggtcctcaaactcaagaacaggatgaaacttaaatcttgagtcatacaattgtgtctacatactgctccccaaaaagagaagtaaagaagatgctaactttcccttttaatttgcagtacttagcaatttgttttcttgagggttaagtaataacagtggaagaaaaaagggttaaaatgccaccaagaacccaattccatgtttagtttgaaagtgggaaatcagctgccactgggaagtctgaatccaatgccatgatgttctttgaatccttctgagaaataatcatgtgtagccataacatacctgtataacagagcagagaacataaacaaatgaaggtgaagggaagattaagacagaagagaaaaattccagaatcgactgatcatttttatctgtttagatgatttcaggcagaatcctagagaccaactttatcacaactgaattttaaaaatcaccagctttgtcattgtgatgcagcatcagtttcagtattatccttggagtattaattcttaatcatcttcatcttagaacatttttgaggtcacttctagtctctatttcaccagtgaagaaacaaaaatccccaaactatatcaggtggaattacacagtattttttttttaattttggggaaagtcgattcaaggcagtaacttgcaagctagtgttagaaaggatttaataaatagtggtttttctgtacacatagtgagaggtcattacatcatttggttgttgaaagtcataaggatgtctagcatgcgctttgcctgtagtggttcatgccaggcagattcctgactcctataacccagagcttatcagagcatttatgtccccaaagagaaatgtcacctccatctttcaataaacactttagcaaagaaaaatcaagtactttaattccaaatcttgagttaattccagaataacaatgatggctcggaaaaatatgggtatttctgtcaaaggacagagaaacctagtagagagtatttactttgggtcctagtgatggtatctgaacaagctaggtgaacaaagagcctcaataagggattttgaggtctagaaaaagagaggaaataccaaataaatggaataattataaaataaataccagcaaagttaaatcaatatatcatgtgggagatatccttatatcactcatgtgatttctattttgttcctatattaggccaaggagaggtggaacttgttttcctttttccctctcagctacgaatggacatacttaaaactgtttctctgcttctgttctctaaaatgtgattgtctaacagtaaccgtgatgacgttttgacagttgcacaagtttctttctttaagctttaaaaatgccagccagtaacccagtggcatttctactataaaatcttaaggccaatccatttccccttttccttattttcttggtttcaaatatatttttattgccaatggaaataaaaatcctaaattagagagcaatggcatcccttgtcttgtgaataaagagctcctaaatgtgaacttatacaggatgcagcaatttatagggtagttaatcattcttctttctagccagttgttccagctacagttttgtggctcttgttagtggcttcattcccagatagaataaaaatcaaaccaaaatcctggaaaggcactctgaggatgcttctctaaagtagatgggcatcaactataaatcacaatgctttgtttcctctgttatgtttcaagatgggtgggattttttttgtagcattacttattattgcctctcaagtgcttgagtctttgaaatccaagtcatgtgagtgaattagatacagctgttagaagtggcctttcaatgccaatggtacacattccttggtttctttacgatactattgctcttacaacttttatctgaagtcataaattcatagttgtcccagaagttaagttccttgcttctagaggacagaaaacaaacaatttacacaactcatggtgcatgtcaccagtccttagatctcatgaaatatgcatgaaatcttaaatcacttgctgtagccacccagccattgacatatttgaaagactttagtgtatcaaagtcactataatgaaaattttgatttcaccagttctaggagtgaaaaatcaaatgtttagtaaaactttctaaaattaacactgacagttgatttctgtatactgttgttcttaataatagctttattgagatataattcatattcaaaacaacttacccatttaaagcatacaatccaatgattttttagtatcttcaaagagttgcctatcaccataaccaattttagaacactttcatcactgtaaaaagaaactccattcctattagcagtcattccttattccaaatccccctgctcgccctagacaactacaaatgtactttccatctctatagatttgcctgttctggaaattttatgtaaatagaacaaagtgttcttttgtgactggcttatttcacttagcattttttttcaaagattcatccctgttgtagcgtgtatcagtgcatcattcttttttatttttttagagacagggccttgctctgttgcccaggttggaatgtgcagtggcatgatcatgggtcactatagctttgaagtcataggcgaaagcggtcctcccacctcagtctcccgagtagctgagactacaggcttgcaccacatgactgtctaatttataattttctttagagacagggtcttgttatgttgtctaggctgctctcaaactccagggctcaagtggtcctcctcccacagcatcctaaagtgctgggattataggtgtgagccacagcacctggcttgcatcattctttttattgttgaataatatcccacttgtaagaatatgtattttatttatcctttccccagttaatagatatttcgattgttcctaattcttgtctattataaataatggtgctatgaacatttgtgtacaagtttttgtgcagacatccattttcctttcttttgggcatatacctacgagtgtaatggatgggccatatagtaactttatgtttaatattttgaggatttttcaaactgttttccaaagtggctgcatcattttaaattccttccaccattgtgtgagtgtttcaatttctccacatatttgcaacacttactattatctactcttaaaaattacagccatcctactgggcatgaagtggtatttcattgtgagttttttttttctttttctttttttctttttttgctaatgtttgtggattttcttttcattttcttgatggtgtcctttgaagcacaaaagtatttaattttgataatttccaatttattttttgttattgctgtttgtgcttctggtgttgtatctaagtgtatgctactttaaaaaattagttgtaatatggcaaattggatacatgtgtaggctttggtgtcacaatcctaattttaaaattctgactctgcccttgacaaattaactaattaagcttccttagcctcagtttctcaactgtaagttggagatattaccaagacctacctcttgaattgttgtggggatcagatgaaataatgtatgtgaaatatttagaattatgcaagtctgtggtaatgaatactaatgttagctatcattattgttataatcccaataataaattctggtgctttgaaaattaaaccaaagccaagcagttgatatgaagaagcatgtaataatgtacagacataatgctttatagacaacattgaatttggctctcatgaacatcaggaatagtggtcatggtagttattatctccagcaggaactgtagctgagagatcttcagagctttttccaaggcgatatcactgggaaataatagagacaaggttacaagctagggctgtgttttcttcttaaaatctttagttcagtttttttcaataacagatttgtagtaggcatcaggtgactggggattcgtattcttcaagttgaaatattaccttgttgagaaagaaaccatgtgtgagacaaccatgttgagaaagaaaaagtgattttatagaaaattaatattgatagtgagcattatatgaaaatcatgaagttagaacatatttggccagaaaatttacattaatagttacccatagcaattaatgcattataattacacataccttttctttaatgaaaaagaattctttccttccaaagttatgcatgctattgttaaacattagagaatatagagaagcaaaaaagaaaatatcttttttgatattttcttaacatacgtctgttcctaataatgtttatagtttagaagcattgcatgaaatgggtagatcaattttctatttaatgtttggattcattaggtacgaagttagcaaattaatttccattagggtgcctgtatggttgtaaatcctggacctgcagaagatttttcagtattggtttgtagtcttttgtttagcagcaaataattagttctccagagcttctgaaattaattgaccactttaatggtgtttacctacctagagaaagaaaaagaacttctccaagtcccttggtaaaattaagcctcatgaacaattaactcaaatatacacaaggcttgtctttagcgagcatatactccctaaagttgattaagctgaccaagtgattactgcttataaattcaccattttatggagaagaagcaaacactgctaaataccttgtggaatcagaggaggggaaattagtaacttgaccccaatactgcgattttaaattgaattcttgaagcctacaagttttacacaggactttagagagctggatagtatcactttgtcaagtcctacttttactatgattctttgagaaaaatacatctgactaaataactctgaatctaaattggataaaataaatgtgacattcaaaatgttatttatgattttagaaaaatatccttatagacactagatgagttttagtctcaaatcaatcctccctatcatagtcacttatcaaaataactaaagcaaagtggtagagctgtgctctagaagtttgggatttatgatcacaatcttttccaatgagtcccctctttcctctgcctgtcttcaacatttgtttttttttttttttggttaggactatccagattgtgtggcctatttcaaactcatggcaaatacattggatgatcagaaattttctaatgtatttgaatttgtctacacaaactagagtaattgctattaattcctcaagtgttaattatttcatgcaaaaaggaaaaaggctattagtctttaagtgtattagtatgtcaatatttgggagaagtgtcatgcaattagtggtttgaatttcctattttattttattgcattttattttatttgcctagtcaaataaaaagtaatgttaaatacatggaagcatgattgttttctacactaaaaatcattttgacttgaaaagatctgatatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtgtttaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgattaattagtttctgttagaaatagtcagaactaggctgggtgtggtggtggctcatgcctgtaattccaggactttgggaggccaaggcaggaggatctcttaagcccaggaatttgcaaccagcttgggcaggctggtgagatcctatctctacaaaaacaaacaaacaaacaaaggacaataagaaagaaagaaatagccagagctttgaacaaaatttctaagtagaccaatgtaaaagtctgtcgtcaatatgtagtggctatgaatggaggttatgaatgaaagagaaggataagatgaactagaggtgagaggggaagacagcaggcccaagtgaaaggcagagccgagtttattgctttttggttattccaggtgtgtctgctttgtctcatgaaacacctggatgatcactgatttctagtggaagaaatgctgaaaagtccttactgtgcatttaaacattctaggtttaatatactcagggtttttcaaaagaaagggtggctggagttttgcactaactaatatttcataaagtgtctaagtatagatgtctggtttttttttgtatttctaagactggcttgaggtaggcatggagaattctttgatgggacataattttcttcctttctttttttttttttttttttttttttgagacggagttttgctcttgttgcccaggctggagtgcaatggcacaatctcggctcactgcaacctccgcctcccaggttcaagcaattctcccacctcagcctcccgcgtagctgggattacaggcatgtgcccccatgcctggctaattttttttgtatttttagtagagatggggtttctccatgttggtcaggctggtctcgaactccttacctcaggtgatccacccacctcggcctcccaaagtgctgggattacaggcgtgagccaccgcgcctggcctgatgggacatatttttcattcaattttattgatttaacctcacaaaataaaatatttccttaagatgactctgtggtcattgttgggcagcataagcttaatggattttagttatcataatttaccttaaacccaatttgtatttcaggatataaatagaggtttattgtagtgaatcttccaggaaatactaagtgatactaataattatagatggtgaacttaagtctttatattactgaatttgtttggtttgatgatgctaggctatggcattcttgctaatcaaaacgatgtgtcatggtgtaacataacttattaaaatgggcacagataacacaggaagctttttataaaagcagctcacaaattgtgttactttgaactgaactggccatttatgggaaaggtcactgggttgtaaataaggaccaaaagagttacgtttatattttttaaaagagattgaggagatttatttttacatttcttgaaaatgccttattttggtatggtattgacagatagtgaaattctgctcatttgtaaatatagtgtcatattttaataatttcaaacatattgaaaatgcagaatttattaatagtgggagcacattttcctttttactaaatgttctacaggttcttttctttccatccacacacagtgccattaccctcattctaagcctttcaaacatctggcagtaagtgatctgctgcacttagctctttccagctgagctgatttttaaattttcagaaaatttgtgagctaattgttaaacatggccattattaaaaattaaattatttcaacttataattaaataaattatattaaaacaaaagtattaaaaactcaaaagttggctgggcgcactggctcacgtctgtaatcccagcactttgggagaccgaggcaggtggattgcctgaagtcaggggttcgagaccaacctgaccaacatggagaaaccctgtctctactaaaaatataaaaaaatagccgggcatggtggtgcatgcctgtaatcccagctactcaggaggctgaggcaggagaattgcttgaacccaggaggtggaggttgtggtgagctgagattgcgccattgcgctccagcctgggcaacaagagtgaaactctgtctcaaaaaaaaaaaaaaaaaaaaaaaagaaacaaaaaaaaaaaaaaaacaaaaagcaaacaaacaaaaaaacaaaaattatcacttcctaattattttgcattttactattatctatgctattaacgttatttgccttcattgtatttgaaaggtggactatattctattgcactttcattgtactatattctaatatgcaactgtgtatcccttcccaactctgtgttcaatgactttatatttggttgctttaaaatgatgacgatgagagtatttatatcatagaaattggcaaatgccgtaagtcagtttttgtttttgtttttgttttccggagaggggattgttaaatatttgcctgcatgcaacaccactacatgcagtctgctatcttttgttcttcctgctttcaggctcctctcccagctgtctgtctagcacaacccagcataccaaattttcttaaatagggaaagttgaacatggtaaaagaatgaatgaagtcaaaagaatgtggaaagacctaggctttgccatttagtaaagtttagcatctctaagcctccatctctttatcaataaaattgagcaatgatcccttttagttctacccatttaagaagattttcaaatgaaaaccacaacctgctcatgtttatgaaggcactttggaaagcgctaaatacacgggtttttattagtagtaaacacttacttcacctttttcacttcttgactttagtttacaagggctcataatctaaattatatcataaattgctgtcccagatttttttacagcctaattgccacctgtatgttcgactttccttctgttctttatgttagatactgggatagtatgcaccaggtgggtgtgccatcactttctcagatgatgtccactgaagaccttgcatgatcatggcattcattttcctgctgtattcagactggcctcaactattttctttattgctctccaggaaaaattacaaatgaatcagactgggcaatgaagggtaaacctaattatcgctctttgttaaagacagctcttgttaaaatgcggatattgcaaattaatggaaaaaatatgacatagtaaaccatactcacttattaatatcttagtaaggaataattgatgaagttacttaaccttagagccctaattcagttaagttttaatgaaggacaagttgtagagatatcgagaacccagggcaggtgcctactgaagaagttccagaccaaggaagtataaagaaggacctgggtgggagcagtgagattggatatgagggccactggcaaagttttgccccagaacagtgtcaaaatgtttgcatttggcatagccctttctctttttgttctgaatggctttgctagaatatcttttctataatgaatttatcctgcttctcagatattgctaaagcactcccttttgaattttggtgctttaacatgcattttgatacattaccaaataaggtctgaatgacacaaattttagaactctccagagaaaagaaagatgctgagggaaaaagcataggtttgggactcactaaatcccagttcaattcctttctttaataaatatattcaattttacctgagaaagctctcgtgctctcgaattttatttagaaatttctctttgtacatgattgatttcacaatccttcttctgcctcctcttctactttcttctttctagattttcctatctttatgaagattattctgccttatcctcaacagttagaaacaatatttttgaaaatcactacggtatcctgcatagtgatttcccatgccaactttactaatttccattataaattattatttattgatgcctagagggcagatgagtgtagctgctatggagtgaggagacaaaacataagaaagttatgatcctaccctcaggtaatgattcagacatgataattaagtcaacaaattgatagaaactaatcactaactctctggctatagtcattctttcaatgaatagctcattactgagtatgcatgctacagtaacaaaattatataaggctgttgattaaatgttgattaagtgcatgtcttattcagagtttttttatatttgaaatggaagaggctggacttcagtaatttgctataaactgctagtatatgattatttgggggcagttattttttaaagaataatttaaatatggaatgtttagcagtttgttttttccctgggaaaaaccatactattattccctcccaatccctttgacaaagtgacagtcacattagttcagagatattgatgttttatacaggtgtagcctgtaagagatgaagcctggtatttatagaaattgacttattttattctcatatttacatgtgcataattttccatatgccagaaaagttgaatagtatcagattccaaatctgtatggagaccaaatcaagtgaatatctgttcctcctctctttattttagctggaccagaccaattttgaggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagtttaattcttatatttaaaaataggagccaagtatggtggctaatgcctgtaatcccaactatttgggaggccaagatgagaggattgcttgagaccaggagtttgataccagcctgggcaacatagcaagatgttatctctacacaaaataaaaaagttagctgggaatggtagtgcatgcttgtattcccagctactcaggaggctgaagcaggagggttacttgagcccaggagtttgaggttgcagtgagctatgattgtgccactgcactccagcttgggtgacacagcaaaaccctctctctctaaaaaaaaaaaaaaaaaggaacatctcattttcacactgaaatgttgactgaaatcattaaacaataaaatcataaaagaaaaataatcagtttcctaagaaatgattttttttcctgaaaaatacacatttggtttcagagaatttgtcttattagagaccatgagatggattttgtgaaaactaaagtaacaccattatgaagtaaatcgtgtatatttgctttcaaaacctttatatttgaatacaaatgtactccctgggaagtcttaaggtaatggctactggttatcaaacaaatgtaaaaattgtatatttttgagtacctgttacatgccaggtagaatatctcctctcagccactctgagtggaaagcatcattatctctattttacagaaaagcaaactgaggctcagagagataatatactttgccagttaatgaatgatggagccatgattccagctgaggtctgtattgccttgctctctaggaatggtagtcccccccataaagaatctctcagtttcctttccaatcaaaaggttaggatccttttgattgccagtgacagaaacccaatttactagcttaagtaaataaaaggaacgaatttattggctcatgaagcctgaactatgtgaagacctaggtggagaactggccttaggaactcaatgggaccaaggactcaaatgccacctggtggcatttgccttatgctggttttattttctcagaccggaccagctttctacataaagtgggtccctggttagaactctttgctcctatctttaaggaccacgaaagaaggagccctttgtccttggctaaatgtgaaaaatcccagagactcttgagtcatagtgcttaccccttgggccactcatagtctagaatgaactaggctgagtctcgtgccaacagcacaggcctgatgccagataaaagggtgagtgaagggggataaaaaataagacatagctactaaattattgcaccaaagtaaaaacattgagttgacttgcaatttgtttcttttaattaaattcatttcctttttttggcattttgaaggcaaagtaagatattaaactttatttttattgattttattcaaagaattaagctagtgggagtagcagattcacacttctaagatcaagggccagcttctattattgaacacttggtgtgtgcaaatgccatgaggtagggatactttgttttgttttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggtattgaatatctaaatgtttgttgttgttgttgctgttgtttttgagacagagtcttgctctgttgcccaggctggagtgtaatggtgcaattttggctcactgcaaacttcgtctcctgggttcaagtgattctcctgcctcagcctctcgagtagctgggtttacaggcactcgccacaatgcctggctaatttttgtattttagtagatgtggagtttcgccatgttggccaggctggtcttgaactcctgacctcaagtgatctgcccaccttggcctcccaaaatgctgggattataggtgtgagccactatgcccagctttgaatatctaagttttaattggatgctgagggaatgattaatcagagtagggctgggttaattgaaaaatgtgatacatttgtatttatggccagatagagaacatgaatctgaatttgcagaattatctggcttaacatttttttctttccagttttcactgtatcccccatgttgattcaatttaaaaaatatacctattttacttcaattcaacaatgctatgccagtacaaacccatacgttctattatttttgttttgttttgtttttgtatctccaccctgttacttcttttcttataaaattggtatttgaaatttattgaaatattttggaagagtgacataccatttttggtactttgtacctctgcacccttgggaagtgaccctggcttcacatttcataactgccttgtgaccatggccctcaagtggttgccagatggttgaagaacattaacctatctggctcaattttgtgaccatggattgaatcctctacataactgcagtgtgcaaaccacacatccgttccaagattgtagtcaggatatgaactttttaagaataaaacttcttcccttctgatctgggcctggtatgtggtcctactagaaccacatcacctactcttggtgctaacaatttgtggcaccaagttgttcaagtttcacccattaaagaaattccccgaccttgccttctcctcaggtaactaccccattctattttttctttcatagctaacattctctgctctcctggtctctctacttcactttcatttacatctcagctcctgaagtatggtttccaccatgttcctaaaactacattgcccagggtcactagagacctcttatgaaatataacaacacctttctacattacttccgtgtggaccactttttcacattgaacccattttgttggtttatgtacacaccccttccttggctttcccatctgatccatttctcctttgatggagaaggtgagtctgctccatatttagcttcttactctgagtaaccaaatgttatggatgggaggttagctctgtgtgtgagagaaaggtggagaagcatgtggggagggaaatagatgggaaaaggtaattaggctttatagaagggctctcattagcaagcttctaggggatgccaagatccatgcttagagattgccaggcttgtcttcaaatctcagctgtgtattactcctttatgttttttgtttgtttgtgttgtttgtttttgagacagagtctcgctgtgtcacccaggctggagtgtagtggtgtgatctcagctcactgcaaactctgcctcctgggttcaagcgaatctcagtctcctgagtagctgggactacaggcatgcaccaccaggcctggctaatttttgtagagacggggttttgctatgctggccaggctggtcttgaactcctgacctcaagtgatctgcccgccttggcctcccaaagtgttgggattagtggcgtgagccactgccccggcctattactcctttagagtgatttagagccatgtttacttatggtaacttgacagtaatgggaataaccactgatgaaacgtaaagcctttgtctaattgtttacctagttcttccttgtggttcatgaaatttttcatctctgtacagtttgaaaattaagatgataatatttagagatattttattcctttgtgaagagaaaaaaggctttcattaacagaaatcagtggcaataacttaataaatacaatcagctggtgttcctatagtatttaaaagaaaacagaaagtttactagatttcagccagttttcagactatttaatgtctattcttactataatagaaaatatataatttgatcttgttctcatttttcaaagacctttaatacatgattttagtagttgaaaatgaagtttaatgatagtttatgcctctacttttaaaaacaaagtctaacagatttttctcatgttaaatcacagaaaaagccacctgacattttaacttgtttttgatttgacagtgaaatcttataaatctgccacagttctaaaccaataaagatcaaggtataagggaaaaatgtagaatgtttgtgtgtttattttttccaccttgttctaagcacagcaatgagcattcgtaaaagccttactttatttgtccacccttttcattgttttttagaagcccaacacttttctttaacacatacaatgtggccttttcatgaaatcaattccctgcacagtgatatatggcagagcattgaattctgccaaatatctggctgagtgtttggtgttgtatggtctccatgagattttgtctctataatacttgggttaatctccttggatatacttgtgtgaatcaaactatgttaagggaaataggacaactaaaatatttgcacatgcaacttattggtcccactttttattcttttgcagagaatgggatagagagctggcttcaaagaaaaatcctaaactcattaatgcccttcggcgatgttttttctggagatttatgttctatggaatctttttatatttaggggtaaggatctcatttgtacattcattatgtatcacataactatattcatttttgtgattatgaaaagactacgaaatctggtgaataggtgtaaaaatataaaggatgaatccaactccaaacactaagaaaccacctaaaactctagtaaggataagtaaaaatcctttggaactaaaatgtcctggaacacgggtggcaatttacaatctcaatgggctcagcaaaataaattgcttgcttaaaaaattattttctgttatgattccaaatcacattatcttactagtacatgagattactggtgcctttattttgctgtattcaacaggagagtgtcaggagacaatgtcagcagaattaggtcaaatgcagctaattacatatatgaatgtttgtaatattttgaaatcatatctgcatggtgaattgtttcaaagaaaaacactaaaaatttaaagtatagcagctttaaatactaaataaataatactaaaaatttaaagttctcttgcaatatattttcttaatatcttacatctcatcagtgtgaaaagttgcacacctgaaaatccaggctttgtggtgtttaagtgccttgtatgttccccagttgctgtccaatgtgactctgatttattattttctacatcatgaaagcattatttgaatccttggttgtaacctataaaaggagacagattcaagacttgtttaatcttcttgttaaagctgtgcacaatatttgctttggggcgtttacttatcatatggattgacttgtgtttatattggtctttatgcctcagggagttaaacagtgtctcccagagaaatgccatttgtgttacattgcttgaaaaatttcagttcatacacccccatgaaaaatacatttaaaacttatcttaacaaagatgagtacacttaggcccagaatgttctctaatgctcttgataatttcctagaagaaatttttctgacttttgaaataatagatccataatatatattcttatggaaatctgaaaccatttgggcatttgggggtaaaaagtattttattagtaaatttaaatgaggtagctggataattaaattacttttaagttacctttgagatgatttttctcaatcagagcaccacccagagctttgagaaacaattttattcacagcttctgattctatttgatgtaatttttagaaaataagttttgctggttgctttgaatcagggtatggagtacagttcactctgatcctatcatataaatcatgtaagtatataacattttcaataagtgattgttggattgaagtgaatgatatttcaagtaattgttatgtcatggccaagatttcagtgaaactcaaaatttctcctggttgtgttctccattgcatgctgcttctattgattaacctaagcactactgagtagaagctggaagaggggtctaattagaaggcccctttctatgctctgcttggcttgtaaaataatttatttctctagatcccaccaacatagtagtttcatgtatgcaaaaacacccacctaaatgtcaaagtttgtatgatacatggacatatctatagaattttttttggtctggtgcatgccaaaaaataaacatgatatagaagaatttaatatttattgagtacctaatctgttccagttcaatatgaaggtctttatgcagattattttacttaattttcctagtaactccatggagcaaaaattatctctaatttatataacaggaagttgagcgtgaggcaaattaagtaactttcccaaagttacacatatggtaagtttgagagatatcccagtctctttagctccaaagcctttgaccctttcaccataccagattatgattgctattaatatataattataattataatgattgtatttaggtactcaacagaatggtgactctagtaaccagccttggttctgctgagcttctctgcgtcttctcaggagacacaggctacagagcttgaaggctgaggattcttccagggtcacttcaggggcaaatctgaaactttcttcaggacaggaatcaacgagatcttctcacttacttatacctgggggaggaactgtatgaaatccacccaagaaccagtcatgctaagggccaaacctatagacaaaaaaagggataggagaatggagtatgtatggagaaagactaaattgttcttaaacttctcaagcttaaaaatatcccagcaaaagagatcgtaaaagcccttcatggcgtattaattatccatgcatgggggtgagtggaaaggtactcctgagcccgaggctacagctttggaactagcagcacctttgaaggggaaagcgtgtttccatcatctcaactcctactgataaccaatggaatattggtgagtaaaggatcctgggggaagaagcagctgaaatgtgtaggtgagaaggcagagagaagaatatttatattgggaatggcacaagtgtgatgaggctgcaggtttttcacccttgtcatagagaaaaaaccacgctgacaccatgcagttttaaatagtgagaaatttgcaaattgttagatcttaaataatttagataaacatagtggccatttagattattgcagttttttcaggatatctgatctcttgatttcattctttttgtctcttataagaataaaagggggggagaaaatttagccattatagtatttctctacattttctctgtccttttacataacttacaccagtgccttcctatttatggtattatttatgggtatttcttcttttctttcactgagcaaggataaatgagccagggattcttgaaactactgtaacacttctcttagaaatagatggtcatactttcagaatctctacacattcttagtccctctaaacaatgatagttgtggcataaaaatatttgcttggtttcaggactgatagagaaaagtactataaaatttgctgttaactgtgaaaggttaaaaaaaaggaggtgccatcatgaaggagctaatctttctgaagtactgctgtagttttaaatattattagctatgacttctcaccattaactatgcacttgctttttcttcatctgactcagcagccagatagatgcaacattgtctttaacatttaagactcctagcaagtccgggcacgggggctcacacctgtaatcccagcactttgggaggccgaggtgggcaaatcacaaggtcaggagtttgagaccagcctggccaatatggtgaaaccctgtctctactaaaagtacaaaaatcagccaggtgtggtggcgtggtggcgggcacctgtggtcccagctacttgggaggctgaggcaggagaatagcttgaacctgggaggcagaggttgcagtgagctgagatcgcaccactgcactccagcctgggtgacagagcgagactccatctcaaaaaaaaaaaaaaaaaaaaagactcctagcatggaagagaaactggctgttgaaaacctgaatgtgagagtcagtcaaggatagtttgagggaagccaagtagaggaagctctcacaagcagattggtgagagaatatgattatacaatgcatttattatgataagaaattcacaagcattcattcaaaatactcttgattcctaggcagctctgggcatatttccaccaacaaattgaggcatatgtcagtgcagcctaggtcagactaccttttttcattaaacctcacaaaattaaaggacatacaggagaagtcctggtactcatgttgcagactacagtctatatggcaaaggaggatctctgtcccttatgtttggatgaaaacattgggtaggcatttgaatacaagcctactgctaatatggggctaaggtctttggccccctaaaggtttgctgaaatattactgacaggaggcagattgataagaggaaaagcacataaatgtatttgacatgtatacatgggagccttcaggatgaagacctaccctctcagtgcagtatggaagcttgtataccatcttgaggttacagaaagaatgggggtttggatctttgtaaaacaggtttcagtggcaagacaggttatgagaaggagaaaggaagagacttgggtagcaaagggggtcttgttttgtaggtaaatcgttggcagcccacagagaaaatagatggagaatgtttcttttcagaccttggcaggtgtcagattctcagttaatctctcctagatttgaaaaaaaaaaaaaaggtctagaaagggagagcctggctgcactaacacattttctacagatgcaaatttctcccacaaaatacagctttgcaggtccacttctatctgctgggcctgtggcaaccatttcaaaatatgtgaatgaaatatatgtgggggtaaactatttttatttacttccctaaagaagggatggtgttctctcgggaattctgtgcatagagagcctgtggcttaggcactttgatttatgtatatctcttcctgtgattggctatctagggactgctatctccagcaaatcttctaaatgtctgccatgtagaattcctttctcatctttctgtctcacccccttatctagctgcttctctaaccctagagtgacactgcactccccacaatctcctatgtcctgaatattttaccccatcctaaactccatctctaacacagatgcactttcttgtgctgcctactgcattgtacatcttccccttagttcccatgatgcaactctgccctaccccagaaaatgtaatttaattggtctgggataaaacctgggacactatcattcttgaaatattccccaagcgattctaattatatagccaaagttgagaactatttgtagacaggcatcagcatgatcacttaatgatttgacttttgctagatctaaggtgaggaaattggagagtggtatccataggaagaactgtttagtttaattttttttttattttttcttctaaaaaaaaatccaacaacgagatacatgtgcggaacatgcaggtttgttacataggtataatgtgccatggtagtttgttgcacctattgacccatcctctaagttccctcccctactccttacttcccaacaggccctggtgtatgttgttcccctctctgggtccacctgttctcaatgttcaactcccttttacgagtgagaacacatggtgtttgattttctgttcctgtgttaatttgctgaggatgatagtttccagcttcatccacgtccctgcaaaggacatgatctcattcctttttatggctgcatagtattccatgatgtatatgtaccacattttctttatccagtctgtcattgatgggcatttgggttggttccatgtctttgctattgtaaatagttctgcagtaaacatatatgtccatgtgtctttatagtagaatgatttatattactttgggtatatacccagtaatgagattgctgggtcaaatggcatttctggttctagatacttgaggaatcgccacactgtcttccacaatggttgaactaatttacactcccactaacagtgtaaaagcgttcctatttctccacagcctcaccagcatctattgtttcctaacattttaataactgctattctgactggcatgagatggtatctcattgtggttttgatttgcatttatctgatgatcagtgatgctgagatttttaaaatatgtttgttggccatgtaaatgtcttttgtgaagtgtctgttcatatcctttgcccaccttaatagggttttttttttcttgtgaatttgtttaagtgccttgtaaattctggaaattagatctttgtcagatggatagattgcaaaaattttctcccattttgtaggttgcctgttcactctgatgataggttcttttgctgtgcagaagctctttagtttaattagatccaatttgtcaattttggctttttttgcaattgcttttggcattttcctcgtgaagtctttgcccgtgcctatgtcctgaatggtattgcgtaggttttcttctagggtttttatagttttgggttttacatttaagtctttaatacatcttgagttaatttttgtataaggtataaggaaggggtccagtttcagttttatgcataatggctaggcagttttcccaccaccatttactgaataggagatcttttcctcattgcttgtttttgtcagatttgtcgaagatcagatggttgtagatgtgtggtgttatttctgaggtctctgttctgcaccattggtctatatgtctgttatcgtaccagtcccatgctgttttggttaccgtagccttgtagtatattttgaagtctggtagcgtgatgcctccagctttgttctttttgcttaggattgtcttggctatatggagtcttctttgattccatatgaaatttaaaataatttttttttattctgtgaagaatgtcaatggtagtttgatgggaatagcattgaaattataaattactttgggcagtatagccatgttcacaatattgattctttctatccgtaaggacgacactttttccatttgtttgtgttctctcttatttccttgagcagtggtttgtagttctccttaaagaggtctttcacatcctttgttagctgtgttcctaggtattttgttctctttgtagtgattgtgaatgggaattcattcttgatttgcctctctgctgcctgttgttggtgtaaacaaaattcatttcttgttcttatttgtgaaattttggaaccaaatctattttcaaattagaaattgcttgtgataatggttttgcaacttagactggatatgagacgatgagatattagttctttcattcctttgtaggaatatggtgcatcttgcattattttagctaactagtgtcctttaatgactaatgaatatgacatggtgaaacaaagtaaaatatatatgatgcactaagtatgcattgtttccaaaggttcagcattttttttttgttaactctgctgggatctgctttatgcactgataacataacttattttatgatcttaagcaaataaaaacacttatctggacctcagtttccttaactgtacaactgagggaaactgtatagtatagctatagtacagtataccatctttaccgtcacttccatcttttaaattatgtgtatataagatagggcctagataaatggtatttatcttaaattacagtgatactagcttataacttaatttgctaggtcatgttgaactgataacaatgtgtgaactgatgagcaactgagaagtaaccaggttgtgttataacagtttgtttttgatttagggttatcagtgagggtggcggtggggaggggactttggagtctaactgtctagttcaaatattagtttttgtttatttttatttttaatttttgtgggtacatagtagatgtatatatttatggggtacatgtgatgttttcatataggcatgcaatgtgaaataagcacatcatagagaatggggtatccatcccctcaaacacttatcttttgagttaccaacaatccaatgacactctttaagttatcaaatcacagttttgccagctactagccatgtgattttgggtaggttacttaaattctcttcatctcaatttcattattgtaaagtggagataatgatagcacattttttctttttcttttttcttttattttttattattatactttaagttgtgtgatacatgtgcagaatgtgcaggtttgttacataggtatcaacaactctataaaacatgttctatccaggaaaagaaactatcatcagagtgaacaggcaacttacggaatgggagaaaatgtttgcaatctagatggcgattgcaatggcggttcgctgcatccatcagcccatcatctacattaggtatttctcctaatgctatccctccccttgctccccaccccctcacaggcccctgtgtgtgatgttcccctccctgtgtccatgtgttctcattgttcaactcccacttatgagtgagaacatgtggtgtttggttttctgttcttgtgttagtttgctgagaatgatggtttccagcttcatccatgttcctgcaaggacatgaactcatccttttttatggctgtatagtattccatggtatatatgtgccacattttctttatccagtctatcattggtggacatttgggttggttccaagtctttgctattgtgaacgctgcagcaatgaacatacataagcatatgtctttctagtcaaataagttataatcctttgggtatgtacccagtaatgggattgctgggtcaaatggtatttctggttctagattcttgaggaatcgccacactgtcttccacaatggttgaattaatttacactcccaccaacagtgtagaagcattcctatttctccacatccgctccagcatctgttgtttcctgactttttaatgatcaccattctaactggtgtgagatggtatctcattgtggttttgatttgcatttctctaatgactagtgatgatgagcttcttttcatgtttgttggctgcataaatgtcttcttttgagaagtgtctgttcatatcctttccccactttttgatggggttgtttttttcctgtaaatttgtttaagttccttgtagattttggatattagccctttgtcaggtggatagattgcaaacattttctcccattctgtaagttgcctgttcactctgatgatagtttcttttgctggatagaacatgttttatagagttgttgtgagaattaaatgcattaagcacatagaatagattctggtacatagcaagtgctctctctatatatggaactctatatgtagttggtgcaaaagtaattgtggttttcaccattgaaagtaatggcaaagaccatcattaccttttcaccaatttaaatatatggaaggaatatatatataaaacctatatatatatgtcacatatatgtctctaacccattattataatatataatacaatatatattataattataattgtatataacatatgttatataataatatagtaatatttattctaaataaatatataatactataaataatataataatttatatatatgattataatatataataggctatattatatattattaacatatacatatgtgtatatatatgtctttcatagacttaaatatatagagcaataataggttagaaaatagcaaacatgtatatataaacatatatacatatagaaaacatatataaaaacatatatatatatatatatatgtgtgttttctgcctttcatttttagagacagggtctcatcatgttgcccaggctggtctcaaactcctgggctcaagtgatcctactgctttggactcccgaagtgctgggatttcagacatgagacactgcacccagtccagtccctgtctttttaaatagactctctacctaagtgcacaaatactcattatttacatttagttatttctgtatatatgctataagcaaatcttgtagcaccagtttgatttttataaggcacaagaatatattttactaatgctttaaaatggcagctagattctagtattactttagaaattaaaattaatattttaacacatctttcattattgtgttatctgaaccaaacctattattgctgctatttcagcaaatccaggggctttttcttataaaatatgaagaatatagcttagatttctagtgaagatgttaccagtaataattaataaaatcagtaagcactaaaaggaaaataccaaaactaaagcattttgaattagtcattgaatctaaaagaaaggtagatttttttctgagattctgttctaggtgtggtatatgtgtatttttgcaaaaactataaacaattgtggcaaaatgaaggaaatatttaaaaacaaacctcttaattcttcagtggattaagcgtgaatatgtttttattttctatgatgaatatggaaaaattcatttccttagcaatttgtatgagcccaaaaactattgtcagactctgctgtatcaaaatagacaaaaaattgacactcacttttaccctgccaaaagcaaaatcttaaacttttgctttagtatataagccagcattcattgtatcctatgatgggttctgagtgtaggtgtatttgctttcttccattttttgtatgcatgttttctttttatttattattgtaagttgtatgaaatttttatccaaatttttattttcttctgattaataatcagaataatcagataattactggtaaatttgatgttaatccttccagctttttcccatgggaatttatacttaataaaggggagaagtcatcattacataatgtgcatattaatctgcttctccctttaatgtgttgtgaatgcctttccatgtcattagatgtttttctacctagttactttcatgaatcatatggctgtaccatgatttatttaatcagttcctcatcattgagtatgtaaattgcctccatttttttattactataaaaggtccttcagtacacacccctttaaaagctgactcttagaaggtgttcttgactctctacctaagtgtaaaaatacaaataaattgctttccagaaaaggtgcactactattttactttcctgatactaaactatgaaaattcagtcctaacaatagatatttaaataaagttttaaaaatgccaagtgaaaaagagcatattattattttcatttgcattacttttggttcctggtgagtttaatctgtttttgtatattaattatgcatttatatttctttttgtgtgtgtgaattgcctttcatgttctttgtgtgtttttattttgttgtatttgtctctttcttgatatatgagagaatattttccctagcctgtcaattgccttgtaattttgtttctagtgagtttttttttttttttttacaattaaaagctttaatttttgaaaattttgctggcaaatctatatatctttttctttgttttctgctttgacattattcttttataaaggcccatgccacccaaatattatgtaagcatgcatctatgtttttattacttcatcttttacatttaaatatctactctatttagaattcattgtgatgcatgtatgaggtagaaatctaatttcaaaaagatgagtatccagtttgtccatcatttattgcatgatctctttctccactgaattaaaatgccgtattttataatatattaaagtattacatgtgcttggacatgttcctggacttttgagataaatcagtctatttctttgtcatgtcacatattattatggctttatgatttaatatccagtaatgtaaaccctctgacacattattcttattcctcaaatgtttttgatgagttttcttccaaatgaaatttataatcattttattcattgattcaacaaatatttgttgaatggatattctgtgcttggtattgtgcatggtattaggattgttgcaaaaattgagactgacagtccctactcttacggtgctaaaaattcacttccaaaaaaatctttaaatgttgatgaagattgcactaatcttataaaataacttggaggggaatgtaatctttgcaacattaagttcttcattttagaaagttttaagactctccatttatttgagacttttaaaatatgtcccaataatgttttgtgagatgtatattttaagatatatatcttattgctattacattgtatcttttgttatattgttactatgaatgggatactcatttaattagatgtcatttttggtatatagaaatctattttcttagcatagtcattttttaaacctcgatctattaaattcttgattcatttacatttgttacacaatcatattctatgctgataatacttcttgcttctttccaatatttgtacctcgatcatttttcttgttgagttgtattagctagaagttctagaaaaatgttaaatggtagtaatagctagtattctgttttttcctgactctaaatgtaatgcatctagacttttataattatggcattgattgtaacattttgaggaagaaatcctttttcaggttaataatgtatctttatattcaagtttattaagaacatttattggaaacatattgaaattttatcagattccttttcagttgttactgagataatcataggttcttctgtattcttttaattaatttctcaaaattaaactgtcctattattcttggaataacgacatataaagtactgtatatttaaaagaagttaaaatgataatggtgattttattaagtgacctcacacaatagaaaacagtgtagccttagaagttttccaagtgaccattctacttagaaacaaccctgctttgggatcagaactgtaatttttaaagtaaagttttctgggtttaattcatttagtgtaattacaagcatgagttcaggtttctatttttttcacctgaactttccttcatggtttgaatatctagaaaaagcagactttcctatctctagactaaacatttgatcctatcttaggtatgcattacaattttttaaccataaatggttaaagaatttagactcatctacaataactttgaagctctggtcttgaagaacatgtgagaaatgagatataactcctagaagatataggagacatttttagtcttccaaattttccctgggaggctgatctaaattgagtcacaaaattgttcccaccaggaatgcaatcacttgagctgttttctaatctgagcccctctacccagatgatcttctgaactcatactgttcagactttcatccttctgagtagaaaacagccatagtcatggcaggatgagggctaggacaattacccaaggaattcttggcctctgccatgggactctgcagactcagatcatataatcagagatgttagcactggaggggacatcacaattagctttctccacctcttagtttatcagtgaggaaaactgtccagagcgcggaagagactaaaataacacagccaatgtaggtaatgtgctggataagaatttggaattcacgattttgaattcagtgtttatttcaccatcacgctggcttacacgttggtatcaggcttcttctattattgaagtgagccattaagtgaattccatcttgatttgtgtctgatacagagtaataaactattttattaaatatccaaataattatacattcctccttcttacatgcaagcctaagtttgcttgtactatttcatgtggtagcaaatcaggacgcttcttgtgtctctgaaaatactctgagtaatggagtacagtcagctttcttgtaccaagaatatagggactatgtttctcccagtcattctggggataatttttgtgaaggattgcacttcataggttaagctaggtatcagttaccagtgttttttccaaataaaaaaaaaatcaggtgatatctgtaaatggttccattgtaaatattaaagaacatgatgcttaaaacagattagggaaaactatagaaggggtggggtttcggagtgctaattttgtccttgaatggtaacagctccatgtggtggtgaggtttatgttggtttgctgtttgcagatgatcttattattagaatttttcataccgaaaataaactgcattttagtttgtaaacatgcccttccagagtaatgctaccagttctttgtgaaatagctactgttgttcaaaggatgactatgtcctcttcggttgaggaaagatgacaacaaactcagtaatgacatgtaaaataggtattacaaaccaggtatggtggcatgagcctgtaatcccagctacttgagaggctaaagcaggaggatctgttgatctatggatttgaggctgtagtgtgttgtgatggcacctatgaatagcccttgcactccagcccaagcaacaaagcaagactgtctctgaatttttgttttgttttgttttttgtttttttttttttgagacagagtcttgctctgtcacccaggctgaagtgcagtggcgcgatctccactcactgcaagctccgcctcctgggttcacgccattctcctgcctcagcctcccgagtagctaggactacaggcgcccgcctccacgcccagctaaattttttgtatttttagtagagacgaggtttcactgtgttagccaggacggtcttgatctcctgaccttgtgatcctcctgcctcggcctcccaaagtgctgggattacaggcgtgagccaccgcgcccggcccctgtctctgaattttttaaaaaggcattccactcaaattaatacacattttaattgtgttttgttgtaaattacaactgaataaaaattcagcaaataagtctgttgtggtagggaaaagtctattgtgatctggaaaatataatggagaaatccagtggaagagattttatttcacattactcaaaataaaaaaatcttatacaagtctttacacttgtaacttgaaaaattctgtgctaaaatttagcttggttgctaaaatatttctctttttttctcagaagcttctttttagcatcctatagacacaagttactttttaaaatatttgcatacttgctttgcaatgtattgtttatcagtagttctatattctttgagatagtctatccagtctttctgtatttatcgtatgtctgtatagatatatattagcagataaatgagttctgaaaggggagaaatgtgattatgctaatcatgatataaagaattgactttataagcagtgttcacaggtcatacctttcccgttactgtcttacagtgaacaagaaatgatgctttgtctggtatgcatggtaaataatgccccttgctctctgcttcatgatcacatgtgatacttctaacatagatagcacatgtaaatccagtggccttgactgcaactcaagagagcattttggccaagtacaaacccactagtcatgaaaaaaaaaaaaaaaccaaatcaaagtaaattgatggtattgacatttgtctatgaaaaacaacataatatagaacaattctggggtaaaatattgatctaaaataattttaaggattaaatattgccattgtaagcatactatgagcaattatgtttgtaatgcagatatatttataattttaaatccaagatttaccttaattgtacattttcctaatttaaaaaagttattttgaaaaaaaaatcctcgaatctagagaaaggttggcaaatacatatggaactttgtaaaaaacatccagggcagcactttcactgattgcagtagcttaggagtgaaaaacaacacaactgctccaatgtatggcaatgggcaaatatcccgatttattcacagggtggcatgttaggcagtgcttagaataaatgagttggttatacaagtatcaatagggataaatgtgaaaaacacagtgttaagtttttaaaaagttgtaaaaagcacagtaggatgttatttatataaaatttaaaaacctcaaaaaccattcttctttgatatatattctaaagatgaacatatatgtaatagaagtacaaaacatacataaaataatatacactatgcagtcatttgtgtacttacttttcaaaaatatttcagtagatatagcaaacagttaacatgtaatatttggataggaggttggcaattttctttttagcacctgcctgtctgctatcattcaaactcacatttaaaatgtggctatgtgagatgagagaactataatattccaggtttgtgattagtttggaaactttttaaaagtttgaatgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtactggttgttcctttccaggtttagcgcttccttcaggagctcttttagggcaggcctggtggtgacaaaatctctcagcatttgcttgtctataaagtattttatttctccttcacttatgaagcttagtttggctggatatctctcagaccacagtgcaatcaaactagaactcaggattaagaatctcactcaaagccgctcaactacatggaaactgaacaacctgctcctgaatgactactgggtacataacgaaatgaagacagaaataaagatgttctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacttctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcatagaattggaaaaaactactttaaagttcatatggaaccaaaaaagagcccgcatcgccaagtcaatcgtaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggtattaccattcaggacataggcgtgggcaaggacttcatgtccaaaacaccaaaagcaatggcaacaaaagccaaaattgacaaatgggatctaattaaactaaagagcttctgcaaagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacactactcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaataggaaagacttggaaccaacccaaatgtccaacaatgatagactggattaagaaaatgtggcacatatacaccatggaatactatacagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataaaaaaaaaaaaaaaaaaagtttgaatgttttcttgcattcagagccttggttgacatagttaattaaaaataaaacattgtatataaagcacagaatgagcagctacacaaagctgctcaatcaatgacagctctatatgggttagggtttcttgtggggatgacattgatgtagaaagcatggtcatctattgagaatgatggggctggaggtattggatacttgaggtttagaaaatacattgtagaaaatggacaaaaacccctcaaattaagggatgaggcagaataatgcttggcaataccaggggtaggctgcagtctttcttggaaatatatattttaaatggaaccaattatcatagcatcatttcctctcagggttaccctctgatccctattttactaaatcgttataaaacaaaatgaggaattatgtgtccttcccttttgaagccaatgtaacaagatgggtaagaattagacctcctgagttcaaaatccctggattcagatctattcctgtatattcaggagaagtggtaataaattcgatggacaatttggtttagtagtcgattgaggaccctgatgaggtatatttgggaaaacataacttccgctctctctcattgactcacgggcctttgaggagtccaggagtcattggaatctggcctgaggttgaggctgctggcaaaactccttccccaaagtccattcctattgctgactgagaagggactagcattggaagtggctgattttaaataccgctagtgctggtgtgctcctccctcccattcccagctctgctttgtgtagttgccttgagaagctaagttcattctgaaaataatgccattgcacaaaacacttttgaaagttctagtttgaaattacatcaggtcacttggtctgtgtggcctcagtttcttcatctgccatgtgaaaataataatgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaattgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaatgttttatttcaatctgaacattttacgtaagtgaagactttgttagatatcatttggaatgtggaatctacacagttggcatatcagagaaggttgaattcagtttaataaatgtttatagaaagtgcttgttatcataatgataatagctcaggatgtgcatgacaagcttttaagcgattgggtacactatctcatttgatcttctgcacaactattaatggtaggtactattatccctatcttatggataagtaaactaagatttaaaaagtacagaacatggtgtgaacactgcttcaaaatttctaaaataggtaaatcacgatctctaaactggagggttgtccaaccactagggacaatagagtactgatatttagtggtcagactgtaatgcgggaagagacaggcatgggctaaacgggtgtagagatcaaataaggggcaggttagtttgtaaacatgtccatatgtaacatttagcacaaatacaggatataggtgctttcagacccagctgcattgataaaaagttaggtggtattgtatctgtcttcctttctcaatgttgcatatctgtgttcttgcccagtttgcttcatctctctagccacacttattggcctacaatggcatcatcaccaaagaaggcaatcccatctccgtgtggctttggtttgctccctaaagtaaaccttgtgtttacttttcccaggtctcatgctttcccatatctgacctgttttgtcctcatggccaggatatgtgggacctttcctacaatgttccaaagtttgtaatagagctcttctctgctttgttccaaattctgcaacattttactttaaataatgaatttaaatacaaacaaacttgagctttgcctatacttttcaagaatgcagagataactaaattaataaaaatattcattgagtccttactgtgcacacagctctatgttaagccttgtgcagaactcaaagtcactcgagattaagcctgttactaagttatgtgcaatttagctcagtggatttcccccacttcatattgctctgataatgttttggaattaactgccttgattccttcttttctctgcttgtctatacactatttattattctacaccatctcaaattctaactcctcaagaaaatccttccagatgatttttctaaccaggagttttaacttccttttaactaccctattactttctacttccttaactcatctatcatattatatttagttatttatatactaggtcgccttgaagaagggattgtgttttcataaatcttaataatccctgaggcatcaagtacagtgatttgcatttactaaatgctcaacaaatatgtgagggattcacttgaaactaatattagataattcccagtcaaagtgatctaatagcaaatcaattcttcagttttataggcaaagtatgactctggttttccataatcataattaatttgtcaactttataattttaattaagtaaatttaattggtagataaataagtagataaaaaataatttacctgcttaactacgtttcatatagcattgcatttttctttgtaaaatttaagaattttgtattaataaacttttttacaaaagtattaattattcagttattcatcatatacttttattgacttaaaagtaattttattcaaaagagttagtataggactacatgaaaaattcaaggccaaggcttaatttcaaatttcactgcctttggctctatcttttaaaacaaaacaaaaaactcccgcacaatatcaatgggtatttaagtataatatcattctcattgtgaggagaaaaaataattatttctgcctagatgctgggaaataaaacaactagaagcatgccagtataatattgactgttgaaagaaacatttatgaacctgagaagatagtaagctagatgaatagaatataattttcattacctttacttaataatgaatgcataataactgaattagtcatattataattttacttataatatatttgtattttgtttgttgaaattatctaactttccatttttcttttagactttaaagctgtcaagccgtgttctagataaaataagtattggacaacttgttagtctcctttccaacaacctgaacaaatttgatgaagtatgtacctattgatttaatcttttaggcactattgttataaattatacaactggaaaggcggagttttcctgggtcagataatagtaattagtggttaagtcttgctcagctctagcttccctattctggaaactaagaaaggtcaattgtatagcagagcaccattctggggtctggtagaaccacccaactcaaaggcaccttagcctgttgttaataagatttttcaaaacttaattcttatcagaccttgcttctttttaaaactttaaatctgttatgtactttggccagatatgatacctgagcaattcttgttctgggttgtcttatgtgaaaaataaattcaaggtccttgggacagataatgtgttttatttatctttgcatatccattacttaaaacagcattggacccacagctggtacaaaattaattactgttgaattgagcaaatatttattctaaatgtctctgtcaaatgacagagtgtggttgtgtggattaagtccctggagagagttctttgttctctcatgttctatgctgtggttcttgctttatgcaaaaagaagtaagttacttaaaacctggacatgatacttaagatgtccaatcttgattccactgaataaaaatatgcttaaaaatgcactgacttgaaatttgttttttgggaaaaccgattctatgtgtagaatgtttaagcacattgctatgtgctccatgtaatgattacctagattttagtgtgctcagaaccacgaagtgtttgatcatataagctccttttacttgctttctttcatatatgattgttagtttctaggggtggaagatacaatgacacctgtttttgctgtgcttttattttccagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacaggtagcaacctattttcataacttgaaagttttaaaaattatgttttcaaaaagcccactttagtaaaaccaggactgctctatgcatagaacagtgatcttcagtgtcattaaattttttttttttttttttttttgagacagagtctagatctgtcacccaggctggagtgcagtggcacgatcttggctcactgcactgcaacttctgcctcccaggctcaagcaattctcctgcctcagcctccggagtagctgggattagaggcgcatgccaccacacccagctaatttttgtattttagtagagacagggtttcaccaggttgcccaggctggtctcgaatgcctgacctcaggtgatccgcccacctcggcctcccaaagtactgatattacaggcatgagctaccgcgcccggcctaaaaaatactttttaagatggtgtaaatattactttctgtatcaatggtacattttttacttgtcagtctctagaatttctttataaatatgttgattcagttcatttttgtagattataaaacaggtaaaaaaggataaaacatttatgtgaattaaagggaatacctaatttttgtgtagagtttattagcttttactactctggtttatggatcatcacaccagagccttagttactttgtgttacagaataactaatatgagtgaatgaatgacttacacaagtcactgcttaggataaagggcttgagtttgtcagctagagtatgacagaaagtatctaagttttggagtcaaatagcactttgtttgaatcccagattgcatgcttactagttatgtgaccttagtcaagccacttcacctcactgagtctttgcttttttcatctctaaaatagagatacccaccgctcataggctgtcataagggatagagatagcatatggaatgagtctgtacagcgtctggcacataggaggcatttaccaaacagtagttattatttttgttaccatctatttgataataaaataatgcccatctgttgaataaaagaaatatgacttaaaaccttgagcagttcttaatagataatttgacttgtttttactattagattgattgattgattgattgattgatttacagagatcagagagctgggaagatcagtgaaagacttgtgattacctcagaaatgattgaaaatatccaatctgttaaggcatactgctgggaagaagcaatggaaaaaatgattgaaaacttaagacagtaagttgttccaataatttcaatattgttagtaattctgtccttaattttttaaaaatatgtttatcatggtagacttccacctcatatttgatgtttgtgacaatcaaatgattgcatttaagttctgtcaatattcatgcattagttgcacaaattcactttcatgggctgtagttttatgtagttggtccagggtgttattttatgctgcaagtatattatactgatacgttattaaagaatttcctacatatgttcactgctgctcaatacatttatttcgttaaaacaattatcaagatactgaaggctgattggtaactcacatggaactgggagagtatacaattctgaaccaaatagatgattctctattattatatcttaatttatgtgttatggtatattaaacatgaaaaaaattgtatttggttagaatatgtttgctcttccttaactcgggaatgacatagggtaatattcacagattgggttcctataaatcctccacttgaagtgaagtcagttcaagtaatgaaagctacctcctgagatagaatcagtacttggcacctatctctagtgttctttcacctcatataacctttcactgattagtaaagattatatccaacaaagaaagtacagcacagactgagatatgattactgagataaatttgggcaaaatataaactacagcatttctgtagcaatgagaccatttttcttcagttgagctccatgttctacaaacttcaatcaaaaaaggttctaggagactcagtgaaagttgatacactgttcaaggaacaaataatttcagcacatgggaatttcacagggaaaaatatactaaaaagagaggtaccattttggatggtgtcaatatgggttatgaggaattcaggctgctgagtccagtgtacaatggaaactgagctgcaggtgtgtgattgtaacaacaaaagaaatgctgaaatattaagtcctttgccatgtaaatagaaaaagagtatttatttcccaaacattattgctcacctgtttttgttatgcctttcaagataaatccaggaaaggaattgcattttctttccagaaaacaagttcttgggggaattgttcaattggtagatgttgtttttctcattaacaagtgagtgctccatcacacttgctgagtgctccatcacacttgctctctgcattactcctctgcctgcaaacacatatatagcaagggtgatgacaaggatatcagagggtctggttttctcaaactcatgataaactcatggctgggtcattcttggtgctgattttactttgttttttgttgttattgttccctcttcctcaaaagatgaaatctatccctcttacttggaatttctctttgatatatagcgaatgtttggttgtaacctgtataatctggcatgaaattgtcactcgaaaaggctagaagtgttgacataaatatgggacagcaagagttgctcctactcaagagagcaaatataatgttctggaagagattggcagaattcacatcaaaggagtgattacttcagcctgggccactgttgtactggtcaaaaggctgtgcaaagctctctgaaaatccactcttttattgctctttagtaataaagtcactttcaattttaaaaataacaaactgatatatttttatgactcataaaatgttagcaattatattatggagaatctactttctgggtgattcttacaaatgttcttggatctatttttttttcttatagtacctattcttcccatttttctcagctctagttaatatatttcaacaacagttcaacaaatttaacatttttataaaaagtgtttcctatcattttataaataccagcctagtccatgttattccttttcttgttgaggagaaaggacacacattgtaaattcaaatatagacctctactgtgctatttaatcttggtaacaactccacaaaggagatgacatgttttccttctatagaggtagattctgtaaagttagagggaagagtgacttgcttaagatggcataagctgtaactggcagaaccaggattcaaagccaggtgggatgccaaaatcataatctgtcttcagtgtcaagttactgaaattggtaaacattagacctaaatagacggaattgcaatccgggttgggcacattaaactccattttcttcatcaatgtgctcagattacattttacttttcaggctaaaaatggaaaaaaagagtccctcttagttctgcacttgagaatgagaatagcttttctgaattatacaaggaagaagaactaatgcccaaatgccaggtacccacatgcactatgccatggcacagctgttgccccctttcaccagagccctctctctgtatcctggttgacctttccttgggcaagagctgggtggggaggatcacaagtgactccaatttggatggcttcgggaagactgggaccgagctgaaggcagtgttgtcctctgcactccctgttttctgtctgctggagcactgaagcctcacatatgtattaaaaaaataatttccatttgcatttcagactagaagattgaacgtatagtgtaatgtgattgcaaataattatattgaaatgagacagagaggatgtagtatctactgtcataatttttcaaaacccacctgcaacttgaattaaaagaaccacttgggtttttttttttgtttcaaacgcaaatcctggaaacctactgagactcattcagtcagtatctctaagaggcaagcttgagactgtatatttaaaaagcatctcaggtgatttttacacatgctaaggcttaagaaccacttctctgtagcttatatgttattttcaatgttcctcaaagccaagttagaatttccaaagtgttaagaatccattagacaatcacagaattgtctttttcctttataaatcttgcaatgttgttctcatttccatacttaattacttaaaacaccaaccaaccaacaagcaaaaaatgattagtctaactaatattacaagttaataatgaagtaaaggtttaaaaataatgtcataataatgttaataacaaattattaattataatttaaaaataatatttataatttaaaaataatatttacaagtactacaagcaaaacactggtactttcattgttatcttttcatataaggtaactgaggcccagagagattaaataacatgcccaaggtcacacaggtcatatgatgtggagccaggttaaaaatataggcagaaagactctagagaccatgctcagatcttccattccaagatccctgatatttgaaaaataaaataacatcctgaattttattgttattgttttttatagaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggtaatgtaccataatgctgcattatatactatgatttaaataatcagtcaatagatcagttctaatgaactttgcaaaaatgtgcgaaaagatagaaaaagaaatttccttcactaggaagttataaaagttgccagctaatactaggaatgttcaccttaaacttttcctagcatttctctggacagtatgatggatgagagtggcattttatgccaaattaccttaaaatcccaataatactgatgtagctagcagctttgagaaattctaaagttttcaagtgataagactcaatttatacaaagctaattggataaacttgtatatgattaagaagcaaataaatacttattatgcttttttgctgtttatttaaatatttaacccagaaaataagtcactgtgacagaaataaaaatgagagagaagggtgagccactcttaggtagttctggcattatttaatctaggccagaggttgcaaatggtgtcccatagaactaattttggctcctagacctgtcttatttaacctttcatttaaaaaatttgtattggttgccagcaattaaaaattgggagatgtctcacacacacacacacataaacacacacactcatgtgtgcagcctcttttgaagaattggaataactagtcaactgcgtcctccttttccacaagctgtgacagctccctgctcacagagcacctgccctctcctgttcatcatgctctcttctcagtcccattccttcattatatcacctatttggtcctgagactaagtgagtttgagatctgtgatttagacaaagtggtgaatctagctctgaatcatagtaagtagctctgggaatcatcttgtcttctgttagcccattgagagagaaatagagagagagagagagagaaagaaagaagaagaaacagatctggggagagtcactgaatgggagcatagagacagagaaacagatctagaaaaccaaactgggagaaaatgagagaaaccaaaagagaggtagagaggagcagagaagaaaatgaagaagcaaggcaaggaccaggctttttcattatttcttatggccaagacttcagtatgcgtggacttaattcttccttatgctcctaccttccctagggaaactgatttggagtctctaatagagcccttcttttagaatcacagtttgatgccttaaaactagttatataccttcacatgcttccttaacccacagaagtgatgctaatgaggcccttaataaggagcgtgctattaagatgaagacattcattttttttctccgtccaatgttggattaaggcacattagtgggtaattcagggttgctttgtaaattcatcactaaggttagcatgtaatagtacaaggaagaatcagttgtatgttaaatctaatgtataaaaagttttataaaatatcatatgtttagagagtatatttcaaatatgatgaatcctagtgcttggcaaattaactttagaacactaataaaattattttattaagaaataattactatttcattattaaaattcatatataagatgtagcacaatgagagtataaagtagatgtaataatgcattaatgctattctgattctataatatgtttttgctctcttttataaataggatttcttacaaaagcaagaatataagacattggaatataacttaacgactacagaagtagtgatggagaatgtaacagccttctgggaggaggtcagaatttttaaaaaattgtttgctctaaacacctaactgttttcttctttgtgaatatggatttcatcctaatggcgaataaaattagaatgatgatataactggtagaactggaaggaggatcactcacttattttctagattaagaagtagaggaatggccaggtgctcatggttgtaatcccagcactttgggagaccaaggcgggtggatcacctgaggtcaggagttcaagaccagcctggccaacatggtaaaacccggtctctactaaaaatacaaaaaattaactgggcatggtggcagatgctgtagtcccagctgctcgggaggctgaggcaggagaatcacttgaacctgggaggcggaggttgcagtgagctaagatcacgccactgcactccagcctgggcaacaaggcgagactctgtctgaaaaagaaaaaaaaataaaaataaaaataaaaagaagtggaggaatattaaatgcaatataaaagctttttttatttttaagtcatacaatttgtttcacataacagatcaggaaataatacagagatcataagttttggagctgggtttgaatcctggctctgccatttactttctgtgtaatctaagtcaagttactgaactttgtgggccctctggctctccatgtgtaaaatggagaatattaatatttaccttgcaagtttgttgtgaagactgaaggagagaatttaggtaaaacattcatcagagtaccatgcacacagttgttcctcaataaacattagcttctctgattgcaagttccagtctaaagtgctttatatataccagccaataaaaggatgcgagagagatataccagtgtattgttttctaccattttaaacctattttcatccactgttacaaattctatcatactgctccacataaaaaatattatcaatgatttttagtctctgaagtgcaatatttgattattgagcacacctgttgaagttttagtttcttctcacttacatgggttgtgtaaaggtaggaggtataaaaccagtgtcctaggtctaaatctttcttaatgtcatactttggattcattgatataagtaacttgagcaccagcgcttcattttacttcattttttaaagatatagtaagagtaattcccatctgcctagcaaaattgttttgtagaaaagtttgtggatcagatttattttactttgattttaggaatttcaagtgtcttcgtcggcatgaaggaaaaatatgcagtttgacattttctactactttcaggtcattattttcctactctggtgcaaaaaccctcaattcctgtctcactccatctaatcaaataggtagcatgcttgagcccttactatgtgccaggcactaggataagcactttatatgttttgtcccaattaattctcacagcatttctatgacctaaataaaattaatattttcatttcaccaataataaaatggaggcttcaaaaagtttagggacttggctcagctcacacaactggcaaggactgaaaatggattttagtcccaaatgtcataggctagagccctttcactaaactgttgtcttccatctggtggcatcctcttcctccagtctttgtcacctaaactctgggcaccccttgatggcatttacttatgatggtgatgcttgttaaacttcctgtttgcgacttcaacgtccatataaatgagtcttccaatactgtacttagaacttatattttgtagtgacttctttaaaagctttctctcttagtcatatcctgagttttgttagcacctggacttaccttactttggaaatgttgcactctgaaatctctttctcagcttggaatttcctaatcttccaactgtttgagtcttttaattctacatttactgcctttccatttcatcaggatttctagtctctttaattcttccttttgaactcctcctgatttaacctctgcttattcgaagaacaataattttattctctcagctgcactctcaattcccttttccttttggtgatttttctttttcctacagaacacttactttatcagttttggagaaggaagtgctatctgggtaacagtagtgctatctgttgactctagtcaactgtaagttttatacatttattgtttaaaccttatatgggtctataatccttcttgggaaatcctttcatttgtctttaatttcctttaccatttccctaaaggctattccagatttttatcacattcacaaaattcccgtcttttctcaggatctgttcacccccagtagatagccttgtctcccacaatacatggagaaaatagaggccaccgtcatatttgaatgtttccaacttctctcttcacctttggaattatctttttcttcttttgtgtctaagagaaagatgtatacttcttcttacccttgtctgaactactctattttgcttcatcttctcagaacaggggaccagcaattattcttcctccagaagcttcaacatcttttgtcaactgactccttctcatgtttaaatattttcaagttaaacaatttctttcctgactttcgctcacgcaacctcatgcccaaaaccttatcactcttcttccctttgctgtcaaggctgttctcacttcttcactttttgtggacttctccccactacaacatagattctgctatcaccaatctattaaaactgttatactcttgtggaatttatcatttaatttagcttcagtgaaccgttctttccagattattttggcctcagaccatgacttctaagtctgccgtgcttgccacttaagtgatgatgggccagtgggtccccacctaggcctctgtgttagtctgttttcatgttgctgataaagacatacccaagaatgggcaatttacagaagaaaggggtttgagggactcacagttccatgtgactggggaggcctcacaatcatggtggatgatgaaaggcatgtctcacatggaggcagataagagcatagaacttgtgcagggaaacttccctttattaaaccaccaggtcttgtgagacttcttcactatcacgagaataggatgggcaagaccctcccccatgattcaattatctcccactgggtccctcccacaacacatgggaattatgggagctataattcaagatgagatttgggtgaggacatagccaaaccatatcagcctccttctggctttttatgttctccgtgggtgacctctctcaggctcaagtgataaccaatgtgctgatgactctcaaatgcgcatctctggcttcagtttcttccttgaacttcatacatatgtttccaaatttcctgcgtgtacctcaaggttcttgttcatcacttcccaagcttcataaacgcactcattttagtgtattctctgtctcctttgatagcatccctgagaggcaagtccctggtgagttatatacaactcctcccttgctccaaacctgagagtaagtaacattcctattaacatattaggaagctgaggcttagacagtttaagtaactcaagcatggttacacaactagctagggcagagctaaaatgtcaggctaggcttctgtgactccaaagccctttctcacttagcatatcatcacttatttttttttttaatcacatatatgatttttttttctttaagagatagaatcttgctctatcacgtgggctggagtgcagtggcacaatcatagctcactgtaaccttgaacttgggctcaagtgatcctcctgccttagcctactgagtagctagggctacagacacacaccaccatgcctagctaattttattttattttattttattttttgagacagagtctcactctgtcacccaggctggagtgcagtggtgcgatcttggctcactggaacctctgctgcccgggttcaagcgattctcctgcctcagcctcctgagtagctgggattacaggtgcctgccactgtgcccagctaatttttgtatttttagtagagacggggtttcaccatcttggccaggcttgtcttgaactcctgacctcgtgatccactcgcctcggcctcccaaagtgctgggattacaggtgtgagccaccacgcctggccacctacctaatttttaatttttttgtagagacagggtctcactacgttgcccaggctggtcttgaactcctgttctcaaacaatcctcctgcctcggacaccccaagtgcagggattacaggcatgagtcattgcagctgacctgtatatatgatttttagtatatgtaaatatacatatttattaaatgtaaatataaatataaatgtgtggagtgatatccattgaaatgttaaacatagttctcagtggtacaactacaggtgatttctcttttcttatttctggttttctgtgttttccaaatttcttgaaatgtgtcttctgtaatcagaaataaaagttattagtaacaacagtcttccactggtacaagtgcttattggataaaagtcccacttctaagcatgatactcacaacttttaggttaatagcctttgtcaccttgccatatacatctgatccagccactcacaccattcctgagatatattttgttcctttgtgcctaaatcattgtgcatgcagatccatcttcctggaacacctataaccatttcttagtcctgtgaaatcctacttacatccttcatagcctagcatgtatgtcatttatttggtcaagggtgagttggttgttctcttgaatgtactgccatatgacgtggtgtgatttcaattgtagcaccaagctcattgcaatattaattcgtttgtcattctcccatgtaggatgtttgaagtagtttctaacacagagattatactcaataaatatttattagataaataaatgaataagggaataacaaatgcctttgtctcattttaaaatactttcattgttagctacccatataataaaaaactaaaagcagtagttttcaagcatgattgtttatgtatgccttaaaagaattttgaaaacctatgtacccctgacacacttttaagttaacttataaatttttcaacatagttttaagtggtggcaaatgatgtagtttcttgtgtattttaaactgcttaagtatgctatacatggatttcttcaaaaccctgaagctgcagtttcagtgcattcaatttatggaaaagaaattaatttataaaattggttcttattgtcaagtcaatcagctaaatataacttgctttctgtcaggaaaagtctgactttaaaatacagataagtaataactattattaattaattaaattattaaaattaaaataattaaataatttgttaattaaaatgccttattcccctacttatttctgcaatttgactctaagaatagataggacatgtagattgccttaggtttgaaatctgggtgaaataagatactgcctccttcagtatttctgcctttgcttttatgggagcctctttcaagaaaaagtcattctctcatggtccctttgtttgagtcccagaggttttcctactccagaaagtgcaacgtagtgagactagtactatactcccttgcatggtaagtgagaaggctgtctgtataaaatgagggaaggactcatgagagggaagtaggtcaggagaaatgataggttctcaggcaggttaattttaggaaagagtgaatagagtcccttaaaacaaggtgcatctgcttcctcctgatcaatctttaggactgtttactttgatttgaagaccactatgctaaagcttcccacgggggcaatagtgaggcaaggaatttttaaaagggaattacttcttcgtagctacttttgtgaaatgaattcatttgaattatctggcaatctcttcatatttatattcaacaataattacttaaagaaatgctttgagcttctcagaggagggtgctaccagtgtgatggagtagaattcagatttgggtagtgactttaaagctgtgtgactttagtcatttaactgctgagtcacagtctacagctttgaaagaggaggattataaaatctatctcatgttaatgctgaagattaaataatagtgtttatgtaccccgcttataggagaagagggtgtgtgtgtgtgtgtgtgtgtgtgtgtgtgtatgtgtatgtatacatgtatgtattcagtctttactgaaattaaaaaatctttaacttgataatgggcaaatatcttagttttagatcatgtcctctagaaaccgtatgctatataattatgtactataaagtaataatgtatacagtgtaatggatcatgggccatgtgcttttcaaactaattgtacataaaacaagcatctattgaaaatatctgacaaactcatcttttatttttgatgtgtgtgtgtgtgtgtgtgtgtttttttaacagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaaggtagttcttttgttcttcactattaagaacttaatttggtgtccatgtctctttttttttctagtttgtagtgctggaaggtatttttggagaaattcttacatgagcattaggagaatgtatgggtgtagtgtcttgtataatagaaattgttccactgataatttactctagttttttatttcctcatattattttcagtggctttttcttccacatctttatattttgcaccacattcaacactgtatcttgcacatggcgagcattcaataactttattgaataaacaaatcatccattttacccagtcttaaccagaacagacattttttcagagctggtccaggaaaatcatgacttacattttgccttagtaaccacataaacaaaaggtctccatttttgttaacattacaattttcagaatagatttagatttgcttatgatatattataaggaaaaattatttagtgggatagttttttgaggaaatacataggaatgttaatttattcagtggtcatcctcttctccatatcccaccctaagaacaacttaacctggcatatttggagatacatctgaaaaaatagtagattagaaagaaaaaacagcaaaaggaccaaaactttattgtcaggagaagactttgtagtgatcttcaagaatataacccattgtgtagataatggtaaaaacttgctctcttttaactattgaggaaataaatttaaagacatgaaagaatcaaattagagatgagaaagagctttctagtattagaatgggctaaagggcaataggtatttgcttcagaagtctataaaatggttccttgttcccatttgattgtcattttagctgtggtactttgtagaaatgtgagaaaaagtttagtggtctcttgaagcttttcaaaatactttctagaattataccgaataatctaagacaaacagaaaaagaaagagaggaaggaagaaagaaggaaatgaggaagaaaggaagtaggaggaaggaaggaaggaaagaaggaaggaagtaagagggaagcagtgctgctgctgtaggtaaaaatgttaatgaaaatagaaattaagaaagactcctgaaaggcaattatttatcaatatctaagatgaggagaaccatattttgaagaattgaatatgagacttgggaaacaaaatgccacaaaaaatttccactcaataaatttggtgtcaggctgggtgcagtggctcacacttgtaatcctagcacttttggaggcagaggcaggtgaattgcttgagtccaggagtttgagaccagcgtgggcaacatggcaaaccccacctctacaaaaaacacaaacaaaagaaaatagctgggtgtggtggtgtgtgcctgtagtcccagctacttgggaggctgaggtgggaggatcacctgagcctgagaagtggaggctgcagtgagccatgattgcaccactgtaccctagcctaggtgataggctcaaaaaaaaaaaaaattggtgtttgcaatgctaataatacaatttggttgtttctctctccagttgttttcctacatacgaaacagcttttaaaacaaaatagctggaattgtgcattttttcttacaaaaacattttctttcttaaaatgttattatttttcttttatatcttgtatattattactagcagtgttcactattaaaaaattatactataggaggggctgatactaaataagttagcaatggtctaaacaaggatgtttatttatgaaaaggtagtaattgtgtttcatagaatttttaaaattaattctgcgtatgtcttcaagatcaattctatgatagatgtgcaaaaatagctttggaattacaaattccaagacttactggcaattaaatttcaggcagttttattaaaattgatgagcagataattactggctgacagtgcagttatagcttatgaaaagcagctatgaaggcagagttagaggaaggcagtggtcccttgggaatatttaaacacttctgagaaacggagtttactaactcaatctaggaggctgccttttagtagtattaggaatggaacactttatagttttttttggacaaaagatctagctaaaatataagattgaataattgaaaatattaacattttaagttaaatcttacccactcaatacaatttggtaatttgtatcagaagcttaaaagataacctaatagttcttctacttctataacttacccaaatatgtttgcagagatcttatgtaaagctcttcattataacactgctttcaggagccaaaaattgggtgggggagccccataaatgttgaataataggggtttgattagataaattttggtgtagttctataatggcgtgttattcagccaataaaaggtttgttaaagaatgactgtgacggatgtatatgatatactcttaagtgaataaagagttacaaaatgttatgtacaagttacaaaatgtatgtacattatgatccatttttcataaaatcatatgtatgtatatatgtgtgtctggaaggataaatttatcaagttgttatctctgaaattttgggtatattttatatttctagattttctgttactttgttactttactgataaagtaataacgttgttgacttttgtcactctcccctattaataatcatctaggctgcaaaaggatcatgtcttctttatttttatattccaaggactgtcaacaagtgcctagcacttgacaggtatattatagaaatttaactgaatatctttaggaaatagatttttgtttgtagttgttctagtctacattaaatgtcttgcgcttatgaaacttccttgaattattttagtgaagcaatattagtatagaattttgcatcactggatgcccttgactgaaagctggcttatggcatctcaccagtgtgtggggagtttcagtccttctgttgtctgcatcacagctgaagcagtgctgttgctgacaattcctgacaccaccttgtctctattattgatcattgcctcactatggtactgagttttagcttattcttgtaataactgggactcatatgtatagaataagctattagctcacgtttttgcttgctttttatacagaatacatgtctgcaaatagttttatcaatattttggaattttgggagatatgaagttaaaaacatcattgaatatatatatatacacacacacatatatatatgacactatacatgatttattttatttaatttttaaaattttattctttttagagattaggtcttactctgtcacccaggctgaacttcagtggtgtgatcatagctcactgtaaccttgaactcctgggctcaattgacctttccgcttcagcctcccaaagtgctgggtttataggcatgagccactgtgtctggtccaatatgcatatatatatttttaacctggattatcagagctatattgtgtttaggtttataaagctgtactatgtgaaaatatcacttctaggtttaattttgtacaaaggaattttatatagaaatgaggtaattcagattttttcccatgtaataagaattgtaaaatttactgaaacaaacatcaaaaagatatctgttacatgaccttcctttcttttgaatatatttcaggtgatattatttattaaaatttaaaaatgaaaattaaaatatataaaaagttgaaaattattcctttctttactgtctctcatctgtccattttccattctcctgcattccctcatccaaccaaggtagccaatccaggtaactttttttagtatcttcccagagatgtttctctctatatatataatcaatatacattttttattattccccacctctctttttatgtaacaatatgcagagttttgcttcttgcttttcccactatcttggacaactttccatattcaaagcacagaggacttgcacatatgttcagactgctgaatatttctgtctctcccctgccattcatatgttgaaatcctaattcccaaggtgatggtattgcagggtggggcctttgggaggtgattagtccatgagggtgaagtctttagtaaatgagattagtgtctttataaaagaaaccttagagagaccctcacaccttagagagaccctcacccctttctgccatgtgagaacacagcaggaagacagctggctatccaggattcaggagtctcttagcagacccaaatctgctggcaccttgatcttggacttcccagcctccagaactgtgagaaataaattcctgttgtttataagccacacagttcatggtattttgttatagcagcctgaacaaggacacacacacacacacacacacatgcacacacatttaaatagatgcatagtattctatcatatggatggatattctatgatataatgaatcactattgattgacatttgggttgtttccaatattttgttaacacaaagaacaacactacaaataactttatatacatatcatttagcacatctgcaattgtatcagtaggcttcctataagtggtcaagcatttgtgtacttgtgattttggtagatgttgtcaaatgtccttccctgaaatttgtaccaattcgtactcatgccatacactctaaatagagtgctgatttccccacagcattactaacagatgatattatctaatttaaaaagtttctcatcttatagggaaaatagtatgtcaatgtattcttaacttgcatttcttttattataagtagtgtaaaatatcatttcaacttatacacaggaggaatttctctctatataaagtgatcctagaatcataatgaaaaatatcaccaactcattaggaaaatgtacaaaggattgaatagatatctcatcaaaaataaaaatataagtggcctttaaacattgaaaggtaacatttgaacaaagacttgcaggaggtgagggattagggaatgcagactctgggaagagtcttccaagtagcaggtgaagcaagtgcaaagctttcagatgggactgactatacctgtctggtttgaagaacagtaaggaggtcactgaggctggcatagagtaagacagggagggtagaatactgtcagagaagtaatcggcggtggaggtagggggtaaaccataaagtgctcgtaaagactaaggcttatttctctgggtgagattagaggccactggagagttttaaacagaagtaacagggccactttggctaatgtttttaggctattctgtagggagacaagggaggaagcaaggagatgagttaggagtctattgtgccagttcaggcaagtgatgatggtggcttgatccaggtagtagtggaagtagtatagtaggaagtgatcagattcaggacatgctttgaaggaagatccaataggattaatggataagttgaacaatggcatatgagaaaagtcacagaggagtcaaagatgattccaagctttctggactgagtaactggaaggataaatgtgccgtttactagaaagataatgggagaaacaggttttggatggagcttggtttgggaatattaagtttgaaatgcctatttgacatccaaatagagatgttagttggatgtacaagtctagtttcaaggaagagggggctggtagtgtgaagatggggctggataagattctaaaggaaagagggttgataagaagagaaaggggtgtaggggttagcctaagggcattctaagtattagaggttaaggaggtgggtgaagaaaacccaataaaataaaagtctgagaagacaaagctagtgaatgaatgtggtatcccggaacccaactgatgtcaagcagaagggtgttatcaactaggtcaaatgctcattcatcaagtaagatgaaactgttataattaaccggtgtcttctgaaatacggagataactcgtgacttaatgaaagcaatagtagagaaggtcaaacttgaccagaatgaaattagaaagaataagaggaaagaaaagaccaaatacagacaaccattgatgccttattcttttgatatactcctggagtccacttgctaatacaattgacccttaaacaatacaggcttgaactgcatgggtccacttatttgtgaattttttttcagttaatacattggaaaatttttggggttttttgacaatttgaaaaaactcacaaactgtctagcctagaaataccgagaaaattaagaaaaagtaagatatgccatgaatgcataaaatatatgtagacactagcctattttatcatttgctactataaaatatacacaatctattataaaaagttaaaatttatcaaaacttaacacacactaacacctaccctacctggcaccattcacagtaaagagaaatgtaaataaacataaaaatgtagtattaaaccataatggcataaaactaattgtagtacatatggtactactgtaataatttggaagccacttcctgttgctattacggtaagctcaagcattgtggatagccatttaaaacaccacgtgatgctaatcatctccgtgtgagcagttctctctccagtaaattgcatattgcagtaaaaagtgatctctagtggttctcgcatatttttcatcatgtttagtgcaatgccataaaccttgaataacatcaagcaatccatacaaagtgccactagtgatgcacggaaaagttgtaacagtacaagaaaaaagttgagttgcttggtatttaccatatattgaggtctgcagctacagttgcctgcaatttcgagataaatgaacccagtataaagactgttgtaacaaaagaaaagaaaatgtgaaaccatcagtgcagctatgccagcaggtgtgaagtcttgcactttttgcaaaatacaaaatatgaaatatgtgttaattgactgtttatgttatctgtaaggtttccactcaacaataggctattagtagttaagtttttgtggagtcaaaaattatacgtggatttttgactatacagtgggttggcacccctaaccttcatgttgataaagggtcaatggtatattatttaatttttttgtatttatattcataaataagattaaatctatatttccaagtaatctctataagattttgttattaatattactattatttttgagacagagtcttactgtcaccaggctggagcacagtggtgcgatctcggctcactgcaacctctgcctcccgggctcaagcaattctcctgcctcaccctcccaagtagctgggactacaggcacgcacaaccacactcagctaatttttgtatttttagtagagacggggtttcaccatgttggccaggatggtattgatctcttgacctcatgatctgcctgcctcggcctcccaaagtgttgggattacaggcatgagccactgtgcacagccattaatattattgttacccaataaaaaaaatttggaaacttgtcttcttttcccctgattctgtttaaatagcactggagttacctgttttgaattttttttccaagcggtcccttatgagttttctctatgttttatttgtttcatttcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtttcatttcttatatcgtatttttgcaactcctttattgatacttttcttcctgattaggtttctactaaaaccaaacaagctttccatgaattagcttttagatttacttattagtttaactgttctgttgtattgtaactcattaatttataattttatctttattaattattctatttttcttcgcttttttgttgtttttctagtttttgagttagatgtttgacgcttttttaaaaagctgtgcattttcctctgggtaatactttagctgtatattatgtattctgatatatagtgtttccattacattgttttctagaaaatctgtagctttgatttatatttgtttcctctttgacctaagatatcctaagggaaaatttaacattttccagaaagaaaacaaattttctttgttttccaagaatgttgttcaaattatttctactgcttggaatttttatcatttttgtgtatccagtaaatagtcaatatttgtacttgctctctgaccacataaaagaatatattcgtgtagtttctattaatagattagagttcaattcagatattaaatgtacatcattattcatgatatttaggtcttctacatcttcacttatcttttttctacttgctttgccattaacagataaagttgaattaaaggcttctactacatacatttctccctgttattccttataggttctgtaatttttgcttcaagaatattgctttttaaatttaatatatagatacttataattacactctagcattataaagagccttttctttttcattgaatgtatttgggcctgcatatgtctaacatgaaaattatagtcctttttttgtttctttgtttgtatttacagttttaagttccattttcaacctttatgcactctttgctttaggtgtgtctcttttagttagcataaagttaggtttgtctttaatttcacctgaagtcttttcctcttaatagatgggttaagccaactgaaaaataaaactgacttatatacttttatttcaagtatgtcctccacaaatattttttgaatagattagcttatatactttggaatttgttaaaaaaagatttttataaaaaataattgtggtgaaatgtacataacataaaatttatcattttgaccatttttaagggcatagctctgtggcataaagtatactcacatagttgtgcaactatcacctccttttgatttttttttactaattttgtaaatttgtttcatctgagctgtcttattatgttttgttttatgtttttctttcctttattatgaagtcactgtattgtctgtaggctatatgtatctgtgagtgtgtgtgtatatgtgtgtattatggtttttaaaaaagtctatatttgttttccagtggctatacttaatactaataactttatgttaaatttttcattctatgtgactctagttcactaatatgagctctgataaaatcagtgctttttcgaggttaggagatcaagaccatcctggctaacacagtgaaactccgtctctactaaaaatacaaaaaattagccagacgtgatggcgggtgcccgtagtcccagctactcgggaggctgaggcaggagaatggcgtgaacccaggaggcagaacttgcagtgagccgagatcgcgccactgcactctagcctgggtgacagagtgagactctgtctctaaataaataaataaataaataaataaataaataaaatcagtgctttttcttcctctgctacctcctttccttctactcagttttagtcagtagtattatcttttttcagatttatctttgtattgttaaatctgcttatgcttctattactttatttattagctttaaatgataccttttgactttcagcttttcttaataaagcaatcagcaaatttcctttacactccacacttataccccatttcctttgtttgtttatttggtttttacttctaacttttcttattgtcaggacatataacatatttaaactttgtttttcaactcgaattctgccattagttttaatttttgttcacagttatataaatctttgttcactgatagtccttttgtactatcatctcttaaatgactttatactccaagaaaggctcatgggaacaatattacctgaatatgtctctattacttaatctgtacctaataatatgaaggtaatctactttgtaggatttctgtgaagattaaataaattaatatagttaaagcacatagaacagcactcgacacagagtgagcacttggcaactgttagctgttactaacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgagcattgatctgccagcagagaattagaggggtaaaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcctcaaaaggccttcttccaggaatagtatttcataacctggaggttggaaaaatctggatttgttacaaaaaaatctgagtgtttctagcggacacagatatttgtctaggaggggactaggttgtagcagtggtagtgccttacaagataaatcatgggctttatttacttacgagtggaaaagttgcggaaggtgccttacagactttttttttgcgttaagtatgtgttttcccataggaattaatttataaatggtggtttgatttcctcaagtcaacctttaaaagtatatttagccaaaatatagcttaaatatattactagtaataaatttagtactgtgggtctctcattctcaaaatgagcatttactaatttctgaacactgtgctaggtcctgggaataccaaattgaataagacatagtctatttttctgaagggtttatagcagagtcccctgtgttaataatgaaggagtgtgtggtatgtgaatcatatatcaatagggttgttaaaaataatgaaaaaaggagaagaggaagaacatcttttttttttctgattgcacgggcagccttaaaattatttttgaagtgtacaattcagtgtttttttagcatattcacagggttgtattatcatcaccatatttttggcctcttgaaaagaaatcctgtgcctattagcatccaattaccgttcctttgtagctaagtctcccccattccagctttaaacaatcacccatctactttctgtctctataaatttgtctcttttggacatttcacataaatgaaataatataatagggttttttgtgcctaaataagcttctaaagaagaataaggtaaggaatcatcattcagcaaatatttattaagacttgctttattttatacagtgtactaggagctggagatgaaaatatgtgtagaacatgaatcatatacttcgggaatttgtggactagtgggaaagattgacatatcaataacaaatcgaattagtgatgtaatagaggcatttttacaggagtaaaatgaggtagcatggactctatctgggtctgaataatgtgaggagtaacctccttacacaaagaggcacaaggctaatgtcctctgatggaatgattcaccatgcaattctaagggtgacaagaatgaaagttagggccttgaagaaatattttgattaagagctgccaataaagtagagtaaagattagattgatgtgaagaagtgggagattaatgagtaaatggtcactggcttgttgagaagattaaatgagatgtacatgtaatgtacctaacacaacgtcttgtacaaagtagccattcagtagagactagcttgtattatctccctttgaggtaaagaaaactgttagaaatagtatttctactactgatagtatttcttctacttatgcctccctttgaggtgaagaatactgttagaaaacatgacataggagaaatacccctgagagacagttcttattagtgactactgtgcagaaaagatggaggttggtgtaattaaggagaaggaaagccatgaagccaaagtattatgaaaaagcatcaatatgaattttcatgttgacaaagtggtataaaagataattataaagatggtcacttataaatacggtagttctgtgtgacacaatttacagaagttggtatatcgtgtggaagaaaacagcataagatcctgaaggtttgaactgtgggcacattggctccatgctcaggaaatggcaatggggttgggaagtgattccactttatgtccctttcagacacataaaaattacttgtgtgagtatcttatgccagacactattcactgtgtagtgagcatggtgggtatgaaatgacaactttattgtctttcctgtcaaagaacttgtaggctggttgggggaaagagaccatttcaatatgaagtgctgagctagaggtacccttagggcactacagaagcctagctgatggcttttagcctggctagacagttcaggatctctaaaagcaggtgccttgaaggctgagtcaaatacaaaaatgtattttggacagaggaaattgtatgaacagaaacacagaacatgaaactacttggttggtgcagggtatcatcagcatagaaccagacagaaccagagtgtaaataagccagaaggccatgtcatggaggccttgtataccagtctcaggaatttggttgtggagagctttcatcaggggaatgatgtaatcagcttggaaatgtagatatatcactgactgtgatagtgaggagcagaattaaggtggacgtgattagaagctttgtgaatagcagaaagaacatagattttgaaagctggcagacgtaggttactgaagaaagttacttaaccttgctatgtctttagttttatcctctgcaatatggggataatactgcctattttgtagagtcttgtggattcttctggcatatataatagaaaataaaacagctattattattattgttgatggtactatttgctatatctgactacaaggagaaagactaataggaaaccatttcaggaatccagatatggtcatgatggacaggaagagacaagagttacatagaggaattctgggaagataagaaatgtcatttttatgtactgtttgcatccatcagacaaggcatcaggaaaaatgatccttcaggaaagagtgattttttttcttcaagaaattagaagaggggagaaattggtttaagattaaggactccatgcataagagaaactgggagggaagacaggtagaaatgctatggggttaggaaggaagaatgcagaggtggattacttagaattgagacatctgatcaagacagagggatcacagcttttgctaacaaagtactagtggaggatgccactaggtgaggtttaataaataattgttgacaataagttccatttaaaaaataaacaatttatgcttcttctttgcctaagtgtcaaataaaacattcagatttttatttcaaagtatccctgagtccctgttcccttttttgtcctgctgacttttggaactgatttaggcttccttagtcatctcataatagaaaaaatcagccaggtatttcctacatttcttgtattttaaaaaaatgtaatggatgtaatgaattttaagcaaatgtaatgaatacaataagtaacttagtatatgctgttttcttctctatgctgaatgtttcatacatgttattttctatacaactacatggtcaattccttgaaaatatcaactccaaaatctttattttggtatactccacgtagcacattgagagagttttaaactcttgttggatgactgtttcaaaagtgttttgaagtaggcatgtcagttgcaaaaagtttgctcagcaaatgttgttctgtctcacagtctcagacattgagcagatgattacatgacagcacgtgattgctgggagtaacagacaaaagtaactgaaagtgctcggttatcttgacagtcaaaatcaaaagtgtcccctattttcagtgacctaagagtttctttttgtgtttttggtattgttgttaaataagtgttctcacctttgaaaaggtcaataagaattcaatacagtataatgtctgtgtgccaaatgaaggtgccccttatttttaagtgtggaggagttttgatcataagaacttgaaatacctacagaatccttgatggttaagcagctggtgccagcacaagaatccctcaatatgttctctatgaagccccgatcaccaaatgcaaacattcatgattcagtatattttcatcttgactgccaaagttgatctgtttcttaatatattacatctagacttggaactggagatgagaacagaatattatcttcctcatttttgtgtttttgttcaactctaatgtctgcaaagcacttgcgtatgtaatgatgctcagtgtcataggagcaggcaggtaagtgtaaatttgtctggataggagaaagcatgcacaacatatttcacatagttttctgatttcagtttgtttttgcaaattattcactcagtgagatagcttaaagacgttatcacagggaaaggcatggagatagttctgtgttgatagaaaacttgtaatgtacagccatgagtgagaagtcaggttcagattcttcaccttcagtcctcctctttcataaacagctccatgtcctattttacatatcctactttaaaacgagattatagaagaatgaatttctaggcaaagtgacacttattttaaaatactattacgtatccctgtgcccattaacttatcctaccatttttcttcccctgtgtccaaaccacctttagaatctcctaaatatttgtagctattgtaaacagcactggagactttgctagtttaaaaggagaaatcaacgcaattaagccctagttaatttacttatcccttatgagattataattgtattttgttattaaaagggggacagagtacactgttctcttgcctttttaatttccagactaccacttctcctgcacttgacaataccgcagtctaccacgtagtcccatggctgacaggaggagaattctaggcaggccagtgtttgagtagtgagtaattggactgtctttacccagcaactcactgttttgtaaatgtacctgagtttggagaagtaattggcttttataaggggtgcggggtggagggttggggtggggagagtgagaaggaggtcagagctttaggatatataattggtctccacaaagttgttgtgatacttttggaaccacgtaatggtcttcattaactaagtgtctgtcatgacagccattacatatgcattataataaaaatttatttacagtgtaagttgaagaaggtaaaatctggatgtagtttctaaactctgcttggcagttttcatatttaagccactagaagaaaaaaattgggagggaagctgagaagaatttactgaaagaaaaaaatacttgggagggaaattggcaagaagtatgaaaaagcttgggagggaagtaagcaaataaatgagttaatgactgttctggaaaataaactctatcatgcagatatcacatgactgattaaatttgaatttgacctcctgctttccaggtctggtaaaaactaacctgtaagaacttgaaacttagcctttgaatggtcaatccaccactgtaggagaatttatgaatgttcagttgagagaactgaaaataaagaagtaccataggaattaacatttgcattcagtagccaagatataatggacatctgaaacaggtatttgaggccaggcgtggtgtctcatgcctgtaataatagcactttgggaggccgaggtgggtggatcacaggaggccaggagttcaagaccagcctactaaaacacacacacacacacacacacacacacacacacacactagccaggcgtggtggtgcacgtttgtagtccaagctacttgggaggctgaggcatgagaatagcttgaacccagaaggcggaggttgctgtgagctgagattgcgccactgcactctagcctgggtgacagagtgagactctgtctcaaaaataaaataaaacatatatttgaaacacattgaattatgtcccttaaacaagaataaacatcactaaatgactgtaccttgaactacctgtaattttctcctgataggtaattaagcttcaaagtactgacacttatttactgtaatatgaagcaataacttaaaaaaaaaaaaaaactattgaaccagaaccaaacaggaatgccatagcattttgtaaactaaactgctatttcatttcatttgagccctggaacttgaaaataaatgctagctaacatctgtgaacagaacatacccatcagtactgtgctaagcacctttcatgaactggtcattaaatcctcactttccatttatttagtgacaacttcacccagagtttgcagtcaaagtgaaaatgtgctgaattccaaaagtgtgagctaggttttagaagttaatcacaattctggaacaaattactagcttaacaaatgagagttcttatgtctctaaaaccaaaatagccctaagtctgtccctcccagtaagatttgggccagtcaatggaacagtaatatacaaatataattacagctgtctaggagcaaactatcctatgaatagataataaaattaagacacttaagccatgttttcatattaaaacacaaagtaaaaaatcattgttttccaaagataaaagccatactgtatcatgacatatatatgcccgatgtttcgaccctcttgaagaattgagattctcgactctacactcttagcgttttctatattgaacagatgtttaatttaaggaggtcaagagaaatcttacacttattttttaatggtaccttagacatagaaggaacctcagaaatctctggctgaatatttccatctgcagatgatcatgtcattaggcttctgactctatagccatagaaaaatattcatgaagacctttcaggaagggaatgttggtatttctaaaaattgagtacaagtattctctagacaaaacagctcttgaaatggcagattgtattcccattattatatttcagaatcaagacattaatacctactttttatttaccaggtttagttatccttgaattagattttataaattaaagaaatagatttcaataaatatttgttgagttcctagtatggaaacatcgtgtttggcaccagggatgttgcctgcaagtataacaggagttcgtatttgtaatgagtttatgatttacagatatttggggggcaaagatatcattcggtaaatacttatgagtgcaaactttgaactagggactgggccaaactctaggaacatatttgatgacagagacacaatccctgtcctcaaggagctttcattctagtagagaagatgaaaaccagtacagtttggtaagttagatgatattggttaatgtagggttcttatgtaagtctagagaagtagcatttaatctgttcttagaaggtcaggaaagatttccctggaggaagtgacatttaagctgagagaggatggataaacaggagtcatctgagtgaacaacagggagaacattccagaaagagaacaaaatgtacgaggcctgatgccaagagagaacattcattgcattggggaactatagtcacttctgtgtggctgggatgtagaatgaaatgagcctggacccaagagagcactttgccctttggggaagctgtaggtattacagtaaggttggagtctggaaagaaaggggtatattgtgagatctgaattgggagaggacagttatatccagacctttatatgctccagtaagaagactgaactttacactgggggccatgggactcactgaatggcattaaatttgagagtggtcatatgaccagatttgcattttacaaagattgtcattgactgcaacatgaagtatggagtattggaggagcggtaaggctggtggcagggagataatttaggaggctttaggtgagggatgataatgacttgccaggtaggaaggagtaaatttcttctcagtggataattagaagattgaatggatggacttggtcactatttggtatagaaggggaaaaaagatgtcaaagatgatgccaatttttaaaaataatttaacatttatttttaaatattttttcagccttattaaggtataatggacaacaattgtaggtatatgtcatttacaacatgatgttttgatttatgtatacattgtgaaatgactgccatagtcaagctcattaacatatccatcactcacataattaacattttgtgtgtatgcagtgagaacatcaggctctactctcttagcaattttcaagtatagattacatttgttaccaactatagtggccacactatacaatagagctccaggacttattcatcctgcctaactaaaactttgtactctttgaccaacatcttcccattcgtctctcctccccatgccaagtttccatcttggtcagttgggtggatagtagtactatctgccgaggcaggttggtagggtgaaaacaatgtgttcccttttggaaatgctgaggtgaccagggaacttccaagggaatctgtctggatctagagcttagaagagatgtttgggctggaaacagacatcaggtattcttcagtatatgggttgtaaatgaagtcacaggagtgggtgatatcaccaatggtgagtgtagtataagaagactggactgaggacagatttccaaggaatttcaatacttaagaggtacgcagagaaaagaggggctgtgaaggacaccaaggaggagactaagagccaggagggaaaactttcaagagagtattgcattatggaagggaagaagagagaacattttaaatgatacgcaatgctcaataatggtatccgctttggagaggccaagtaagattcctaagtacccattggatcaaggtccttaatcttacaaaaacttatgcaaatcaataataaagagatgataacccgataatcaaaaatagacaaggcatataagaagaaaatgaattaaaaatattcaaagcattcaacatatacaaatgcgctcaatctgatatataatgaaagaaaagtaaattaaaacaacaatgggcatgactaaataacagtatgagggagcctgaggagaaggagcatttgaaatttcagtacagaagagaaaaggggtgacttatagaaaaaggagacagaaaccatagaacatgtttggaggataagactcaaacaggtagtggggacccttttctagagtaggatgaaaacaggtaatgtgtgtggatgcaaatatgaggtaggatgtaatgggaagttgagcgaattcatatttagtcattcattcaaaaatacttaattgagttactgctgtgtggcaagcatcattctacaaacagagggcacagtgataagcaagccagtttgtactctcgtgtaacttacattctactttgagaagacagattataaataggttaaaaagtcaataatatgatgtttcagcatcaacaataaaaaattagggtgatatatagagtgccagggaaagtgctttcatggacctcttcattctctcctctcctggtgtcataagctactccttcatccatgctgccatttctcttggtttacggttccagtatagtactcatcacattattactatagagccatccaccttatgaaggtgaaggtgtccatctccttacttaaaaaaaaaaaaaacaaacaaaaaaacaaaaaacccgaaaaacaaaaaaagaggcagaaagacagaaggtcctccactaactttcacgtgccatgtaaccagcgaaatccaattattttacagcattctagctatagaagagtttgggaagcgtagtgcttagtgttctagcctttgtagcacaggaaagggcctggaaggaaaggaattgtgtcttccgcagttgcttttctttatggggaagtgctatagcccaaacaatattttaggaattttcatctattgtcaatatgcaaactggaaggggataatgaaaatgttgtggttagaagtttatgaaatattgttattcacattttaaagtaaaaagagggaatgtttaagagacttgtttaagatcacatgtctcataattggtgggaccagcaatacaatccaaatctaactacttatctttttgctatgccctattagtgttcatattagaaaagaaattctatctcagacactaatgatttgttctttggacaccaatgactttaagttaaaacttcatactagttaatttaattatggtgtagcagtattattaaactatcaagactataaattttctatttgtaaaggagattatgataccaaagattagtgaactaatgatattgagaattctatgacataattttgaaaaatatttgcaggatatttatttttgtgtaaatgatgctttcaagctaccataatcctaagtaagtgtatatttgggaaaaccacctattctaacacacttgaaatttaaataagtcaggaaatttttttccagatcttctcccaaattatcttcatctttttcctctccccttgggaaagaatctcttcatgcctcataatatcaaatttaaactatggaagtccaggtggtggacagtcagcaaaggggaagatgagaagcttgtgttataaagccagctcttgtcagaataaggatctggtaggaacttcagaagtgatgggtaggtaagtatgaaggccaggtcctaagatctaaattacaaagcagaagacttacttaccagggagctggaaaacatgttaggaaatccagagcaggaacagatttcaagatagcacaataatatagcagtgaagtactgagaaaagagtttttttcacgggttggatttattctagcattttaggcagcatttgggcatttctaagtggtcagacttagaggagatagttaaggaattagcagctgctaaatgccaattcttagaccagttgaatcaaaatcatctaaaaagctttcagaaaccagactttttaagggccatttgagagactctcaaatctggaatccagaaatctatagctagatgagtttaaggtagagccagaataagaaaaataaaatagtttgtttgtttcaggtatcttttccaatattatttccgaacctaccccaaacaccttaaatcactgcattctatagccattcttttaaaaatgcttgagttattagttttcaaaaacaaatacaaatctgcacacatacagaaataaacattaaagagacataaagatattaaacagagttacatatacttacaacttcatacatatatattatatataaaactgaatattaagtgtttgatattagtgacaaaatctgtaacatccattatattagtgctttttgtactttttgttgggtgtagtaaaaattgcattcgaatttgagttttctgctatatatttggtcagttcctatcagtgaaggaaaaacctttttttattattttattgtttttttattttttgagacggagtcctgctctgttgtccaggctggagtgcagtggcatgatcttggctcactccaacctctgcctcccgggttcaagcgattctcctgcctcagcctcctgagtagctgggactacaggcacctgccaccaggtccagctaatttttgtatttttagtagaaatggggttttgccatgttggccaagttggtctggaactcctgacctcaggtgatctgcctggcttggcctcccaaagtgctggaattacaggtgtaagtcaccacgcctggcccctttttattttttaagctgattgaagattcttagttctcatgctttctagtggtgattaatctttagccaatatttctatatacagttattagtaatcatgtttgacttaggtcaacaaacaatctttcctaaaaaaacagaaccccaattttaatttctgaattatttagtatctattttctgctgtggaagttgaattatgttgatagatatcatacagggccatgtaacactctcagatacacgttcacatgtatagtagctgtatacaaaaatgttacttcattctctctctctttataatactcttggctctcttacgttctctcacacactctactcttcccttcctctgttctttctacttgttccctctgctcctaccacacttattccccccttgtccattttccttgtgcataaagcacaagtgcttagtaattatcaaatattaataacaatgacactaaccacccaatgatttagtgttaatgacatgctttattgaatggcattacctctaaagttcatgtttcctttacccaaccaagcttcttaccctcctcccttaccacaagcatctatattgtcaaggttgttataaagagtaataagccagccattaaaaaagggtttatggtattttcctatctacaaagtcacaggaagctcaaatgtactcagtaaatattgcaaaattacacaggaccattaaatgtaacactccaccctttctctctctctctctctctcttgctctctctctctctttctgtcaatatagcaacaccctatatcattgccctttgtatgtgcaaatcagagttaataagctttatattagcaattactccttaacaacttctggtttgtttggtccagttgaataatgtaagcacttaaaaaaatgaaattataaacatttatgtgaaaagtgcatatatcacattggatatgttgttatgcactccttaataataaagtaagttaatctttattgcacacttattataatattactttgaccctctctagtactctttatctaagtattctcaagtgctttacaatctcaaacagacccaatgtgttgtatacacagaatcctttgaagctgacatttgcctttctgaccagcttgttgtaaaggaaatcagccaaaaaacaagtatctagatgagtagctcaaacattagtacacatagtaatcacaggtcaaaatgcagatagattaccctgtccaaattctcctgagtaagagtaggtgaaacatttttaaataagctccccaggtgattctgaaattggtccaaggaccacatattaagaactaatgatccaaacaatttgactttttattgtagattaaaccatgctgagaaaattattaaaaattgaaatggcagtggaggatggtttgaaagaaaggtttttcagggccctttcaacaataaaattaattgaacacaatattaaaactctatatttgatttaagactaaggttttcattgtttttaaatctcagtaatttttatgtaacaggtcaattcatacccagcatcttaattccaatgaatgatttcccacaacaatttttgtggataactccaagggaactcgaaggaagttgtagtatgaacaaagagaagtagaatttgtccctgtgtgtaaggcttctctgataagcagcacaggctctcatactgctttttaaaaaaattatgatagcatcaagtggaattaattttttttagattatactttcatggaagggaagatctactgtgaaggctggaaaaccaacacccttaagataaatatattaccagatttgagcgctcttagtaatcagcaaagataaatgtttaacagtgcatacaaaatgaagtgttttatgttaaatcaaatagagaaagccaaacactaataatgtggttacaaatgaacaataaattaggtaatcagaacaggtacagacattaatagcaggatattggtattattaatgtattttgttttaaaataatgaacttaattacaattctcctcatcctaccccactattttattttattccagattcagcagcttcatattatgtctctgaaacacttattattaaagttatccaaatgtacacatttctctttatataaatgtttcagtccagaaaaggaggccaaatacattagctcagaacatcaaatcttctcagatgtgggaatcttttattttcacacttttaaaggtaatctgtatttctagcgtctattatagacagaaaactttcatatgacaacattcctattttcttaactgccttgataggggcgaagacaaattctaagtaggactttttaccccattcttcttaccatcattctttcacaaaacccccagctttagacaatcgctattatgaatttgacatgtactattccaatccattcccataaatttacacccatatatacatatagttatctatgaacaatatttagtagcttttttgtgtgtggctttaaaatttacataaattgtataatttgtgcacattcttctttaatttgccttcttggctacggttatctttttgagatctagctatgctgctggtatgtagaattctatttcattcttttttcattgttgttttgtacccataacgtgtcacattttatttataccttctgttcctgatggacatttagattcttccaggattttactcaatactgcaatgaaaatctttgaatttttctcttttgcacatattcaagagacttttctgacatatatatctataggtgaattgtgtagtcatatgatacatacacacattttaaatttcactagatactgccaatttgccctttgaaatagccatacaatttatagtaccaccagccacttatgaaagttcccatttcctcaaatctttgaaagttcttattataaacagacatattaattcttgccattctgatttgtaaatcagaatctctattgttctacctctagttctaatttggaattccccaattacttgtaagatgctatatattttcatgtttgttagtcattctgatttcatatcctttaccaattatctttttggtaagttattgtggtggccatgagatgtgccttacagaggccttgctagagggaatgtgattgaatgagagccccagatgctgtgtattaaaatcctgcactgagtttgtctcaagatttcttgcacgtgaatgaatgagtacagctgggatactaaagcagatgtgtatttgggagatatgagacttctttagtggctgatttttggctcataaatgactttgccaaaccttccttagactgctcagtgttctaacatcttccatccagccttctacccttctttcctttactaggggattgaatttacattgaggtctcatagccttctctgcctctctccttatttccttttatacaaatatttcccctaataaatccatgcacatttaataccattttgctatttgcaacctgcaggtcctggactaacacagttctatacattgcattaccattctctagagtgggatcttttgttgtagagagttttaaaatttttatgtagtcacttttatccatatttttctttatggtttatatttttgtgtcttctctttaacacatcttttctagcagaattcataaatatattattctatattgccaaaagtttgaaagttgcaatcattagaattaatttttgtatattgtgtaagttaagaatctaattttattgtttttcattggaaagccatttgtcccaagataattttttagtagtccctccttcccctattgtcattctgacatattttttctaggttccgatctatgcatgtgtttctttatggaagagttggccctttgtatctttgagtttcaaatccatggattcaatcaaccacagatagaaaatatttagaaaagcgtcagaattgaacatgtacatacattttgcttgtcattattccctaaacaatatagtataacaactatttatgtaggatttacattgtattaggtattgtaagtaatctagagatgatttaaagtatacaggaagatgtgcatatgttacatgcaaatactaccccatttatataagggtcttgagcattcatggattttggtatccacagagagtcctggaaccaattccccacagatgccaaggcacaactgtatttattctatcatctacttgtttaatctcacatcagtatctacttttgaaataacaataactttattatttaactttttttattacttaggattagagaatttcctctggtgaggcatcatagtgtctcaagctggccataaagacaagtgagggctaggatcggtaagactgggcagaggaagatacaacagatctcctatgcatgaagcaaaagtgcagctcagaagccagctctttcattaagttgtcctctataccctcactagattgtaagctcttgaaatgagaggctataccttaattgtctctgttatctaaaatacttccactcactgcttggaacatattgcctgcaataattaagcttgccctggctcccaaagcatagagcaaatcacactcctccccttgcctttgagaagctcacagtcttcgaaggtagagatatgtgaacagataagaaaatggatgacaggagaacagaaacgcatgactgtcagagaagtcattggagactttacagaggaaattaaatttttattgatcttgaaagagtttgccagatgaagtagaggacaggcattttagacaaagggaacaggaaatgtgaaaacacaaagtgatggaagtcatggtgagtttggagaactataaaacttcaatgtggctgaagggtaaggtggatatagaggagtgctgggaggtgaggctgaagaaataagctaggaaatgtctttttatgccattttttaaagtttggactttattctgaagttcacatggatccaatattttttgttttgtgttgttttaagcagaagcgtgacatgatcagcttgaatgatgaacaacttgaattgtttaaagtggatcacacagtctactgttttacagttattctttgaccaagatattctttattaactgaggaaaaaaagggctttcctgaattttgcagtcatgggatatatgataagcattcttgatttatcatcttcaatcctgttacataacataataaccattgttattacctttagcaatgctttcctcagtattatctaatggcctataaaatgtgactttcatttgcaaatacagtacatctaacaagaacttaccacagctgctatgcaaaataccaatacaattgacccttggacaatgtgggggttaggggtgctgattccccatgcagttgaacatgttacataacataatacataaccattgttattatgtaacaggattgaaaatgataaatctttggaaagtggggcaaatgaattcttatgaattccatatcttccacatgtgttttacttttttgataagaagtagtaacctagttcagaaagaaaataatcatccccttttacttatgcaggataccaagtctatcttagcaccataatagtgaatgataggaatcaagctctatgaatacattcacatgtacatatatatggctatataggacacatgcatgcacatatacatatatacacttgcatatatgtgtatatacatgtacatatatgcatgtatattcaattgtatatgtgtatatagccaagttattgtacagttgacctttgaacaacacgggtttgaactatgcaggtccacttacacgtattttttttttccgtttctgacacccctaaggcaacaaggccaactcctccccttgctcttcctcctcagctgactcaacatgaaaactatgaggacgaagacctttatgaagattcacctccacttaatgaatagtacatacatttctttttccccatggttttcttaataacattttcttttctctagcttgctttattgtaataatatagtatataatacatataacataccaagtatgtgttaattgactgcttatgttatcagtaaggcttctggtcaacagtagactattgctagttaagtttctggtagttacaagttatatgtgggtgttcgactgcatggggagtcagcaccccaaccctcatgttgtccaagggcgttgtccaagggtcagttgtaattggtattttggatagcagctgtggtaaattctggttagatgtactatatttataaatgaaactcacattttataggccattaaatattattgaggagagcatttctaagggtaaaatcttgtctaatgcttgaaacatcttcattttcctgtcagtttagatctttttgaagtaattctgaaaatctctcttttaagctaaatttaacacaaccaaatagccaaatatttaagttccactaatgaagatatctaaatttctgttaaaaatttaagatatatgttaaacccttctaatataactcttctctcagtcaaacttttttttttaacagttgctttgcttcttctttcaaagtcatacttcaacaaagttgctattgaatatgtctgactaaacatgttagctatatgataagatggctggataagagataaatatagaaaatgtagctttttttctacttgcaataaccctttaggaattaaaatggaaaactaataactatttgattcataatagtagcaaaccgtaaaatatttagacataaatctactaagaaatttataagacatatatggagaaaattcaattgaataaaccgttattgaagtatataaaataagatctggatgaatagaaagatcataatttttaataaaattttgcatcttaaaaagtgaaccctctccaaatatatgcacatttaataaaattataaatacatcccaatgaggttggttttgaaattttgttaattggaacttaaatttcacctaagaagaaaaaataaagaatagttaagagtgcatgctttgtagacaaattgccttagttagaatcctggctctatcatctattagctatgttatctttgggataacattcatcttttcttatagatatgcttaaaacagtgcctgacatatagtaagcacaaatatccattagctattcttcttattatttatgttattagtattgttaatatttgttattatatggaagactaaatgaccaaagagagtcaagaaatttatgaataagatttatgcgttgttagatattagagccattaaaaaaaaaaaaaccaaagtgccaaaaaacctagcacagtgttaatacaggaataaaaaaatggatcagaggaaccaaacagaaaagccagaaatggatcttaggaaacatgagaatatgatatatgatagatgctaaatgaattcagtataaaaatattaatgtaataaatcatgcttgctattcaagtaaaagaaaatgaggttagattcatgtctcataccaaatataaccataaattataccttgattaaattttttaattaaaaagcaataatatttgaaaagaaatataggatactcaatgtataacctgaaggttgggtagtacttttcaacaaatataggaatttttcacttgaaatactagaagaaaaaaagatagcaaacaaatacaggaattccaatttcaagcagatataatgatttcatgaaatgttaactgtgcacatgatagatggtctatggatagtgcaaaagaaaaagagaaaagaaaaaatgttttttaacatatgcagcaaaaaaggtttttaacatctattacatacaaataaaaatgaatgtataacacagacttcaataaaaataggcatttcacaggagaacaattcagatggccagtatttacaatttcataggtattaaggaaaatacaaattaaaatggcaaattagcaaaaattgaggtgtgattatattaatatctgttggtggtggtgattatggggaaaagggtactttcaaaacttgctaatataaatataattcttttggttgttttgtaaaggaacctgacaatatcttttaaaaataaagaaaacgcatacttttgacctagccatcccattcatgagggtatgtcttagaaaaataagatcacaaaatcatagagatttatgtgcaatgatattattggtaggtcatttttatgaggaggggtgtggatagtaaatgccagggtaaatcacatagcatctaataaacgtatttatgaactacaaaagcttacactttcagtctagtctagtccagactgcaaataaatgtgagcaagtgaattcaagcacagaagtgcttgaaggcaggtttcataaatctactttcttacagtatcctgatattgacttatcgagacagttactgtggggttgattattaaaatatttatgtatctaggtatttttcattcagtagtatgttattcaattagcaacaagtgtggggatttaaagatattcttgtttgtttttactgctgaaacatattctagtggaaatttcgaataaacgattagtcatcctaaaagcaagatacattttctcagaaaagacaaggtaaagaacttgtatatcctccctcaattcgtttataaggtaataagatgaataaaaatatcatagtacaatttagcattgtaaaataaaattaattggtcatctctagtgtggtcgtgcttggaaggtgaaagaagccaagatcttgtctgggaatatcatgtctaccttgacctcacccttaagaatcctagcctttagtttaaaatcacatggctacatacataccaacttcaacaatagtacatctggcaaggtcatgcaaacctgggacttgagcttctgattctaagtccagtgctttttgtgtacatcatctcttgtacataccttatgatgatatgctaataaaagctacgtgatcaggccttaaaaatctgctttttttttgtaatggtagaatggggcatattatcacatcaggtaaacactctattcaaggataaatggaaatgaatgtcatatatagatcattgataaatatctcattacaaaattatgagagttaccaatgtttgagtgtatattatgggccagccctttatattaaattacttcaaatttttacaactgttaaaggaagatattattatacccattttatagatggacaagttagggccagaaaagacttcctcaaagctgttagtccagtaatggagacagggctagaaaacaggtcattttgctctttgactaatgttactactcatgttttgtattttgtttaaagttttattttattttgctttatttattttttgagacaagatcttactctgtcacccaggctggagtgcaatggagtgatcacggttcattgcagccttgacctcctgggctcaagcgatcctcccacctctcaatctccagagtagctaggactactacaggtgtgtgccaccatacctggctaaattttgcattttttgtggggacagggtttcactatgttgcccaggctggtcttgaactcctgggctccagcgattcacctgccttgacctcccaaagtgccagtatcacaggcttgagccaccatgtccagccaagttttattttagaattaaaaaaaattccacttggattgttacattttatctcattgctttatatttatagaattactttataaatgccactttcttaattttcatagttagcactctttatgaaacataaactattatttgacccaggtttttgttagaggaattgagtcagagagctgttaagtaactgagatttcacaataagccagacagaccagggttcaaattctgggtctcacattatccaattcaatattccagctttgttacttattgagcaaccactacaagcacagtttacatgacatctgatagctctcaaaatgaattttacaaacataattcagatttcaactcagcagtgactcaggagaaaggacacttggatgcatttctttatggcatttttcccagggtacacgcaacctggaagatctcccaagtatgggggaaggtttcaccctgaggaatcccattccctctaatctgggacaagggggaggagagtactgtctcttatcagccatctccccagggaggcctgggccctcctggaatgcataccatggcttactgactcaaagtgttgaaaagaccaggcattgggacacacaacactactcttaaaataaaaaaagaatcagagtagcttgtggttataattgaaatggacagagtaacatggtaccaagaaactattagcaattccttccctaaatccctcattttcttaaagcattttctccttttcctcaacaagctttaagttggatttgaagaatgataagactaaaaggagggctgtttctggtctttggaggaatttgatattccattcgatctgagtgtgcaaagcctgagttcacatgaactcttctgatctctttctctaatattttttcaccttattcatatgggaaagaaggaggggaatactttagttccattctccctcctcctatttccttgacttgtttaaaatataaatgttatagacacctaagatagaaatttgactgaaacagcctcttaattattgtcttaaaaaattggtataatgaaattgcatttgtagtctttggacatttaaatccagaagggatattttctttttcttttttaaaaatttaattcaatagtttttgggctacaggtggtttttggttacatggataagtgctttagtggtgatttctgagattttgatatacccatcacctgagcagtgtgcactgtacccaatatgtagtcttttatcccccccccgctccacccttcctttatcgtccccaaagcacattatataattattatgcctttgcagcctcatcgcttagctcccacttgtaagtgagaacatgcgatatttggttttccattcctgagttacttcatttagaataaattgtctctagctccattcaagttgctgcaaaggccattatttcattccgttttttggctgaatagtattccatagtgtatatatgccacattttctttatccacttgttgattgataggcatttaggttggacccatattttcgcaattatgaattgtactgctgtaaacatgagtgtgctttttttttttccatataatgacttcttttcctttgggtagatacccagcagtgggactgctggatcgaatggtagttctccttttagttctttaaggaatctccatactgttttccacagtggttgtactagtttacaaccccaccagcagtgtaaaactgttccattttcagcacatccatgccaacatctattattttttgactttttaattgtggctattcttgcaggagtaagatggtatctcattgtggttttaatttgcatttccctgataatcagtgatgttgagcattttttcctgtgtttgttatttgtttgtatatcttgagaattatctattctgtcctttgcccactttttgatggaattatttgtttttttttcttgctgatttgtttgagttccttgtagatcctggatactagtcctttatcggatgcatagtttatgaatattctttcccactctgtaggttgtctgtttaccatgctaattatttattttgctgtgcaaaagcttttcagtttaattatttcccatctatttatttttgtttctgttttatttgcttttgggatcttagtcatgaactttttacctaaaccaatgactataagagtttttccaatgttatcttctagaatgcttatgttttctggtcttagatttaagtctttgattcatcttgagttaatttttgtataaggtgagcattgaggatccagtttcattcttctacatgtggcttgccagttttcccagcaccatttattagatagggtatcctgtccccactttatgtttttgtatgctttgtcaaagatcagttgactttaagtatttggctttatttctgggttctctattctgttccattgtctacttgcctatttgtgtaccagtaccaggctgttttagtaactatagccttgtagtataatttgaagtcgggtaatatgatgcctccagatttgttctttttgcttagtattcctttagctatgtgggctcttttttagttccctatgaattttaggatttttttctagttctgtgaagaattatgatgatattttgatgggaattgtattgaatttgtagattgcttttggcagtatggtcattttcatagtattgattctacccatccatgagcatgggatgtgtttccatttgtttgtgtcacctgtgatttctttgagcagcattttgtagttttccttgtagagatctttaacctccttggttaagtatattttcatgtattttagttttttttttttgtttgtttgttttgttttgttttgtttttgcagctgttgtaaaagggattgagttcttgatttgattctcagcttggttgttgtcagcagggacattttctaaagtatagactgtagttccttatcttctatctgtttcttactgtccccttcagtattcttgtccttttttcccgctattatctttttgaccttttaatatatagatatctacttctacttctgacaatttttgcttctccaattttctttctttttctcctctgcacacatttatttattttcttctatgtacttctttatttttaacttaatatttgattaacttcccttccctgtctcttttccttctttccataaatcttcattaattgcctgcactgagctaggattctatactctctaaatcaataatctattttctatagtcaactgtgttataatcgtactgtcaagataactacttatttttaatacttaaaaatattttgaaattttaaccaatttaattaatacaatgttgagttcaaatttgaaaaaaacaatggaaaactgtaataattctagcaacctcctgctttttaataatgtattagaaaatttgcctctttttcaaaagcctacagtgaatctattcatacaaggcaaaagcaaaccattctcttcattctctttttttctccaaaagatttaagtgttttttgtttgtttgttttgttttgttttttagatattgagtcttgctctgtcatccaggctgcagtgcagtggtgtgatcatagctcgctatagcctcgaattcctgggttcaagcaatcctcctccctcaccctcctgagtagctggggctacaggtgcatgctaccatgcccagctaatttaaaaggaaaaaaattgtgtagagatgggtcttgctatgttgcccaggctggtctcaaacttccaatctcaagcatttctcccacccagcatcctgaagtgctgagattataagtgagccactatgcccaaccagatttagtttttaaaaagagaatacgatttgaaaaaggaaaaatgtgaggcaggagagaagaaatacacacacgagctgttttgtaattgctgtaaaactgaaatcttcagcctcactaaaggagcacttgcatgaacacctctaaattaccttattaccttctaaattaggtgtgaagtctaacttctaaattatgagtgaaatccactgcaattcttgttatttggatggaatcctaggtatgtggtccagttcatgagttgaacaaaagcatgctcatttaggccaggtagaaagaaataaagacctatgttttacatgtctcataaccactgaaggtccttctcataagcagtgcttatgggtattaacgacctctctatattttacttctccagtgcctaagtagccgagtccactgagtcctgctacatctcctccaacatgtcagcatttttttcacaggccttttgttactctagatcagaaatgttgatagcaacagttccttgagggcagcagctagcatgatgccagccaacaggaaccaccaaatggttcttaatataaattactacttattaatctatttactttgtgcatttggagttttgcatgtaaagtcctatttatgtccatatggtagataaatggaacaaatgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagagtatatggcttctagacatccaacatagaactgagtttgtgttatcagtttaagatttggttttgctgtaaggtgcacacactttgaggaactaaaaataattgtctgttcttattctgatcagaatgtgtaatgtgttgtccagttttggatgatgaatttcttatttctaatctcataagaaacttgtcatagatgtgagggagagaattaagaacagagtgtggggaagaaactgtgtacattttgatgggatccattatgtagctcttgcatactgtcttcaaaaataagttacactataaaggttgttttagacttttaaagttttgccattggtttttaaaaaaatttttaaattggctttaaaaatttcttaattgtgtgctgaatacaattttctttattacagaagtaccaacaattacatgtataaacagagaatcctatgtacttgagatataagtaaggttactatcaatcacacctgaaaaatttaaatgttatgaagaaattatctcatttctattaatatgggaactgtgtcttcatctttattactgttctaaggtcaactcaatgtagattttacttgcttatggtttcatattttagctaaatagtaaaataatatggatatacattttgttgtgacttactcatactttccttatttggaacttttatgaatatgatatagagactgaaactacaaggaacaaaatgcaatatcaattatacagttgtggcagcactgctgtcaatttgttgatagtgtttaacacttagaaaaacattttaaaaataatttcacataagtaatgtaatttattagctgtctctgacattttacagtttggaatagtttattttctttttggtgtcctcaccaaaacccaacatcttcaagggcaggaactgtataatttttgctattgtattttgagcacatagcatggtacttgcctctaaatagatactattgttaaaatattttttaaggtaatattttaaagtgtatgctatggtacagttcagtttgtgacttttgctagtttatgccacttacagttagcaaaatcacttcagcagttcttggaatgttgtgaaaagtgataaaaatcttctgcaacttattcctttattcctcatttaaaataatctaccatagtaaaaacatgtataaaagtgctacttctgcaccacttttgagaatagtgttatttcagtgaatcgatgtggtgaccatattgtaatgcatgtagtgaactgtttaaggcaaatcatctacactagatgaccaggaaatagagaggaaatgtaatttaatttccattttctttttagagcagtatacaaagatgctgatttgtatttattagactctccttttggatacctagatgttttaacagaaaaagaaatatttgaaaggtatgttctttgaataccttacttataatgctcatgctaaaataaaagaaagacagactgtcccatcatagattgcattttacctcttgagaaatatgttcaccattgttggtatggcagaatgtagcatggtattaactcaaatctgatctgccctactgggccaggattcaagattacttccattaaaaccttttctcaccgcctcatgctaaaccagtttctctcattgctatactgttatagcaattgctatctatgtagtttttgcagtatcattgccttgtgatatatattactttaattattattatacttaacatttttatttactttttgtgttagtattttattctgtcttctccttagatagtaaccttcttaagaaaatatatatgctaagtgttttactggtttaatatgcttagactactcatctacctcaatacttccttggagatctcctcctcagtcacacagagctcaggacttatatttccttggaactcctgttagggtccaatgtacatgaaattccctagacagacagacagtcagttatatggcttgatttcaaagtttcaaaatgatttaatggactatcaagtagtttattaggagaacagttattatactcttctaaaaataaagactttaagcaataaagatgtatatgtatataaaatggctgggttattcctagaagtacctttcttagaatttagttaaatttaatatccaagatactatcttttcaaccctgagattgtgaaaagtaacttctatcaatataaactttactacatttgtattgtgttagtgtgttacagtataatctagaacaatgtgtctttctatatgatatatgacattttaatgcctaaaaaaactgatatgtcttagatgattctagtcaggatttacttctagaatagattaaaattctatttgaggagagtcaaattaattatcgaattctcagttgttattattgctgttttatttttagtgaaacagattagtcttaatgtaaacacttgagaaataaattgatggtcaacctaaaatgtaaaaaagaaattaatagaaaatttaaagagcaacaaagctctgacatttaaaagaaatgaagtacaaatctctagggaccttaaagatcatctaataatttcctcattttctagataaataaactgagagaccccgaggataaatgatttgctcaaagtcaaatatctacttaatataggaaatttaatttcattctcagtctgttaacatgcaacttttcaatatagcatgttatttcatgctatcagaattcacaaggtaccaatttaattactacagagtacttatagaatcatttaaaatataataaaattgtatgatagagattatatgcaataaaacattaacaaaatgctaaaatacgagacatattgcaataaagtatttataaaattgatatttatatgtttttatatcttaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggtaggtatacatcgcttgggggtatttcaccccacagaatgcaattgagtagaatgcaatatgtagcatgtaacaaaatttactaaaatcataggattaggataaggtgtatcttaaaactcagaaagtatgaagttcattaattatacaagcaacgttaaaatgtaaaataacaaatgatttctttttgcaatggacatatctcttcccataaaatgggaaaggatttagtttttggtcctctactaagccagtgataactgtgactataagttagaaagcatttgctttattaccatcttgaaccctctgtgggaagaggtgcagtataaataactgtataaataaatagtagctttcattatttatagctcgcaaaataatctgtatggaagtagcatatataaggtatataaacatttagcctcttgataggactaactcacattctggtttgtatatcagtcttgcctgaatttagctagtgtgggcttttttttatcttgtgagtttgctttatacattgggtttctgaaaagatttcttttagagaatgtatataagcttaacatgtactagtgccaatcttcagacagaaattttgttctattaggttttaagaataaaagcattttatttttaaaacaggaaataatataaaaaggagagtttttgttgttttagtagaaaacttaatgccttggatgaaatgagccatgggcagggttgtaatgaattgatatgtttaatagtatagatcatttgtgaataatatgacctttgacaagacacaagccattaacatctgtaggcagaagtttccttctttgtaaaatgagggaataaaatagatccctaaagtgtgtaattttagtatttctaaactttatgaaggtttcctaaatgataattcatctatatagtgtttttttgtgtgtttgtttgtttgtttgtttgagatggagtctcgctctgtcacctaggctggagtgcaatggtgcaacctcggctcactgcaacctctgcctcctgggttcaagctaatctcctgcctcagcctcctgagtagctgagattacaggcatgcaccaccatgccgagctaatttttgtatttttagtagagaaggggtttcatcatgttgaccaggctggtcttgaactcctgaccttgtgatccacccacctcagcctcccaaagtgctggtattacaggcgtgtgccaccacgtccagcctgagccactgcgcccagcccatctatatagtttaatatcaatctaaatgaatttctcagtcctgagcctaaaaatttagttgtaaagaatgatatccttgactaataatagtttctattaatggattgcatctagtgctaggtggcatatatttagtccccacaactaccctggaaggtatttaaaatttttcacatttgcagataaggaaactaaagttcagagttcagcaacatgcttgaattcaagcagctcctaggatgttaatggtggaggttgggttcaaatccagatctgtctgactcaaaaaatgcatactcctaaccagtgcactatatcccaattccataggagcccttctttgtgattcatagcactttcccatgagttttgttgattttgtgagaaacaaaactctttttcctttggactgtctggaatctctctttttcaaatttttgaaatgtatttctatgccaaaagacaaagatttctagaggaatatgcctaggatgagaattatgtaatttaaatcacagctggaaagagagaaagtcctaagttactaagaaatgttcaaacacaaatgagctttcagtctattggaagacctttatagctagaagtatactgaactgtacttgtccatggacccctgaagaaacaggttaaatcaaagagagttctgggaaacttcatttagatggtatcattcatttgataaaaggtatgccactgttaagcctttaatggtaaaattgtccaataataatacagttatataatcagtgatacatttttagaattttgaaaaattacgatgtttctcatttttaataaagctgtgttgctccagtagacattattctggctatagaatgacatcatacatggcatttataatgatttatatttgttaaaatacacttagattcaagtaatactattcttttattttcatatattaaaaataaaaccacaatggtggcatgaaactgtactgtcttattgtaatagccataattcttttattcaggagtgcttttttgatgatatggagagcataccagcagtgactacatggaacacataccttcgatatattactgtccacaagagcttaatttttgtgctaatttggtgcttagtaatttttctggcagaggtaagaatgttctattgtaaagtattactggatttaaagttaaattaagatagtttggggatgtatacatatatatgcacacacataaatatgtatatatacacatgtatacatgtataagtatgcatatatacacacatatatcactatatgtatatatgtatatattacatatatttgtgattttacagtatataatggtatagattcatatagttcttagcttctgaaaaatcaacaagtagaaccactactgatattttattatttcatattacatataaaatatatttaaatacaaatataagaagagtttttaatagatttttaataataaaggttaagagattcgaaagctcaaagtagaaggcttttatttggattgaaattaaacaattagaatcactgttgatattttattatttcatattacatataaaatatatttaaatataaagataagagtttttaatagattttataataaatgttaagagattaaaaaactgaaaatagaaggcttttatttggattgaaattaaaggccaggcatggtggttcatgcctgtaatcccagaattttaggagactgagtggggaggattgcttgagcccaggggtcaagaccagcctgggcaacacagtgagacaccgtatctacaaaataattaaaaaattagctgggcatggtggtgtgtgcctgtatgctaccattaactaaggaggctgaggtgggagaatcgcttgagcctgggaggtcaaggctgccctgaactgtgattgtgccattgcattccagcctgggtgccagagagagaccctatctctaaataaataaataagtaaataaataaacagcaacaacaaaaacactcaaagcaaatctgtactaaattttgaattcattctgagaggtgacagcatgctggcagtcctggcagccctcgctcactctcagggcctccttgaccttgacgcccactctggctgtgcgtgaggagcccttcagccctcccctgcactgtgggagcccctttctgggctggccaaggccagagccggctccctcagcttgcggggaggtgtggagggagaggcgctgggggaactggggctgcgggtgcccttgtgggccagcgcgagttctgggtgggtgtgggctgggcaggccccgcactcggagcagccggccggccccgcgagccccaggcagtgaggggcttagcacctgggccagcagctgctgtactcgatttctcactgggccttagctgcctccctgcggggcagggctcgggacctgcagcctgccatgcctgagcctccccccaacctgccgctgcagtgggctcctgcgtggcccaagcctcctgacgagcaccgccccctgctccacggcacccagtcccatagaccgcccaagggctgaggagtgtgggtgcagggcgcagggctggcaggcagctccacctgcagccccagtgcgggatccactgggtgaagccagctgggcttctgagtctggtggggacttggaggatctttatgtctagctaagggattgtaaatacaccaatcagcactctgtatctagctcaaggtttgtaaacacaccaatcagcaccctgtgtctagctcagggtttgtgaatgcaccaatcagcactctgtatctagttaatctggtggagacttggagaacctttatgtctagctaagggattgtaaatataccaatgtgcactctgtatctagctcaaggtttgtaaatacaccaatcagcactctctgtctagctcagggtttgtaaatacaccaatggacactttgtatctagctaatctagtgaggaggtggagaacttttgtgtctagctcagggattgtaaacgcaccaatcagcaccctgtcaaaacggaccaatcagctctctgtaaaaccaatctgctgtctgtaaaatggaccaatcagcaggatgtgggtggggccagataagagaataaaagcaggctgcctgagccagaagtggcaacctgctggggtctgtagaagctttgttcttttgttctttgcaataaattttgctactgctcactttttgggtccgcattgcgtttatgagctgtgacactcactgggaaggtctgcagcttcactcctgaagccagcgagatcacgaacccaccagaagaaagaaactcctaacacatccgaacatcagaaggaacaaactcaggacacgcggcctttaagaactataacactcactgcaagggtccttggcttcattctcgaagtcagtgagaccaagaacccaccaattccggacacaatttgactgcagaaaatggatgtccaaccctgtggtttccctgggccacattggaagaagaaaggagttgtcttgggccacacataaaatacacttactatagcagatgagctaaagaaaagaaaaaagtccatgcgtaatctttgtgatatgtgccaccaccaataagcaaaattgttctcttattcaaaaggttggacacagctgctctagatattttattattaaatatgcaggcaattactgtttaaatgaagatttcctcacagaatgagattaaaagtatatattagtggcttagcattcattttagacaaccattttagagattcaaatcacacacttgcttacagaaattttgttgtcttcaatgtccccattgtggtttctttaccaagcctctactgttcttcacatcaccaagttaaaaaaaaaaaaggggcgggggggcagaatgaaaattgcatggtaggccacaagttcagatcctcatcgacacaagaggtgcctgaagcagtggatgaggcttttctatggatcatgagcagccacataaatgcttaaaagggcctggcagggagcatcagtgggtgatgtggctgggaggctgaatggagagcatttgttcttcagttatctatagaaggcagctgtcactcagcaccagctaagggcttcccatgagggaactggggatcaggtttcccagatctttttatgtaacaggataagacagagatccagctttttttgggtaattatttcctattttaaaatacgggtagttgattaaataaaaacaaacgaatgaacaccatatgggcacaacaaaacacatctgtggcttggattcagcttgtgaatgattactgcagatatttattctagaggacacccctgggtatgtcctaatataaaacctaaatctaaactcaagtcccatgctaccttcagagaataaatgacccagaaaaagaaccacctctcctaaggaagtataaatttgtaaataactgagacccaaacttacaactatacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttccatttgatctctgagtgtggtaatacatgttatttgccctgctgttgtaaataaacaaaccaaatggaggcttgatgcaagatgcagtgtagcatagtgccaactctggactccgactactcagggtgtaaattctaactctgttctattaacaccatgaaactgagcaagttagttaaaactcgctgggcccattttctcatttatacaatggagattttaatagtacagctacataggccattttgtggtttaaaatacatcatgattatgaaacacttaatgtagggcttgctacataatgagcaaggtttgttgctgttatcattaatatccttaattctcattattataaaacttgagatagtatgaggtgaacaagttcataacagcaatataatgaaaattttaataattccttttatactttaacaaaaatacgagattgggtaatttattatttttacatgagtaataaatattgcattaaaatatatttaaaatttaccacattaatgtctgccagtcatgccaaatgaccaacatgaatgtgaataaaactcagtctgtgcccatttaatcttaaccaaccctttataattgttaatgatttgaacctctgccttgaaagatcacattacttgattgtcttcaacttatctgaatgtggtagtgatttctgtaaatttataggacctttgtctcatgcagctccatggagttgaacttatgcacctttaaaatggtatatacttaattaattaagtgttgatctgcttcacatgtgtataatattattagctcactaaaccaagaaaacagtggtcctttagggaaagaaactaaattacaacagagaatataaataccatataaatatctattatttattgaactgtcacaattattgcaaaaaattaccttttagtggacaaaacaattgatattgcccttttctggaaaagaaataatgtaatatatgatgaatagttttggccagtatcctctagaccttgccagttaactggctctcaaaattttgaataataaaaacttggtgatagtagaaaaatagtaattttttaaaagtatgtgcacaattatacaactaaacaattcattcaccagtgttcacaattctattgccttctttgaatcaaaatttacatagtttttcttttagactaagctcctttatgataccagtgtgcccatttctcattaccattgaaatgtctcatgagcatgtcacattctggtacaactgctaatccaggatgacagtttagttcttttaaatccaattgagagccttctactcatgaccagagaacctaaagaaaggttaagatacatttattccttggtgtaagtgatttgtctatttttagttttcctaagggtcatatttcaatttagatttttttttataggttaggtaaaataggcttcccttttgcaatatgaaatatgtagtcttttaaaaaatttcttcaaagctattaaactgaaaaaaaattaatttggtctattcagtttgttagcacttaccattttggaaagagagtgactctacttttgtatttggtaacattttccctactacagggcagtatcttttgtaagttcttagatattagcaccaaataaataggcaaaaaaaatctattatgttaattcttagaacccctgcttggcagtgcatcattgactagatggagaagaaatgaaaataatacattaggaagcagtttcctggttcttttgaaaacaactagagagtcttgttgttgactggaatatctgaagatcctgtttaatgctttcattctatgattgttaagaatatgtcatagaactgctgtatcctgtttctttatgtcttcccttctgtttgttgattagaaatccctgagtggctttacattattagtacagtagatatgtagtatattcccataataccactgctgctattgactaatagtaataattttagggcagctttatgacagttggtttatgttttagggtgtcatttgacttgtgaagcattgaaatctgggtattaagcacactgttttctatgtggtatggaatgattcttaaagccctgagaaaatggaaaataaaaatatttttcctttttaccataatcacctatgactgtcactctatcataaactgcataaactttataacctcaaaacattttggaaatgaaatgacagaacttgcttactcaattgcttctatatacaccaaatatttttttaaagtattatgttaagtccttgaaaatattttgttctactcaatagaagcagtttaggttggtagttctatgtggaaacagtgaggaaataattttatattatgatgactagaccagtctttgaacatcactttggttattgttccattagtaaatattataattatttctgagatttactcaccttcaaagaatgttggcaatgccagcattattaacactcctctagttagaacaaagaggaaatgtaataacaaaacataataatagccaaataaagagtgacttagaatgtacacccttatctaggatcctgagtaattcgattattcttaggaaatacacttttgtgctagaacaaagacttttgaaatagctaatttctgggtttcttttcattttgaattaacttgaatttcaaggaaacaagggtagtttttacagatacagtgcatagaagctctgtgtacaatgaagaaaagtaggaaagtgagaaaaatgccattagatttttcatcgttatactatctgatatgtgaatttaactaaaacttatatacctcattatagtacttcctaatgtaatttcttaatttaagtgttccccataaggtttttttttatataaacttaagtactgttaaatatttaaggcaaattcaggtataaaataagacttgttgatatcttattccaagcatatttgtttctctcctatttatttttattctgtgttcatttccaaaattgttttactcacaactgtttgttttttctgtttcattctgtggtaaaggtatcatttggctaattgtataatttcagtgtcatttctaatattccaattgtgatagtatcaacacaagattaaatttctctacatggtttatgagaatggaatgccaaattgaaatagaacagagcacagatgatctaaatataaaaagaactacaaaaatcacagttgtttaaaaaggttttttgtttgtttatatatggtgcagaacatttgttccttagccaaatgtttccaccttgagaaagctatagagattctatgtagtcctagtaccaataatatgttttaacctgaatgtaccttatctttattcataaactgtgactttttacactgctgaaacttttttttttaagacaatctcactctgtcgtccagtctggagtgcagcagtggtgtgatcttggctcactgcaacctctaccttctgtgttcaagcaattctggtgcctcggccacctgagtagttgggatcacaggtgtacaccaccaggcctggctaatagtttttgatatttctagtagagatgagttttgccacattggccaggctggcctgaaactcctggcctcaagtgatctgcctgccttggcctcccaaagtgttggtattacaagtgtgagccactgtgcctggcctgaaactcataattcatttccattaatattaatctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatatctattttcttgcaataatagtatgattttgaggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggcatgcacatgtctcagatattataggttatcatatattgttgctcctaatatttctgtgttagataattagagtagcttggtttgtaagaatgtgatgttggtgggactgtagcagaacaagaaggcccttatgggtcagtcatacctctcttttcaaatatttggtctagctctcttctgggcatcttgttgccaatatatagtattgctcaaaagggcaggagatttgaagtgatcaaggaaaatatattttttctattgattaagtcttttgatggggtagaataatctaatttcatgtaactgctcaaagttatatggtagggggatcccaaatgtattttaaaactatttttatatcatcatatttgaagtaatagaaagtcagagtagcagaataaaggtactaaaaattttaaaaactaataaggtactttgaaagaaatcaattatgttgattcctcattaaacaaatttgcacttaaagactgaggttaataaggatttccccaagttttttcatagcaacctgtgagcactttctctgttgaggcatttatggtatgaaaagatgagtaaggcacagttcttgccctggagaaggtcacaggtgagaggaggagttgacacagaaacatttgatataaagcaaggaataaattccaagactaaaattttcagaaatctaaaaaactcaagataagaaaaacccattatattttctgggtaacaaaatttcagtgttattaacatgtaggaagatcttgatatttattctgaagcccatgtgtgttgctgaaatattgccgcatttgcatatactcatcaccatcctctgttttggagctaagaattttagactcaagatgtctaattaagttgatccattgattttattttttatggaaatctgagacccacagaaggcaggggatttgcccacatttctagaagagtcagacatgagcgatgaggcacagtggaaagaacatgagcattgcctgagctctgagttggcgctataagagcagtgatcatgggcaagtgactcttctgagccttggcctcctcacctgttaagtgaagaaaagaatatttcagaagatctttgtgagaatgaaacaaggcaatttacttgcctgctacatagccaatgggaaatcaatataagttccccgtggttcccttctgtggggttttgttcccacagagggtgcactggccattccacttcttcttttccaagctcctcattccctttaacgctgttcatagttggttccaaaccatttgaaatataataagcaccaggatggttttttctttccaccaaagcaaatttcattttctaaacactgtttataaatatcaatggctattttttcaatttttgattatcatgaaaatatacaaatatgtttaattaaatatgctaaagaatgtattaataaatatgtattaaataattcctacatataaggcctttttgcttggggtatgggtgatacaaaataaatgtggcatgaacccactgacctctagcaatttataacctagaaaaagagttatgatatgtttataagttcctgtgatataagacatgcatatagtcattataacagaggtgcaaacaagatgtatcaagtatgtccagaggaggaagagattaatcccagctggaggaaacactgatgctttcttgcagcaggggcatttgagttgagaaagggaggaaacatagattttgacaatgagagctgaggggaaaggggtttcaggtggagggaaccgcatgtggaaagcagggaggtaggaaagtgtagagtgtgtttaaagaatagaccagtttggctgaaacaggatatttgagcagaggaagcttgtactaggtaggtgggttgaggccaaattatgcaaggcattaaatattaaactaggaattttggactttatcctgcagtttatggggggtaaatgataagattcaatatcactttatttgtacagtattatgttacattttatctaattgtttgtttaattcctgtctagacaatgaattcctcaagggcaaggagcatggcttattcacctcagtaatttcagtgcctagcattgtgcctggtacaaagtggacacttgtatataaccttttttaattgaagcaacaagttgtcaaccttacaaatgtgaatccgtgattcagatgacaggttgaaatgtagattgtctgcgaagagggcagaaagagagtatgacaaaggaggacaagacagtggggcaggcagggagagagagcagccagggtttcggtagaggtatgtcaaaaaggtatggaagtcagaggagaaggagacccctatgttatagaatacaaatggaagggaaatgatgacaacagtaagttgtcattaaatgcaaggttgcaaaagtaagattgtaaagcaggatgagtacccacctattcctgacataatttatagtaaaagctatttcagagaaattggtcgttacttgaatcttacaagaatctgaaacttttaaaaaggtttaaaagtaaaagacaataacttgaacacataattatttagaatgtttggaaagaaacaaaaatttctaagtctatctgattctatttgctaattcttatttgggttctgaatgcgtctactgtgatccaaacttagtattgaatatattgatatatctttaaaaaattagtgttttttgaggaatttgtcatcttgtatattataggtgggattcttaatagattctccaaagatatagcaattttggatgaccttctgcctcttaccatatttgacttcatccaggtatgtaaaaataagtaccgttaagtatgtctgtattattaaaaaaacaataacaaaagcaaatgtgattttgttttcattttttatttgattgagggttgaagtcctgtctattgcattaattttgtaattatccaaagccttcaaaatagacataagtttagtaaattcaataataagtcagaactgcttacctggcccaaacctgaggcaatcccacatttagatgtaatagctgtctacttgggagtgatttgagaggcacaaaggaccatctttcccaaaatcactggccacaaagtgtgacattttggcattggcatcactatttgatggaagccaacctccccccaaaaggcctgtattagaatgaagatggattccctgggtgggttacacttgaaactagcctcacccatgaacactttggcacagattagctagcccattcccccacagtaaggaccataaggaagggacagaagcaaagataagttttagaacaaaagagaggggaaagaaaaaatctagggttttatgagggctgtccctgagtgatagatgtgaataggcctccagggcaggctggctcagaggctgactctttgggttggggtgactgattggtggtgaggatggagaagaaaaggggagtggaggaggtgaaagtgaccttgggacattaggtctccataagtgacaggatttaaggagtgttgtaagctgtggttgttggaccaggtttaagcacagcttcctgagcttcctgactggtttaggtcaagctccagagagcaaatgccacagtctcagtgatctccttggagaaacagttggaataggatgttgcccatgttgggatgagtcattgtccgctcttgctctttccctacccctgcaaaataataatactgtatttgattgaacatataaaacaaaagaaggattatcacataagtatgtatatataaccaacattggcaggtgcagaaaaaccagactgtcagtttgcctcatctgaaatgattgacacaaacaaatatatttactgtcccaagtgaactttggcattttggatatccttcagttgttctgtttaaagatataacttagaagcagctgatggaatatttaaatccatgcgttgaattcatgcattcaaagaaacatgtcctgagtcactaaatgctgacatttgtttttcatgttaagagtgtaaataactggtcccaaatataatattattacatcagataaaaactggaatgtgaacctcttaacttgattgtgaaagtatttgccaatggtgcctcttgataattatttgaggctcacttcagaactcctctggaagggttaatttttaaatagtcattttataaattaacatttttgacatatgtgatggctctcaaattttttcttttatgccagtttgaatcatttctgctcaatttttttttttaattgggatggagtctcactctgttgcccaggctggagtgcagtgatgcaatcttggctgactgcaacctccacctcctcggttcaagcgattctctcgcatcagcctccagagtagctgggattacaggcgcgcaccaccatgcctggataatttttgtattattactagagatggggtttcaccacgttggccaggctggtcttgaactcctgaactcctgacctcaagtgatccacctgcctcagcctcttaaagagctggaattataggtgtgagccactgcaccaggccctgttcaacttttaatgctaagattcatttgttgttgtttcacaagtgattaggcagaggtcttttatattaatttacccattttatttgtaagagagtctcatattaaggaagcataatatatgacaatccaaatacagtacaaatttggttaattttgattttgttaaataattaatcacaggggtccttcaaattgtgagctcctctggttatacttatgttttacctctggttatacttaatttcaaacaaatgaaatttcattctattcatgatatttcagaagcagatctgttgcacaaaataaagcatacctataaattttctttttttaaaaaaaagtctctgttcactctattttctattatttttctctttttaaaatttgaattttattgtggcaagtccacttaacatgagatttaccctcttaacagatttttatgtgtaaaatacaatattgttcaccatgggtaaatgttgcacagcagatctctggaacttattcattttgcactactgaaattttatacctgttgattagtatctccccatttccctctctcccctgtcctgttacccatggttctgttctttgcttctttgagtttgagtattttgatacctcatgtaatcttcattctattttctaactttgacaatgttctgacaaatttgctttccggattggagcactgtatagtgaaaattgaaaatcttggttattttctacagattcccactattttaccttgagcagacacttatcttgaagggtctcagatttgtcacttgtagaatggggaatataaacctgataatggtccctttcagttctaaagttatatcagttgaaaatacatgtgtcacttatggtaacgggtagagaactggctcactgaacagcatatggatattataaagtggttttttttaatcctttctgcagacagttactttatactttattcaaatggattattgtgaagtacatgttagcggactttgtaccttttaaaaatgtatgtatttggtgtaatgtagaaatatagaaatttattaagtatgatttatttcaatgttaagcatgagaaaatatgctccgaaaggttagatagcttgcctaaatgacaagcttgtatttcaagcagaactttctgaatcaaaagactccaagacgaatgcccagctttcaaaaactgtctaaccaaaataaatcctaagattcaccttcatactaaaattatttaaaaatagtttattttaaattaatattcacttaaaatgtatttatcatgcaatactttaaagtgtctgggaaatgaaaatatccaaagatcaaagaacaccatgttttcaaacttcaaaaatgttatcagtgacctaaacaatttttaaaattttcatagagcctatgaaaaatgtacttgcaaatggctactttctgactaggaatagaatggggagagtatttagtccaacaatgatagactggattaagaaaatgtggcacatatacaccatggaacactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaactatattacaaagtacacatggattttttttcttaattaatgaccatgtgacttcattttggttttaaaataggtatatagaatcttaccacagttggtgtacaggacattcatttataataaacttatatcagtcaaattaaacaaggatagtgctgctattactaaaggtttctctgggttcccaaatgatacttgaccaaatttgtccctttggcttgttgtcttcagacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatatacatatatatatatagtattatccctgttttcacagttttaaaaaccgatgcacacagattgtcagatagcaattctgtgattgaaggggaaatatgtcacctcttcatactcatattggtgaagggtcctagcttcaaaattaatagattcctaaagaggggaaatgaaacatccgcatttacacacacacacacacacacacacacagagttcctcttgtcggtaagttttgttttttttaaatctctactagataaaatttgttatctaattgtgagttttacacaaagaaaaactgtcacagaaaagaaagacagtgtcacatttttcaaaagaaaaagaagaaaagaaagtgccatgtttttcaaatacaaatgttctggattgattttaggatctttagtgaaaaacaaagtatttcataataagtaaaataaaaatctatgtaggtaaatttgtttctctaatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggcacaagagagtcagctgcagctcttcttcttgagtctatatctgtcctgggtccattcctttttgtggttgcttcattcctttctctctctgaagactggtttttctggtctaccagggctatgccacattgactttatgtagtgtctccattctggcctcctgaatttacaggagagttcctctgtacaaactcaaagtcctggagagaacagaaaacagcttccttttggctcaggggtccaactgcagtctactctgctgctatgaggatagtgggttcaccacctttgttgttctctcagctagggcagtgggaaatgactctatgaaaggaatatacatgggcaggcaaatgtactaatcctcatcagtactgtaattttaagcaactttaaaaaattcttttaagttatttgaaaataagatcaaagaaggctgaattacataaatgaagatttgttaacaattaattcaaaccaatataacacatgctataacatggttgagtgtgattgagtcttgatttattaggggcaataatcaaaacatttaacaatcattatagtacagaacttaccaatcaaatcagatgctcagccggagtggatgttggccacccagctattattatccctggctcaattggtcttcagctgtgttaacttgcaaacattaattaactatctaagcccctcattttcctcaagtgtaaatagacacaataatattacctattccataggtgtggggtgaatagtaaatgtaataatttgtccaaaacacttagtatagtgcctggtccatggtaaatactaaataaatgttatctgacttattattaaaattttatcttctcagcttaaccttcagaacagtaatatattggggtctagataaatcttgcctatatgaaaataatttaatactacatgcagatatatgctgtgtatattatgccttctgttagaggaattgcagaaacaaaaatttcaattaataataagatgaattatttctcccaattgtagaatcttttgacaattttatcatgcattacagatgtaagaactcttgattgggacttgatagtctaactttataataatttaagaacattcctcttagagaatttctatggccataatactgaacacatgaattttaattagctgtcctctttagccctaaaaaaaaaattactgtaatttaacacttaagtgttgttcttcccaggtacagtaatctttttttttttttttttttttttttgcatagagggtaatcttttctctttccaaatggcagaactgttagttttctgactgtccggtgaaattctaagtccacttacttcccaatagcatgcaattagcaaaggtcctccttgcaaaggcacagaacacacctaaacatcttgcagatgctgtttggacactcttcccctgcttttggtctctttgtaaagcagctcatctggatacaggatctcttttccccattgcccattctaatatatgttaccgttattacttatagaataatagtagaagagacaaatatggtacctacccattaccaacaacacctccaataccagtaacattttttaaaaagggcaacactttcctaatattcaatcgctctttgatttaaaatcctggttgaatacttactatatgcagagcattattctattagtagatgctgtgatgaactgagatttaaaaattgttaaaattagcataaaattgaaatgtaaatttaatgtgatatgtgccctaggagaagtgtgaataaagtcgttcacagaagagagaaataacatgaggttcatttacgtcttttgtgcatctataggagaaggagaaggaagagttggtattatcctgactttagccatgaatatcatgagtacattgcagtgggctgtaaactccagcatagatgtggatagcttggtaagtcttatcatctttttaacttttatgaaaaaaattcagacaagtaacaaagtatgagtaatagcatgaggaagaactatataccgtatattgagcttaagaaataaaacattacagataaattgagggtcactgtgtatctgtcattaaatccttatctcttctttccttctcatagatagccactatgaagatctaatactgcagtgagcattctttcacctgtttccttattcaggattttctaggagaaatacctaggggttgtattgctgggtcataggattcacccatgcttaactgagtggtgccaaattgtcctcaagtctgttgtactgatatatatccccatcaagagagtacaagaattctcatagctatgtatcttcaacaacacttggtgtctggtagatgtgaagtgattactaaaaatatagggaagctgcatacataattattggcttttgctgttctcttacattaatttcttattcatgttgattactcatttgtcacctagttttttcttccttaattaaattgtaggaatttatgaattatggattgatcatcagctctatacatttcaaacataatccctcagtcagtggcttggcttatagagtcttttgatgaaaagaagcttttaagtttaataaagttcaatttattgtcttttcctttatgttttgtgcttttggtatcttgattaagaactccttccttatattgggttctcaaatttagcagcataacattttcatactattatttaaatttttttcacattatttagtgatagcacctttcttattcctaaagtgtttatcattgccttctgtctttctgcttgataaatattgccacacatttgtatactttattagtgtgtacaaagaccacattttagttgtgttatttctcttgttttggttttctagaatgcagagccattaatattatagtaatgcttatgtgctaataccatatcaggggcacaaatcccattgcagcgggactgagaaattaaaggaaatgatgcacatttactcatttttgtttaaaaaatcaaatgcatatttttcaatcagactatatggttggtctggatagcttcatcattgaatttttaaagtatttttgtactactgtatttaaaattattcattcaccactgcttttgtagatggtttagaaacccaagttaggaatgactgtgcaacactattattatactctttttaaaattatactttttgcttaagtttctttccttgttctctgagacagtgttcatgttcccaaaccacacacatttattcagctataaaatttgtatgatcaactcctgtcagaacaaacatcattataaaaaatatctccaggaaaaagaaaacccttttaatgctctcttctggttcatgtgtcttcttattttctttaagcattttcataacccattgagctgtaatttaattggaacatgatttatactaaagttggtttctttacctttaactttttttttttagtttgatcagctctctttagcttctgtagttcggtctttaattccattccagtatgcttttggagttgggtctcataaatgtatagaaatgtttctgttgggaaacagcaggagaatattaaataaatattgtgcttacatctatttaattctttgcccaactttctacaactttgactttacatttaagctcctcatgcacttacatgtttctttacctaaaaatatcttttcaccatgggtgtgtacaattcctttgtccttgctgtattaattttcttggtttacatagtagcctctacacattgatgtcaaaacctctgtttggtgcatttctactctgcgtgttcaatctccatgaaagtttctgtaaggtattttcattcctctagtttttcacatgtgcatcctggctttgtgacctgtgctttgatatcgtgcctttcatcttgtggcattgaaggatctttgcaaggacctattgtgttataatacagtctatgaaaaatatcaatatttgcatttgatcacatttaaaaaaatcacattcttttgtttgaatatcaaagctaatatgtgagtgatttccctgccaaatagcacaagtagcctttcctgggtgtttatgggcatttatctggttaatgattcccatcatagtgctgtcacccatgccattgctaaacttatacagtaacttttttgttttcacctcagcatatgttgagagtaggaaatagataggactatgccctcaaattttacgtttatatgatgttaatcctaaaggtccttgtgacttctgaagtaaaaactcagtgttgtcattttacttactgaattgttagctgagtttagagttgagtttacaatggagtaaacaaggtgtttagtttgatgtatgcttttagtctttcagaaaaaaatgtttatacttggaaagaatagtttatttacccatctggcctagtttagacaaaaacacagagtcaaatgtcaacagaattctgaagttataaaaatgacagtgtggctttttttttttttaaccttccacctggtgcttatgcccaagtgcctagctttctttagctctcaactaataaaggtaatgtttagataacatttaacgttaagttgcattgtgtttatgatcacatatctcaaatattggtacacgaaactgtacaacaaccttttttattagattttcctacgaaattccttattatattccctaagatagctttttcccaccttcttcttccttctcccttctcaggtgctccaataattccaacccctgcagccagtgactttattatatctttttttaaaaatctaaaaaaaaaaattgatgcaaccaggaagaattttctcatttctctccaccagttgtaccagcctactgcacctctcctcatgcaccaccttctgcctgtgttcttgctcctatattcaggagcaagtaatatgcaatacctccctctttgtgggatctttctcattagcataaaaatactttcccttgatctccagctactaccccatttctttgacctacatatagcaaaatatttgagaaaggaccactttccatcttttcctcaatctacttccatttttttctcaatccactttcatttcattgttctcctcaacccattctttccacaacctacttcattttatttccatcagccccataactcaggatcaacatcttgccagagccaatttccttgtctcccttaacagctccagcagtatttatgccatggacaaattattcttcttgtgatactttctctcttgcttccatgacactactcccacttcattttctttctacctctctggctcttccttggtcccttttcctggccccttctctctttcagatctctaaacatcagctatatctcagccctgttctactgacactctctagctgttattttctaaacccatgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacacaaagaaaataaaccatctcttgatgaatcataaatttgtgtctctagtttagacctctatcctgctctctaaatgatgtatccaactatcatcttgacaccatcatatgttcataaaacataattatagaatatctttcagtaggcttgacattttaaggcatgagtttccgttcagtatctccttaaaatatacccagggtctcaggagactattcaaacaggacaaagcttctattctacttactaatgtgtctggccctatttggcaggttggataaaaagtcatctgaacattgtcactttatgaataatatagtttaatagtttgtgaatcacccctgcaatttaaaaaatagtaaaattatcagaatctaatttaataattcctattggaacaccccatgttaggggatttccagttatttcaattgatatctcaatgttttaaaaattgtttatttctattactaattcactctttattttaacataaattgtggctatctatctctattcatttcaattatatttctcataccattctatagatggggtgaaaagaaaagtgttaattttttaaaactccatacctcaaatactatatgaatttatagttgttattgctaaagcaattatcttacatcttttcctccaaaacaaagttatgtgctggtttattttctttgtactcataagatgccttccatttttagtaacataagtcttgtctttctcctattcttagctacttaagcattatgtagcttaaataagcactaaagattcctatctgtatgaaaaaataaagattaaataaataagatctagaaagggtgacaaggtgatgcttcaaaatgaaccataccaagccatctagcgattgataaattactcacactcataatcacattgttggaaagaagccattgacaattcagtttgtttcacaactgtctatcacatagtgagcacaactaaaagactactttttgtcttttactgcttgttttgttgatcaagtgactgattgtacaatgaccaacaagaagtctgatgtgtagagaaaaggggaacctggcttttctgccttactcctgatgcctaattctgagcatgtgaatattattctgtttctttaattctccaagtgaagcagcagataaaccatccttgtttccattagctgtctaccctgttcaactgtgtgtttctaataacataagaataagaaagccaccagggtgagcagggaaggcaatgagtctgcaaggcttgtggatagatttctgttagtgaggctctagaaagttcttccaagattgatgcaatctgagaagagttttctgtcaatacaaactccctgggtttctcctttgtccttttactgcctgtgtttgttttgggttccagtaaagatcaagtgactgattgtaccatgaccaacaagaagcctgatgtgtggagaaaaggggaacctggcttttctgcattactcctaatgcctaattttcttgtactgaaagtagtttttgctgtaagaatctgaggggaggagtcatttcttcaatttttttttttggtctccttttaatggtttcttgatcatgtctatccttatttttctgttttcacaaatttttgtggtatattttcctctcatgacctctgtctcaagacttctttccatccatctcttctcatttcatcctgtagagtgtctgtggtaagagccctgcattctactctggccttgccatgtgtggccttgggcaagtcctagcctccttgagggtcttatttttctcatttgtaaaatgaaacagtttgatgagaagttttctaaggttccttcaagctttgacaatctctctcttctggatctttttcccatgaaaaatttcaactcttgattagcatgtaggcagggattattccacatccttataggaatcacatttctgctactgtccctgaatgctagagtccattgattaagttattcactgctgcaattgtcagagctgatcaaagaactctgaaccagtgtgttactagaactaacaaagaaaatgccattatgatgttctagagtcttgaattagtagaagaggtttaataagaaccctaagggattgctagaatgttaaaaacaaacaaacaaaaaaaaaggttgaaaagtttagaaaattcactggtctttgtgcccatcattttacttccagggtttagataatctcatttttgcaatgaaggaatggattagatcacaagttctcatcctagtagcacatgcagaatctttataaaaacacagagtagccaggtgcggtggctcatgcctgtaatcccagcactttgagagcctggggcaggtggatcacttgagaataggagttgaagaccaagctggtcaacatggcaaaaccctgtatctactaaaaattcaaaaattagccaggcatgatggcacatgcctcccagctactggggaggctgaggcaggagaatcgattgaacccgggagatggaggttgcagggagctgagatagctccactgcactccagcctggtgacagggtgagactccatcacaaacaaaacaaaacaaaagaaagcaaaaacacagattactcagggtccactaagaccagtgaagtcagttctcttggtagggggcagggtgactgagcatgatgtttgtaattttaaaagtgctccaggtgattctagtgtgtatcaagcaagacttgtgaaccactgaactacatgctaagactcattttagctctgattttctgtgagtcatagcagagggctcagcaaactttttctataaatgctaagatagtaaatattttcagctttgtgggctgtatcgtctttatgacaactcaactcagtctttgtagagaaaagcagctgtacataatatgtaaactaatgggagtagctagatgtgtcctgtgggccatagttttgctgactcctggtctatgtcatagaatttccttttgaattgatggaccaccagcaaatgatttttgtcctgtatcaatcaatgatacatacataaatctctacaagacatgtaaaggatgaggcttaatgacagagtactttggggaagacataatattgcaaaattaagatgcttagagaaaaatcatattaaaatagtgaaaactgtgagaaggtattttgatttgttgttttggattcctctttttgcaaattcttttgaaatattttcagtggaagctacatagatccaattgtattcaccaagctagattgtaattaagctccagagtaagtaatagatttgatgagtgatgtccaaccttttacatggaagagtaagtttgagtcttcctttgcccattgacacacttagtaccatgtttaccaaagttcttagttattgaaatgggcaccagcatattttgaaacgttggtgttaacttgggatatgccttttgtcatgttgcaaatagattttgtttctgttttgtgaagatcaccatctctgtcacttctgatagaaaaagtgacactgacttctcaagtgatttgacacaggttaaaatatgtaaaccatttctgtagagagcaagctgtaataatatactaaagggctaggtttatagtataatataaataactcatttatgctgttaataatttatagcaacatggcatttgactgactttttatgtgctctagtcatgtaagtaatagatgtggaaacatagaccagagtttcaagaacatgttttgggcagagtctgttttcttgctattatctcttaagtttatgttcatggcctaaagattatgctaatggatctgccttggtcttgggtgtcaggtctgtgttagcgagtattgaaaagcatagtttttgcctactgggaaggatttatgatttaaaagccctaaatctccccttttatgtacttcatacttagaaaatttttcctgtaaactgtgtgacttttttacattgtgccagttttctagatgactctcgtcatatttatttcttgcaatccttctataactatcagttatgaagtctctttatagtgttgccagccaggtctcaggtgtgtgaaatgtattttctattatggattttggggtatgatggcacatagtttgggtgttaatgcctaatcttgatgtactggcttctgaacaaccaaaaggatgaaaggaaatagaacaaatatttttgtgagggagaggagtctggcttcttgacttactctagaaaaagcctgtaagcctcctcttccctccttgtcacacaaagtgacaaagaaaatcaagaattgttttcttcttggcttaaatgcatcccttataaagtaaggctgagatcaggctgtgaagctatctttttgtcaagactgtcataattccaaaacactttgttcttctaatgcttaggttagtaactttaaacatttttataaagatagtgaggtccagttttaaggattgaccccttctcaaggggctcagaagaggttttggagaataataaaattaaataatgaaaccaataatttaaaccagatcatgatccttaagaaaaaatcccatcaaatttgggctaaactctaatatacagaggtctgcacaacttatgtcaagtattcttccccacaaatgaagaatggggttcattgtgtcattggttgggtctcattttggcttcatcttctatttctcaaagtctaagaaaagtgctcctacggaagtgggtgttggctatcatgagactttgctgctggcaggccagcttgctgctctagacagagatatccctcgatcctccttggacaactcttttctgtgcacaggaagcagcaggctggggttaaggagtttgccaatccagtcattctgataattgctgaatatgaatttctatccagcacaatctaggtagctacaatggcacagtagtttttatgtatcaggtgaaaatgtttaataggcactctaaatgagagaaaaggttaagtgaggttaaaagctcaatgaaaacaaatagatgagactaaaaatagttcaataggttgtaacttccatctcatccaaacagcaatgaatattttgaggctgaggcgctgaggggtaaaattgcagcctggactacttgctaatgtagacctacagcactgtcattcttactgcacagacactgctttctgcataggaggtagaataatgaattcatttattattaacaaagatttattaagtgactgcatggtgctaaccactagatggggagggatgttttgaactgtccattgtttgactataacaaggaacgctttgaacgaggttactatcataggcagaatttgtttaacatgaagcctatgagacataagccacaggtcctctcacgtgcaggaactcctttgaaggccctatacttaattttatatgcatagtttggatttggattcttttttttttaagagttccccaaattacttaagcttcaggctccacaaaacctggatctacccctggtagcagctatgaatctttgactatgaaattaagtgtacaagaaatatgactttactttttctgtgattgagtttattttctatttgagcacgcattccactgagtgaaagaaataatatcattgaattcagagattttgctgggttctaagtggagtttacagaatgccatgatattaggaattaaggagtgtgttgccctacatcatcttttgtccgtgctcactgtctctgaggcactgatgttcctatgtgacctagaggggcatggtccaggtagatggagtctgtccttgttctcactgtgagctctcgcttgctgacccttcttcagtttcttccatgcccctgaggggtaaaaagattcaaatctgaagctatatcaagccatctgtgcatagacattccaagcaaccatgttcactctactgctcccatgtcatgcaaggcacaggaagcttcactatggcatgagtatttcctgggctttgccttggaattgaggcacgggcctcctttgttctaaaattccccaaatctacttgaggatagaaccaggatttggttgcaaggcagaacttttcttagaggacctggtatctaaaccctcttgttacccccatttatggaccccatttatggggtgaggagagtgactgcttctaatccatcataatttttgtctatggctactgtttttgcatagacactatgttttgagtccttaggctttggcttttggcgcttaatggccaatattcacatggctcaaaattttcaaatgatccatatctgacttgagtttcaaaagtcagtttttgaaacttaaatgatcagaattgatttgttctgctctggttctgatgtggcctctccttccagaggtactggaggtagaatatccaaggtggaaagcccacgactacaaggaattggttagtaattcataatgttagctgtccacatctattcagtaatggcatttcagtggctgcacaactgaccatggtgaaagtgtctgcacaagccactttttcttcctgtcagaaaatgttctcacccactgaattgaatgactgtctgctcatatgctgtgaatgagtgcccagtcttaagattaaatcacacgttcttggctatgcatatttgggcatgctgtggggagttataataggctgtcttagagtcacattaagcagctagacagacaatgagttggaaagttacattttctaaatttgattggtacattccatttgtcacatttgacattagaagttctggattcaccctctatggtgagcttcactaatggagaatgtaatttgcaatgctcaaacacaagtcctaaacagaaaacattgtatgttacattccagtgctaccaaaatagtggttttgaaagtccttattttctaatactactatgtgtaattttgagtcatttagatagcaacagttaaatgttttatagattgtttggaagtattaaaatgtgaaggatttttgttatatagtgtctttcctatcttgcttaataaaatataagtttagaattgtgtatagaattaacatgcaaaaatatcaagtctcaactttatacagttaatctacatttgtgtatacccttcaattatttcaagagagggatactattcttatgcaggataaatacaataagatattttaaatgaattttaactacatctctggcagtttcatctcaatagtagttgtaattttatctcccagaccttattatagactagcagctctctatgaaaattagtgacagtgtgagtgtattttaattcaaagttaatcaagaatgactgagtcaagagttagctacccctgaaagtaactcataattcagaatttaaaatattacatgtggaacaatcatgactatatgccttttactttctctatcattatttaggttgtgggctttgggtccttttcacatccgttaacagtgggcttgacttcaaaggattattttcttgaatcttgaataattgctgaagacaatttgaagatattttcaagatgaaggaaactgaagcacagaatcactagagtgaaaaaagaacttcacaaacagtgcaggcttgatcaatggcatgggaaaacaggcaatacagttagaattgctaagatggaattttaacgttcaattaaggatctatctctaaactcctctgctttatccaccaatcattccatattaaagatgaagaattgttcccatttcaccttttgataaggaaaaatagaaataacagaagcaaatacacttttgcccacatttttttccaaaaagaataatttttgaagtctaaacgtttggtgtaaataagatgatgtgttaatattgtaaaggaaagctagttaagtttttgactgaataaagccagcatcaataattactagtaagactaaaaataagagcagtaaaattgtgtctaatcagctactaatatctgggaaggattgagccacaggatcaaagatggtatcttttaaaaatagaagttgagtgaattcggtcttcaaattctttctttttattcatttatatttatttactcattagtatattcattcctttattcatgtattgttcaaatatatattgggtacttattatatgccaagttgtttttaaaatcacattccaaattcccgtaagtcataattattcagagatgtatgttttttttaaaaaaaattgaacacctttaaaaattatcaagtccttttatttctgtatgcattaaagataaactttactaaatgttacatgaatagatttataaagcagataaatatttaatttcaaatataacccttatatgcaattatattttccttagcactaaaaatgaatatttaagtaatttatattaaaagtgtaattatttaactgcagatgtatgccaatgacttaaattgtttaaagattatagcaaagttgtttaaaattgtctaatcatgaagagttcacttaaccacctggttgacacataaaattatagttagttactaaggtagttcgagagaaagagaagaatcttcagtagtggttttgaggtgtggtacattttattataatataccggttatacagcattgtgcagtgctgctcatagtagaaataaattttctctttgatgtcatctattcccttgtgtggcttacataactgagaattaggtgatcacaaaaataaacaggcctatacagagcccatttatataagtcctggttatttctcttcagttaaacttttaattatatccaattatttcctgttagttcattgaaaagcccgacaaataaccaagtgacaaatagcaagtgttgcattttacaagttattttttaggaagcatcaaactaattgtgaaattgtctgccattcttaaaaacaaaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatggagtcattatttttaatatgaaatttaatttgcagagtcctgaacctatataatgggtttattttaaatgtgattgtacttgcagaatatctaattaattgctaggttaataactaaagaagccattaaataaatcaaaattgtaacatgttttagatttcccatcttgaaaatgtcttccaaaaatatcttattgctgactccatctattgtcttaaattttatctaagttccattctgccaaacaagtgatactttttttctagcttttttcagtttgtttgttttgtttttctttgaagttttaattcagacatagattattttttcccagttatttactatatttattaagcatgagtaattgacattattttgaaatccttcttatggatcccagcactgggctgaacacatagaaggaacttaatatatactgatttctggaattgattcttggagacagggatggtcattatccatatacttcaggctccataaacatatttcttaattgccttcaaatccctattctggactgctctataaatctagacaagagtattatatattttgattgatattttttagataaaataaaagggagctgaaaactgaattgcaaactgaattttaaaactttatctctctgtggttaattgcaaacacagatacaaaaatatagagagagatacagttagtaaagatgttaggtcaccgttactaacactgacatagaaacagttttgctcatgagtttcagaatatatgagtttgattttgcccatggattttagaatatttgataaacatttaatgcattgtacaaattctgtgaaaacatatatataggatgtgcgaaaagtccctgtgtatcatgtgaaatggcttaaaacagaacaccataggtattcatatcagtgaataccataggtagctgaaagtgttttttcctggggtcgccaagatgaatgccaaaagtgatatcattattataaacaatagccagaataggttggtataaacctggtagaaagccttgataaattgactttctctcctcctgacatcctgccacccctttgctttgctgatgctcatttgtccactaaattaaactcaagcaagccctagtaaagtaatagaatttgtggagtcctcattagtataggaagtttccctgatgtgagattagtaattagagatgtagcaaaatgagaaagaagtaatatgcttagatatttcattttctctgaacctgtatatacaaaataggccatgcgtgttcagtaactattcactgcaaggcactctctaggtactttgggggaattggaaattactcacataaggctatggattgtgccatttgtcaaaagacaaaatgacaacaaatttagtttaaagacctcagtcagctttattttctattctagatttggacagtccttcatttcacaaattggagtaagtgttccaataagttgagcaaaggagcttggctttatagacccaaaaaaagggccaaaggaagcagaaacaaagaacaataagagaattggtcatttcaaagttacttttcttgaaaggtggggacaaggagacagaataatagaaaagtcactgattggttaacattggattaagaattaaaacagaggaaactttaagattgaagtttgaaactgacttgtttgggaaatcaggctgtcttctttcttgatttcttagaaggccggataacaactgagttttgctttggtgaacatgggtgactccatttttacttttagtctggtctgttgaggcctcgtgagagagcttaatctaaaacaatgacttcctataatttttgtttgacacatccaaagagggactctaatatttattgagagcttatcatatcttaagtactgtttaaacacttttatttgctattacatttgatcttattataactctaaaggcagaaatgattgcttttattttccacaatggaggaaactgaggttcaattaagtgagtaaggaagcagggatcttaaacccagataccattgctcctctttaaaggtggaagaacagaaaacatggggcaggggaagagagaaagtttctgtcccaggacatgataatctaaaagggaaaacgtaagatccactgaaacctgaggcagatttattgtggcaataacaaagcttaagtttcacagaccttcatttgcctgagccaactttgaaggccatgtatctaattttgtttttataattctataatctttattcttgaaaagagccctccctccaaatttacaagctttgggcccccaaaatccttgaaatgcccttgaataagagatatccaggtaaatgctatgggaattcagaggaggaagcagttagtatcagttggcggagagttaggctattaagagaaggttttatataggaagtggcatttagaatgaagctttgagaactgagctgtgtatttgaacaagtaaaggtggtgttgcagaattttgctccttagttctattaaaaacccgggttcttgtcacatgatccggaaaatttaggcacacagatacattgaagcatgagtagagcaggattttattgggcaaaaaggaaaaaaagaaaactcagcaaatcgagatggagtcttgctcacagattgaatcccaggccaccacaaaggaactgaagagatcgggcttctcccctgcataaggtgcaaattccccatggctccacccacttccccttagtgtgcatgtggggctccagtccacggtgggcatgcccagacaagccttgggcaggttccctcatctgtgcaaaagcatctgatgtaaacacttgaggggtggttcggagattctctgggacccttttattttcttatctgcctaggcatttggctgtctcagtgggtgggaaagggtgctccaggcaaagggcataacatgaggcaaagggcatgcacagaaaacagtgactggttcagtcaggttgggggatgccaaaggaagtaatgggagacaagattggagcaagatagataagagattgtggattttttttcttttttatctatataaatacagagacagggtctcactatgttgcccaggctggtctcaaactcctggcctcaagtgatcctcccacctcatcctcccaaagtgctaggattacaggcatgaggcactgtgcccaacctccaattttggattttgagagctaaagcaatatagtcgaaaactcagataatccaggtagattttgctattaggtgctatttggttcctggtacagagctaaaacccttggaatttcctaagtgataagagctacaggagcatcttttgttatatgtttccccccctagttcctgaaatagctctagagaaatacaggtgaataacatcctttgttattcatatcaagcccctatcaaccataccccagtttctatttatgaagtggcttttgggaagtccctaaagacaggagtggggaaaggctggttgtcagggggatgggttgaaactttcatcttccccccttgacctccagggagggatgagtggctgaaaattgtgtaaaatcaacaatggccagtgatttaatcaaccatgcctatgtaatgaagccacccgataagccttaactggaactttttggagagcctccaggctggtgaagacattgaggtgctcagaaggtggtattccagagagagcacagaatctctgttccccttcccacattcattttgctatgcatctctcccatctggctgttcttgagaggtatccgtttataataaactggtaacctagtaagtaaactgttaccctgagttctgtgagccattctagcaaattatcaaacctaaagagttcatggatacgtgcaatttacagatgcacagtcagaagcacagatgacaatctgggcttgccattggcatttgaagtgtgttgggaggcagtcttacaggaatgagcccttatcctgtggggtctatgctaataacagacagttgtcagcattgcttggtgtcgaaaacccacattgttggtgtcagaagtattgtcagtaggatagggaaaacagtttgttttctttttttagtggtctttggtcatctttaagagcagggcttctcaaagtgtggtccttgaaccagcatcacctgtaccacgtaagaacttatgagaaatgttcattcttgggccccaacaaagaattaaaaattctgagggtgtgaacggggtctgagtttcagcacaacttcccgaccatgctgatgcattcttgcccaagcatgaaagccctcccttgtttaagaaggccattagggccgggtgtggtggctcatgcttgtaatcgagcactttgagaggacatagtgggaggatcacttgagccctggagttctagacaagcctgggcaacatggcaaaatgctgtctccacaaaaatcacaaaaattaggtgggcgtgtgttgtgtgcctataggcccagctacttaggagactgaggcaggaggatcgcttgagcccaggagattaaggctgcagcgagctgtgatggcaccactacagcctggatgacagagtgagacactgtctcaaaaaaaaaaaagaaaaagaaaaagaaaaaagaaaggaaaatgaaaaagaacgccattaggtataaaggagcaatggtaaaagaccagttgcaaaaggttagggaatgggtggttactgaaataagaagctatgtagaacactagtgttggtggcaggaagtagaaagcaagagcactgctctgtgggggatggtcatagcaaatgcaatatggaggcatttgcctctgcactgaggagaaaactatcttttccaagataggaggaaaggagataagtggaattaaagagaacctttgagcacagagttgggaaactgaaggtatttgtgttgtgctccctcaatcttttaattcaactataagctaaacccatgaaacttgagtagtttcagttatctgacttttttcttctcttttgatacagtgttggctattctgggtcttttgcctctctttatgtacttaagaatcagtttgccaatgtatgcaaaataactggctgggattttgattgtgattggcttgaatctatagatggagttgggaaggactgacatcttgacaatgttgaagcttcctattcatcattatgaaatatttctccatttgtttgattctttgatttcttttatcagaatttagttttcctcatatagtcttttaaaatattttgttatattttgttcaagtattttgtttttgaggaatgccaatgtaaatggtattgtgattttaatttcaaattccaatttttcattgctgttatataggaaaatgattttttttgcatgttagccttatatctttcaactttgctataatcaattattgatagtttcaaggattttttggtcaattattttgaatcttctacatagattatcatcatctgaacttagttttatttcttccttcccaatctgtatacctttatctccttttcttatttcattagctaggacttccagtatgatgttgaaagtagtggtgagaggggatatcttggtcttgttcttgatcttagtgggaaaacttcaagtttcttatcattaagtatgattttagctggagggtttttgtagaagttttttttttttaagttgaagaagtctccttctatttttagtttgctgatttttaaaaagaatcaggaatgggtgttaaattttgtgaaatgcttttctgcaactattgatttgagcactttatttttcttctttggcttgttgatgtgaagtacattaattgatttttgaatgctgaatcaaccttttgtacctgagattaatcccgtttggttgtggtatataattatttgtatacatgttgagttcgatttgctaatactttttgagaatttttgcattggtgttcatgaaaaaatattggtgtgtagttttttgtgacatctttatctgcttatggttttaaggtaatgctggcctcatagcatgagttagggagtatttcctctacttttacatttgagaagagattgcagagaattagtaaaattcctactttaaatattttgtggaattcaccagtgaacccatctggacctggtgctttctgttttggaaggtcattaattattttaaaatagatataggcctattcagattacctattttttctcatgcgagttttagcagattgtctttcaaggaattggtctatttcatttaggttatcaaatatgtcaacgtagagttattcatagtattcttttattatccttttaatgtgcaagggatctgtagtgatgtccccttttttgttttattgatattagcaatttgtgtcacatcttttattttgctttgttagccaggctagagatatctctatttttgatgtttttgatgaaccaactttttgttttattgattttctctgttgatttcgtgatttcaatttcatgatttttaaattatgcttacatttgatttaatttgatcttcttttgctagttatccaaggtggaagcttatattgttaagatccttttgcattcttatgcattcaatgatgtaaatttccctctaagcactgctttttctgcatctcacaaatattcatgagttgtattttcatgttcatttagtttgaaatatttttaaatttctcttgatatttctcttttgacccatgtgttacttagaagtgtgttgtttaatcaccatttttaaaaattttctagctatctttctgttattgatttctagtttaattccattgtggtctgagagcatatattgtataattttaatttttataaaatttgttaaggtgtgatttatggcccagaatgtggtctatcttggtgaatgttccatgtaagctttggaagactgtgtattctgctatatttgaatgaggtagtctatagacatcaattatgtccagttgattgatggtgctgttgaattcaactatgtccttactgattttccacctgctagatctgtccattctttgcagagggacactgaagtctccaactctagtagtgaatattctatttcttgttacagttttatcaacttctgcttcatgtcttttgatgctttgttgctagaaacatacacatgaagaattggtatgtcttttggagcatgacccatttatcctcatataatgcccctcattatttcctcgccctgatgtctgttctctctgaaagaaatatagcctctccaggtctcttttggttggtgttaaaatgacttaactttctttatcccccttacttttagtttatatgtggttttaaatttaaagtgggtttcttgtagacagcaaatagttcagagttgtttttcgatccactttgacaatctttgtcttttaattggtatatttggactattgatattttaagtgattattgatatagttagataaacatctactatatttattactgttttctgtctgttacactacttgttctttgtttatatttttattgtctactctttttctttccattgtggttttaatcgagcattttatatgtttccattttcttttcttagcatagtaattcttctttaaaaaaacattttttagtggttgcccctagagtttgcaatatacatttacaactaatctaagtccattttcaaataatactaaataatttcatgtgtagtgcaagtaccttttaataataaaacactcccagttccaccttccagtctcttgtattatagctataatttagttcacttacatatatgggtatacctaagtatatacattatcatatttatgattgaatatattgatgaaattattttgaaaaaactgttatcgttaaatcaattaagagtaagaaaaatagttctaattttattataaaatgaaataccttcatttattcattctctaatacactttctttctttatgtagatccaagtttctgacctgtataattttccttttctctcttcagcttctttgaacatttcttaccagccagacctactgacaacaattttccccaatttttgtttgtctgatagagactttatttcttcttgacttttgaagaataattccacagggcacagaactctagattggtgatttcttcccctcaaacccttaaatatttcattccactgccttcttgcttgcattgtttctgagaagttagatataattcttatctttgcctttctataggtaagatgttttttcctctggcttctatcaagattttttctttatgaacatgatatgcctttctttttgaacatgatatgcctttctttttgaacatgatatgcctttgtgtcggattttttttggcattattctgcttggttttctctgagtttcttggatatgtggtatggtatctgacactaatttggaaaaattctcagtcattattgcttcaaatatttcttctgttcttttttttcctttattctccttctggtattcccattacatgtatgttacagtttttgtagtcatcccgctgttttggatattctgtttttttcagtttttttttccttcgcatttcagtgttggaagtttctattgacatattctcaacctcagagattctttcttcagctgtgttcagtctaccaatgagtccatcaaaggcattttacatttttattacagaatttttgacctatagaatttcttttgattccatctttgaatctccatttctcttctgcttttcatctgttcttgcatgttgcctactttttccatgaaaacctttagctttttttttttttctttttgaggtggagtctcactgttgcccaggctggagtgcagtggtgtgatcttggctcactgcaacctctgcctcctgggttcaagtgattctcctcctcagcctcccaagtagctgggattacaggtgcctgccaccatgcctgagtaatttttgtatttttagtagagatggggttttatcatgttggccaggcgggtcttgaactcctaacctcaagtgatctgcccaccttagcctcccaaattgctgggattataggtgtgagccaccatgccctgcctttagcatgttaatcatagttgttttaaattcctgatctgttaattccaacatccctgtcatatctgactgtggttctgatgcttgctctgtgttttcaaatggtgtttttttttttttgccttttagtaagccttgtaattttttattgaaaggtggacatgatgtgctgggtaaaaggaactgtagtaaataggcctttagtaatgtactggtaggtgtagcagagggtgagggaagtattctgtagtcctatgattaggttttagtcttttagtgagcctgtgcgcctgcagcttggaagcacttgtgaagtgttttttcaccccttttggtgggacatagtgactagtgtgagcgggagttgagtatttcccttcccctaggtcagttaggctctgaaaaaaccctgataggttaggcatggtaaaatagtctcttttgagggcaggcattgttataagaatagaatgctctggggccaggtgcggtggctcacgcctgtaatccccgcactttgggaggctaaggcaggtggatcacctgaggtcaggagttcgagaccagcctggccaacatggtgaaaccccgtctctactaaaaatacaaaaatcagccaggtgtggtggcacacacctataatcccagctactcaggaggctgaggcaggagaactgcttgaacccagtaagtggaggttacagtgacccaagattgtgccactgcagtctagtctgggtgacagagcaagactccgtctcaaaaaaaaaagaatgctctggcatatttgaaaatggttacttttccctttttttctctgatcttcactgtgagaacctggtaagcatcctataggcaaaattcataaaagtatagaagtcggccagtgacttggacccacttggaattttcttgctctcacatcatgcacactgaatctccagcaatttttcacttacagtttaggttttcctaccctactactggttctctcagaggtttctgcttattggtttctgttttgtaagttgtgattctctgtacctaactgcctgtctcccattttggggggcagtggtttgccctgtgacctcacttctctgacagatctaagaaaagttgtttatttttcagtgtgctctgctttttacttgttacgatgaagccaaccactttcagaatttctacaaaccagatcagaatctggaagtcctgtttttttattttttttatccctttgtttagcatgttacctatcttaacacattttaaataagtgaatgcatagcttatatctacttctaggttatatgcttccttagaataggaattgattcttaaaatgtcgttctgctcacgcctgtaattccagcactttgggaggccaaggcaggcggatcacttggggtcaggagttcaagaccagcctggtcaacatggtaaaaccctgtgcctgcaaaaaatacaaaaattagctgggcatggtggtggccatctgtaatcccagctactagggaagctaaggcatgagaatcacttgaacctgggaggtggaggttgcagtgagctgagatcgcgccactgcactccagcctgggtgacaagagcaaaactccatctcataaataaataaataaataaataaataaataataaaaataaaaaaataaaataaaacaaaaattttattctgagcagtctctgaagaatataaattctactgccttgcctttagaacttataacagcatctcgcaaactatcacaagatgctccaaacatacttcttatgtgctgaattaagaagtcaactcaaatttagtatactagtaatatttttggatatcccaaaacactgccagctcagctttaggctgcccttcttgggggggaaaaaagcagttgaaatttaggacttaagtgggcatctcgtttaatttttaatggatttctatgttgttggttatggtgaagaggtgaaaagaataaatattctgtgcagaaaaattattcagtcttcatgtgaaaacactttgtccatagcaattactttatgaaaaagatgtggtattactttctttgctcttaactgagacctttaatttaaagaacctatactttacaagtttttattttcaatgcatgaaaaatgtagcagctatttcacaacctttacttttaaaatccatttttctttttaatctcaaatagttttttcttaaaaccttttgactttttatctaaattgtaatagccagagcaccttcccacaactagaatatctcatcctttttgtcttttctttttcctctcaaaatgcctactgggaacttaatttggagtcagattcttcatgataaatctggacttaatcaaaattcctcatatggtatattgtatatatcacagtactggatagtcctctgattaaatagatatttgatagtactttaaggtctatacttttggatgaacttaactgctttctccatttgtagtctcttgaaaatacagaaatttcagaaataatttataagaatatcaaggattcaaatcatatcagcacaaacacctaaatacttgtttgctttgttaaacacatatcccattttctatcttgataaacattggtgtaaagtagttgaatcattcagtgggtataagcagcatattctcaatactatgtttcattaataattaatagagatatatgaacacataaaagattcaattataatcaccttgtggatctaaatttcagttgacttgtcatcttgatttctggagaccacaaggtaatgaaaaataattacaagagtcttccatctgttgcagtattaaaatggcgagtaagacaccctgaaaggaaatgttctattcatggtacaatgcaattacagctagcaccaaattcaacactgtttaactttcaacatattattttgatttatcttgatccaacattctcagggaggaggtgcattgaagttattagaaaacactgacttagatttagggtatgtcttaaaagcttatttgcgggaagtactctagccttattcaacagatcactgagaagcctggaaaaacaaatcccggaaactaattattatgtgccagttatataaacaagaagactttgttgggtacaaaccagtgattccttgcctttgaaaaatgtgtcagatatcatgcattaccagcagttcaatgatataaggaaaccagagtaatagctaaaacctttaaagctaaaccaaagatttacaaattgcctcttcatccagtctttcccaacctaaaaactgagttctctaaaaattttagtatttttttctgaagaaaagggaacatggacatttatctaatcctcattagaaatctgactaatgataacaaggatttagacctcaagcacttcttaccaaaattcttgatatgaccttatagcaaattactttcacctgttgaactttcctttcttttattcccctgtacctcacctgcactgggcatattcaagttgcttatacaacactttactattgtgttagaaaaatcatgacacatgatgaatgtgtttgtgcaacatgagctgattcataaatgaaaatgtgcattgaaattccacaatattttaaaattaggagtttatctagcaattgaacaaaattgattaaatccattatttgttagatcagctaaattacataagttcattcatctgctcataaatccatccattcttccatctggctatcccttagtcaattcaaataaatatttatggggcactttgggtaagccaggtgctaagaattcaatgcaaaacaagatagactcccctgtccttgttgaacttatatttttggtacaaacaaaagcaataatcaagaaaaaataaaaaaagtactgattgtgattaataatatgaagaaattcaacagagtattgtacttaacatttgattgatctgattttctcagttgtctgagaacaaacatttgtgaaaatctcattgtagagttcttacgatggatagggggtcaactgtgtcattattgcttatcagcttatcccaaagacctagtttattaccagattgcaaatagtgttcaataaattattcttattaagggttgttatgtactctaaaacatttattgtggtcccttcactggttctggtttacaaacttacttttctatgatgacatagtatagaaattgagagtgaatatttagaagttcatttttattatatatttttgaagtattgatatgtagtgaattagaaatttaaaaagaaaacaaaactgtccttcactacagattgaaaagcattatactaaaagaccatttgctcagttatagtatataaaggccaaatgacttaaaaacaaattatgtaaggagaaggaaacaaccatttattcagtgccactaactgtcagccagttttttcagtggtcagttaatgactgcagtagtgttctaccttgctcaaagcaccctcctcaagttctggcatctaagctgacatcagaacacagagttggggctctctgtgggtcacctctagcacttgatctcctcatgcagtgcatggtgctctcacgtctatgctatgttcttatggtctttaggtaacaagaataattttctttcttttccttactatacattttgctttctgaaattcccttctcgccaatccaggtgaatgtcagaatgtgatttgacaactgtccaaagtactcattcactgaggagtggtaaggccttcgcccaacctgccttctctgggaatatactgctgcctgaacatatcattgtttattgccaggcttgaacttcaccaaattaatttattagggtcaacatctaaatattagaactatttcagattaatttttaagtcgtatccactttgggtactagatcaaattgcaggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaactatttttttttaatgtcactctgatttggtcacaaaggatctctagtctcattgccttagtatcattctacgaattagaatgtgttactgtgtaagagcacttcttgtatatgagagaaatagcaacagttccagtttaaagtgatataaatggaaaccaagaaatgtctttactgggaccaaatctggacagcatttactgtatttttgctggtattttctctagtctttccgggtatattcacatttaatgatcacttttctccctttgtgctaatggacactgaatccattccactaccatagttcttgctaatactactctactttttacacaaaattaaaatgccaggagcacctccaggtagactgactataaatctagactgaaaaaaaagcttgtatttcttaacagattaccttgtggaacatttgctcctttcaactaatgaggcactaaatattgtaactgctcaactggtgcttttaatttatttgtctagactttgtcatgttgccagaagctttatcctggttggagttttgaaaacagtattgtttcttcagaaagaaaaaagggattgtcagatgatctaaaaataaagaaacactggaaatacaagtatcccaaggtgatagcattaggcaagataaaaatgttgaaaagcgaaaaagaactggttgatagagaagtgttgttattcagtagaacctaagtcttgtggtcccatttttaatgaaaaatggtgaattttttggtttttattgttcttgttcacacaaatctgcccattagaataagccaagccctaaaaattaatttcagtttcactgggaatcctttagtttatctactatgtagtagagaggttttgttttattgcatgtttgacgtaggaacgtatatatgcaagacatggaggaaaaccaagtgggccagagttttgaaaattctttatcttttctttctgccaaagtgagtctcccaagtttgtcttttttttttcatttccactcttctatggtttctagcattatataaaccaaacaaaaaaaatacgttcagagattccttcagaaatgctggatgatcttgatatcgatgcttttcatatatgtgtttatgatgctggtttctggggctggctctcagtatcacaaagatgtctgtaaacagaatatgctatttcttctttgtgacaaattttgaacattatgtgaatgtccaagaaagagcaaaagagggcaaacttctcatacatttttgatgtcgaaaccaagagacgcttttattttcctaacttttctttgaaagttcaaattaagtaattttatcctgtcctaaagtttaaaaagaaaaaaaaaaggaagaaggaattaaaaatccaaagaaaattatgtttgtttgcttttctgtttttttcttccttccaactccgagactttgcaagggcatagttctgaagatctctgacactgagacattagagatctctgtatcaatggatcatttgttttcagacatatgaaacaggaactttgaacaagaaatttcccctctttttctcatagtgatcctgagacatcagctgtggaatcacaacacgtcattagttttggcaggtccttgcaggtgttttgttttgttttattaatgttcttccctcctgtagctagacagcaatcttggagaatctgccagcttggaagactattgtgtaaatttcaaggtggagcctcctttaatttgttctgtgttacctgtgagctgtgaggtcatgaagaggagacaatgaggctaatcatgagagccccattggtttaggcaattagaacaacaagatctaaaatggtttattagccttgaattgtgttaagcacataattcataaaaaacagaaaaaatatttttaaatgtatgtctaaatcttcagttacaagtttgaaaggtgacaaactattctgaggaaatgattaggcctattcttgcaacgagtctttatgatctgaaaagaatctatgtccacacataactcccacctcaaagatggggcatcttttgctctgggagatatcaaatgcgaccaaaacaagtgtttgtagatttgaatgatgattcagcagtgtagcagttctcactcattttataataattaacaacttaataattaattattaaactcctacatgcttaacattataagtatgataacttctgtggttacataaaagatatacatagcacttgtccttgatctgtcacagtgaggtcccaatccaacctatgagcttcaaatgaaaagttcaaaattacactcattgtcataagtcagagatcaaaggaagaaaggatttaaccaaaatgataaattaaatataggtgattaaatatagtcatggttcaaggcatgggccagttagggagtgtgatgtgggtaattatgaaaggccagctcccaagccctgttgttgctactcccccacatcagtcatccttcctttttttctacttctactgcagtgccttcctcatcttttcccttgcatccctccattatatgagtcatacaaattagacttttcaaagcaacattaacattgtgtgaatttggggtttttgactaatcccaacattccacccccacattccagtcccacatgggatttggagccttgtttataaacctggcacttctaatatatcttatcttagagtaatccttgtatttgtttaatttccacttagcattgtaaatacttgcaggtatcctagttaagaaagcaaggtttaaacacaaaatcatcaccaattaaagcaggctagataaagaatgtaatagaaatgctagataaaacagattttttcttactaagttttctgtcccttatagagtgcataacacaataacttgcttgataagaattcaatgtacattgttttgtgctgaatcactaaatgcttgatttctgtaacaagagattgtggttccatcagtatctggattttagtctgtgtaatcttaggcaagttatttgatttctctgtgcctctgttttcttgtctgtaaaatgagtataatggtagtaactaattcattgtgtttttgtgaggattaaatgagttaataactagtactcctccctggcacatagtaagtacaatatgctgtgctgtggtggttgttattattttttatagttccttgagcaaaagaaataatgtccccatcttagtataatattggaggtatataccatagaagtgaacaaaagaatatagtttcacaaagaaagtgataattaaggcggttcataaagggtcataaagcttgtagattttagaaatgtgggggcatgaggatgtggagagggtattccaggatgccagacagggagattatggataagtactaagatgagaactagaaaaagctgaggggcaaaaggtcagaggaggccacaagttagggagtattaggaaaaagaagttaatacttgacaagtgccaacatggcttcacgaggaatgggttgggcctttttgagtgaggaagaggctggtgaaagggtggtggaggacactgctgctgctgatggcatggggtgtaggtggcaggagaggcagggacatgagctaggaaactctccagctatgaagtgatgagtctggagtaatataaggacagtaggggtggagtgctgaacttaagggaggagagaaaaataattggtatggaagtaggtacaatgcaattttattatttctgagcctaaaaatgtgaaatttttgattatttggtcagaccagggaagtattttcttttatgctatctctgaaaatgtatacactaaaaagttgtagtataaaaaggttgtaaagcattaagtaattttagaggaaacaataatttggatattttacatgcaatcatttatatgcaaatatatgtaaatattacaaaattattctctatttgttacaaaccttaaatatttttgactgaggaatattttattcatctaattatagctactttgttctaactaatagatattcttgaaaacaaagcaacacttttttggagacagagtcttgcactgtcacctagacttgagtgtgttaccttgaactccagggctccagtgatcctcccacctcagtctcttgggtaggtggattacaggcccacactaccatgcccagctgtattagtccatcctttcattgctataaagaaataccggaaactgggtaatttataaagaaaataaatgtaactggctcacggttcttcaggctgtacgggaagcatagcagcatctgcttctgaggaggcctcaggaagttttcaatcatggcggaaggcaaataagaagcaggcatgttacacgacgaatcaggagcaagacaaagtgagggaggaggtgccacacactttgaaatgagcagatctcatgagaacagcgccaagaggatggtgctataccgttcatgagaaatccacccccatgatccagttacctcccaccaggccccgcctccaacactgggaattacaattcaacatgagatttgggcagagacacagatccaaaccataccaccagctaataccaaaaaaaaaaaaaattttttttttaagacatggtcttactatgttctacaggctggtcttaaactcctggcctcaagtgatcctcccaccttggcctcccaaagcactgggaattcagacatgagtaacagtgcctggccaatacttatttttaaacattctctaccataaacttaggatcttgatttgttcacattgaacagatttttattatacagattgaatttataagaaaatgttgcagacattgtcaaaaagggacgtccaaaccactgtgatatttataagcatttgggccacattttgatagaactatacacggagtgtgtgtgtgtgtgtgtgtgtatatatatatacacacacacattatttatatatatgtatatatgtatatatatatatgtatttatatatatatgtgtatatgtatgtacacattatttacctacctactgtgtgagtgtgtgcatatatacacgcacacacacacacacaaatatatatatttcccttctgagacaaagccaaacagcactgtatgcttaaagaaaaacagtcacacttcccacttatgtaatttatattacatccagtcaccacaccagccaaactgctttattgttttttgtttgacatccaatgctaaagcataatgcctgttgcagtgaaatatacatgagcaaccctgagaactcaatatagcctcacgtgttgccactgagttgagttgaggagtcaagctgtagcaaaaaggtttgtcaccgggtgagtaatggtgctcttatttttctctgggtctcaagaagtgctctttatgacatatatggcattaaataaatatcagatatttgcacatcctaactttcctattggtgaagtttcttaaaagagagataaagggccattgtgtgattgatagtttcaggtatatttttgctgcacagtcagtccgagtgtaccacgtagggcaaaccacgtaacttctcagggccttgactgtttcatttgtaaaccagagaaaaggacttgggtgacctccaaagacctttcaaatttggagatgagtttgtggaaagttcaaacagtttagaaaacagaactaagacacccactggcacccctggaagcaagagagtgccaggtactatttgtaatacaggaatgaaatacctaattgtatgaaattgaattctaactgaaccagtttgttcagttaaattttttttttcaattagagtgcttacttcagtatctaacactagacagtaaactgtagacaaaagacctacagaatttctgaatggtatcaaattcaccacacttaaaactttgggatgtctaatttcaaccaacagctttctttcttcataatgttgaatatatgtgtatctattttagctaaatttaatatatatcaatatactttgatagatattttatataaactattagactatagtattatgagtaaaagacccaccatttcccaagcaattataaagaacgatcaaaattttaatgggttgttagtattatttctttaaagattgtgatactgataaatatttggccacattttaatagaattatacatggggtgtgtgtgtgtgtgtgtgtgtgtgtatatgtgtgtgtgtatatatatatggcagtagagatatatatatctacacacatctagatatatatatacatgtatatctatatatacacacatatatctgtgtgtatatatacatatgtatatatacctacatacatatgtacatatacatacatgcatatatctgtacatatatatatagtgtgtgtgtgtgtatatatatatatatatatttattttttttttcctgagccaaaacaaaatactaggttgtaatagctgttctttcagaaggaagaaaaacaacatgtgctgaactctgagtttgatgtttttgtattttacttcctattttcatatcagtccatttatttattcaggaagaatttattgagcatatattatgaacacagcttttgctaaggacagggtatgcagcagttatggcctagtaggagatatggatgttaaaaacaaaatgctcacaaatgcacatataatcttaatactcattgtaagctatgaaagcagagtgtgagtattatgagaccatatgttgggagattttatttggtattgaggatcaggaaagatacccctgaggaagtgatatttaatttgaaacctaaagaaagcagttggccatgggaagaaggtagggaatgagattcccaagcaataggaatccaatgtgtgaagaagctgagggagtgaaagaaagctagtgtggtggcaggaagaaagagaagagaatggagaagggcactaaatgagtcagagaagtaggaggggctaaaccatgtagggtcgtgtaggccatcttaaaggcctgagtgtagtggaaaacctttgaaggtttgttaaaaggtcaatgaaatgttctaatttctgttgtagtgaattgctttgattgctgaatgcgaatggatgggtagagatgcaagagtgaaagggaagaaatcaattaggaggctcttgccctgctccagataggactgataattaattttatttgggaagatcagggagaaagataagtcatgaatgactcccaagtttctggattgaagaaatgaaggtaccatacactgagatgggaaagcctaggggtagagtagctttgagaagaaaggtagcatttccccatttcataaaacatggaagaacaaagaggctggattcctgtttgtagacataccttccaggccagaactgcattactacaacatctttgcaagccacattgcctttcataactctgtgtcagtgttgatgccgtaacatctttggccttccccctaccatcctcccgcagtcctccatgataatgccattattccgtttcaaattgtgtgcttccattggatgtgtgagtctccttgaaagttataatgaggctgtagcccatatgaaatgcttcaactcaggtcctgcataggaagaggaagctaatctctccaggaactgagcctgtggctagagggatggataattgtttaaataaagaatatgctgctgagtactgatgggctctttatgtacccatttggctgctgctgcccaacctttaatctttcctgagctttaaataggaaggaaaaaatggtccacaaaggatttgagccattttgctgtggtgatgaggagcacgggtttagagacaaacactcctgtgtttgaattccagctcctactatctcctagctaagtgaccttggacaagtcacttaccttctccaacctgctgtttcttcatgtacgtaataggatttacctcatgaggttgacatgaagattgaaagaggtaacatatagaatgagcctgtcccaggacatggttcatgataagtctgccataaatgggagctatgtgtcccacccttttggaggagataactgttctgtagcaggtaatatattgtttgatacttggttaacccttacaattatcatttcctgttcttctcaataatgctagaaaccttttatttaaagaaccacaatataaaatgaaaaatatataaaaaaagcaaatggaaaaattctattggcaaggctttttaactttatatactaaataaatccaattgcttaaataatgaactgactcaagttctcagcactgcttcttgtttaattctctttagtttttcagaattctccaataatgacctttgtctactctcttcagtttattcagaaattacttttatttacatagaagtttggaagtggatacacaaacatatccctcacatatcttatgatcctatgagtcatatactcatctcttatattccctctgtaaagcaatgtaggtacctttcaggaaggtgatttttatgtaggttgagaaatatcagcatggaggtcctagctgacctctctagagagtttctgagacatttgacaacaactttttctttaagtcatcagttatgccccggggtatgaaatttctaacatgatcctcagtaaacttggctgccttgctgaggatactctccatctgcctgagagacacagacaccattaattgggaattgacttgacttgtgtggttccttgtggaccagatggccactaaatattctcatttcaaggcaattggtaaaaactacacttcaagaaatttcattcttaattccccttagtggatgttattaaccaaaggcaaaagaaaaaaagggtaaaaaaaatattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggctctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaagtcaaagatcaaggtgccagcaggtttgctgtctcgtgagagcatacttcctggttcattgatggtgctttcttgctgtgtcctcacataatggaaagggcaagacctctctggtgtctcttttacaatggcactaatcccatcatgagggctttgttctcatgacctaatcacctcccacatgtcctacattctaatactatcaccttgggggttaggattttaacatatgaatttgaggaggtggcgggggggacacaaatatttagaccatagcatttcactcctgacctccaaagttcatgtcttcttcacatgcaaaatacattcattccatcccaatagcccccaaagtcttaacttgttccagcatcaacttacaaggctaaagtccaaggtttcatctaaatatcagctaaatcagcacaaacagctaaatcaggtagagtgggacttaaggtgtgattcctctttaggcagattgctctccaactatgaaattgtgaaatcaaacctattatgtactttcaaaataaaatggtgaaacaggcacaggctagacagtcccatttcaaaaaagagaaatagaaaagaaaaaaggagtgacaggtctctataagtctaaaactttaaggcttgagaataatttgctttgctttgcctccaggctcactggggtggtgtcttacctctggacacactggggtggaggctctatcctcatggatttgagtgtctcattctttgtggcaggtctgtgctccaatcccacacctatggctccctgagtgtgcaattgcatgcctggtggttctactggtctgggattgcataggtggcccagccttcatagctccactgggcattgccctaatgtgggctctatgtggtgacctcacccctgggcctctacctgggccctgtgactccctgggttcttgaaatctaggtggaggcagccatccccctacagttgtgctgagtgtagtgcatgagtgctggggtctgctagagctatacctagggtggtggagatgtatggcaatggagtatggggagctgatatggtttgggtgtgtccccacccaaatcttgtcttgaattataatttccataatctccatgtgttgagggagggacctggtgagaggtgactggatcatgggcatggttttcccatgctgttcatgtgatagtgagtgagttctcacgagatccaatggtttcataaggcagttttccctgctcttgcaccctctttcttgcctgtcaccatgtaagacataactctttcccttccgccatgattgtaagtttcctgaggccttcccagccatgtggaactgtgagtcaattaaacctcttttctttataaattacccagtctctttacagcaatgtgaaaatgtgctaatacaggagcaaagactgcagtgtgaggtggcaatgtgaagtctgcaatgtgaggtggcacggggcagttgtagcccctcctttgaaatctttcttccctaccccaggcctctgcactctgaactatgatgggaaaggcagcttggaagatctccaaatggctttggagtcattcttccattgtcttggactataaattctggcttctgtttaggtggctgactaatatccccactgtctgaatgcatagcacctagtttctgttgagatggctagtccatagtaatttacttatcaaatttggccacaccctttgtattctctcctgagcaggctttctcatctttcacaatatggataggctgagaattttccaaattttgaagttctgcttcccttttgatcaataattccattttaaagtcatttctcatcttgaattttactatgagcagtcaagagtaactaagctgctccttcaactttgcttggatatttcctcagtcaaacattcaatttcattgctttcaagttctgccttccacaaaacactaggacacaaacagctcagccaagttctttgacattttataagaaggatagcttttcctccattgtccaataacatgttcctcatttccatctgaaaacccatcagattggcctttaccgtccatatttctgggaacattctgctcatgaccacttaggtattcggtaagaagatagtagctttctctatagctctcctcctctctggagccctcaccagaatggcctttaattgtccattcacagcaatgtaggctttttctagcatgtacctgaaaactcttccagcctctactcattaccttgttccaaagctgcttccacattgagtatttgttacagcagtacccagatcccagtaccaatattctgtcttagtccattggggctactacacgatgtcttataaacaacagtaaaatttatttttcacagttgtggaggctgggaagttcaaaatctggtgccagcagattttgtgtctggtgaaggccttcttcctcacagatggctgtgttctcactgtgttgttacatggcagaagagtgggcaggctagctctctgggatgtcttttataagggcagtaatccaaatcatgggtttagggtagagccctcatgacctaaatcacctcccaaaggccccacctcctaataccagcatctttgaagttaggatttcaacatatgactttggcagggggacagaagctttcagtttatagcaaaccctataggtagcactactttgtcctttcctaatcaatttgcgtcaatgaaacatgaattagaagagacctaggcgactccactatactgggattattcccagtataaattatcatctctccacaccttctcatctactccctatctgagttctgaagctctccactacaagaaggaggctttggtttgacttgatatacttctctgggaaacaggtttagcataaaacagtgatgctcattctagaacacctgcaaatgacaatagttttctttcgaagtcgccaggaatcgtctgcctttgggtatgtggctgtgagcactgccgggcaaaatgccatatgacctagatgaggcatatgccatcctttgaagccattaggacattatataggaaatatattaactaaaatggaataaaattttctaaataacaccttatgtttatccaacaggtggttcattatacttgagagcattatacagaggaatttgatggggaggagagctggagaaattctcgaaattctgggtttctttaacagaatactctagctataaacttataattttaaaaaataagcattatattaaagaaaagggaacataaattattttgttttattaaacttaagtccaaaggtctggattgtggcagaataggatcaggggacctaaaatgttgagcctcaaaggtcttcttagagaacaactgtattccactattagcgcttttggtccttttagcccaatttctgtttatcccaaatgttcttcccttttctgccttccttcacagtggaccctgccaggagctttgaaatgcctgtgagtgttaaacacttacccattgagtgcccaaccttaacatgcccctaataaaatgtacttagattaaccgttttcattatcaaagtttccttattacccaacaaacacaggcgctttaaagaaaacattaactaaattgcaagtgacacattttaagatctttgatatgacttcagagaatgcactataggaacacaatgcaatgggagggaaacttgggagggaagacattagcctttataaaatctgcaagtattgccaaatcaaaataaaatttacaggaaagcaggatcataaatataatctaaaatcttagaacctgtggttatgattttaaatactaatacaatgcaaaatttttacctgtttaggtttttatttcatcagttcatatttaggtatatacttttactgttctccttttttataatttaccattcacaaagatgatgatgttagtctaactttaatgtcatgagtgctttgagtagtagtgctaagtttttgttgagtagtagtgtgcttttttgattagtagtgataggtttttgatgagtaagcctgctagcagcatacaaacaaacaagcaagtatcagcctagagaagcagaaaaggcatttgggtttcaaagtcacaaggcctaggctttagtctaatacagctgataatacaatttgtccaaacaggacatttttgggtgtgtcaaacactaaactggacaggacattatgacaaaagtgcaaagcaggactttccggggcaaaccaggatgtatgtcatctcactgagtcctctctttgtccttgccatgactagtatctctagaggtaaatgaacagagtaatgacaaatagccagacacctgaatcttatcccaacagcacctcctacataattccccattatcccaaatggaaattaaaaatatatacagtgataattccaggccaagaaatgctttatttctagcttggacttggcttccatgtccagtgtagaatcttatccttgctgatctggactgtatctcatgaagccatgacttgtacctagttactagctggaaggcttagaacaaaagctggtccagagagcctcctttttccttatttcctgggtccacacctttaccatggcagtctgcctatcatttgatggaggaatttaaagcaagtccaagggaagggaagagagtttctaaaatctagaacttggatagtttaatttacctatcccaaaacagcttaggcccagacagcttctctccaagattggtgccaaactgaaattaccagctgtgtagaccaaagagaatttcaaaagaaactgaatcccaagagaaaaaaaaaagacttctggcattgtggcccaataaattggtaggattgttgtgacttttcaagtttacatgtaaaatgggcccagcgcagtgcctggcaaatatgggtactaagtaaaagtaactataatcatgtttttttaatctggacttcacttggtcatcctttaaatggtgtctgacagaatcctagttcttgtctcactttacttagtttccctgggaaatttcatgtgtccttttggctttaattaatatctctattttgatgacctccattatctgcctattcccagagctttccacctgatatctcagcacatgaaaagcaccttatgtcaataagtgagttccttccctgccccaccacatacctgtcctgtgttcctaattccactgaatggcatcccatcctccagtttcccaaggccaagacctgggactcatctttcactctcaagttcctccacgggtacccacatgtcacatcctgtcaatgctgtccctggggagtatctgaaatatattcacttttcttcatttccacctgacaccactattaacacttgcacaaatttctgaggttcctggctcatttccctcattgacccccaatagttcattctgctctttgcagctctggtgatctttccaaaccccacatctgatcacttgtttcttcccttcatatggctccttaatgccttctggactaagtccacactgcttaaggtggcttaccaggtccttcatgattttgtctttgtttggctttctacactcactgcccaacttccccttacttcccatgattcagttatactgaatttctttggttctctaaagcacatgtgctttctgttctgcagaggcttttttgttcacttgctattctctacctgggaaactcccccagcccttcactgcctccttctaccatctttcaggcctctccttacacatcacttctttccaaaaatctgccttgacactccaggtctcggtttcctaggtgtaccctataactccacccctttcatagcatttctcactctggctggagatttaccttttaacttgtccatgtcccccactggagtggaagttcctggaggtcagggattatatcctattaattgttgtatttccagtgcctagagtagtcttgcatacatggatggtattcaataaatattggttgaatgaataaggagttctttcatttcatatgtaatagatcatggaaatagccttgtgattgatacacagcaggtattaccatcctcactttagaatgaggactcagagccttgagatgtctgagggccttgactgggacagctggcagatgcaggagcagagctgcatcacccctgtgggctatctcagggttgtctgtaatctaagtacaatgtctgttgattttggactgaaggctttttgggtaattgtttgctttttcaatacttataaaatagtttccatccttactcattgatagtaaggttagttattttagaaaacaagctaaatagcagaaatagtggccttttaagttgaaaatttaccctgaaaaatctacagagtagcaaacagagtatcaaaaggagttgactgtatctatttttataactgccacttatggattattcagtaaaaccacaattcacttttatgattttttttcatgtttctctgtcacaagagcaaactcttgctccataataacattccagaatacagcaatagcaaaagtcaacattttgaatcctttacaaactcttagacatttttttttttttagtttaacatgttacaaaacaaaatttcttcttttttcacagcagtttgggaagtacatactatttattagctcatcagcatgaagctggaaaattctttttcctaaagttctttatatctacaaactgttgatgttttcatttatttatttttaatgctacgttgtaatgaaaatcattggaaaactttagattctagtaattttgaagtcttcttagtttggacaggactgagctaaagtttgtactttttttaatttattgaaaaatggtttctaatgatagtattaacaagattatattgggggcaggacgcagtggctcacacttgtaatcctagcactttgggaggccgaggcggttggatcacctgaggtcaggagttcaagaccagcctggccaacatgtagaaatcccctctccactaaaatacaaaaattagctgggcatggtggcaggcactgtaatcccagctacttgggaggctgaggcaggagaattgtttgaacctgggagtcggaggttgcagtgagcccagatcgcaccactgcactccagcctgggcaatagagcaagattctgtctcaaaaaggaagaaagaaagattatattggggatatatatgtgtgtgtgtgtgtgtgtgtgtatatacacacacatatatatatacatatatacatatatatacatatttaaaggataaaggattctgctgccacagatcactaaatcagatgatctctagcaatttcctgtttgtttgttttttgcccatagtgcttatctctttgaacagtaattttccacttactatttttctccccttttggaccataatttcctttaaggcagagcctcctgttactcatctttgaatctggggtctgtcagagtacctagaatttaataaactctcattaagagccagttgaaagaatatatgactaagcagtcatttacatccaaaagatccgtaggagaattcttatcagcacatgtgattggtaacaataactttgtacttttcaaaaacaattactaatctatcttgctttccattatctcaccaaaacctattagcatgtctggcagaaaatagatacttaataaatttcttaaatgtttactgacttcaattttaagttttattaactatgttgacttttctctaatgaagatgattctaaaaagctttttactatacttcacagtgaataaaacagtgagataggaatattgcaaaatgtcccctgtgttggtcagtcttagtgtcattcattttaaaaattctgttctctaaatattgacagttatatataaatttatgtaattgtttacttctaataaagaatttcatctggggaaaaacatactttgctcagctctttgccacaagtgcaaagtctaagacagtcaaatagctttcctagtacggccttaggaacttagtatatgactggtgtgaatctagagggagcatactgcattctgaccaaaatctccaccctgttactatggccatcactaacttcgcagtattgcagtacttcctgctagcttagttcccaaggcaacttgtgaaggaaaatttttacaaagctgttgtcacacaaaggtagtgtttcagttcctgagcccatgtccttggagttgcccaggctccaataatactaataattactgtacattaggtacttaccatgtgccatattctgtgggagccgctttccacaaattatctctggtaatccttgtaacaaccctttgacatcaatattattattttctccatttttttacatatgagataaatgagacttaaaataatgtgcctgatatcatcagcaaatgagctgaggagggcagattcaaagctgattgtgtttgactctagagctgcagtcttaagccagaccttttcttgctggttaattttactgaaaaaaaaaaaaaaaaaaaaaccctcaaatactgctgattgatctaaagtactaacatttctatcagtgttagggaaattttaattttataatttgattttgtgagaaatttatagcatcttgaatactcacatgcaaagtgatatgtcttagataacattttacaatggcagagcttaagccagtgctcagtcattcattcatcctcaagttttgattcatttatcattcatcaaaactctgttttgtttggccacccacattctaggagctcagtacatatttgataaatgaatgaattgttgaggttgacagttacccaggactggcattaggaacacagagctgaagagcacgtttttaccctcaagaagcttacagtctaacgagggaacttgcacaaatactactatcactaggtgcctggttgaatggcttaagagatgatcagggatattcagaaggatatgtcaggctcagcaatggcatcacttgagagcatcaaggtgtttagggaactacaagatgtttggttctgctgggaataagagtgaagggggctccatttggatgcctcatacaccaggtgagagatcttagattttattccaccaggaggagaactaccataggatttaaaacagaaatgatatggtcaaacctacatcttaggaagatccctggggtgtttgtatggtggacttgcaatttgactaattgagatttgtaggatgattcttaagagatgatgatgacccagactgggatcactataatagagttggtaaggaggagaatgatttaaaaagtagttggaagaattctagggatggagataaacatttgaaaattattaacttataggtggtcatcaataccctgaaaatgactgggatctcagaggagagtctggagagttggaaatgacaaagactaatattcaagggggcaggaagagggagagttgttcacacatgacaataggaagaaatggccatagagtgtgtggtttctctcaagccaaggaatagatgttttaagaaaggaaaattcttgtggtgggaagcagtagagatgacagatacacattaatttcttgagatttctagatgactaaatgggcagatgttgaatgatagctaaaggagaacccagaaacaagggagggattttgtttttgttttttaaaaaagatagaccatagcagcttcatagactgaaacaataaaaaagttgaaggcacaaagaaagacacaggtcctctaactccctgcccagtgccctttattcatattctcagcacttgtatttctaagttttatgtttgagtcttcggggatacatcagagtagtcccccttgtctaataaatgtgtttacatttcctgccataccagaaacccttctcaaactttaatgaatttctacaaggtgagattactttaatgagaaaccaaccaaggaaaggagtatcatctgcaatatactttcaaatgttttttgcttgtttgtttcttgtccagctaaaaaaaaaaaaaaaaaacaagccattggtcctaacacaactttcatattctaccccaatatcaaagaggcttaaaatctcctggtcgtgtgatgggcacacagttaattttttgtgaacaaacacagtgttatgggccatttctgaatttatctctgaaatcataagattctttctgagccattatctcattctatattacagtcaggtggagcccatcttacctcctcatactaaattctagacttctcaagggcaggagacaatcatctgtatatctctttggccttcatacactcaggagtacttgccaaaaataaacatttaatgcacatttatttgaataattgataagatccaatacttcaataactttgtcatatttttatagaatgggtttctatatctcatttgcattttcaaactttacttttactgtctagctttaaaaaaaaagcctttgactctaatacagccctcatattctaccccaatatctaagaggctttatatctcctagtgttgtaccactattttaactccagtattttttacttcatagttttacctatttgttacagttagtttttatgaattcaagagatgaatagcaattttccatatgtaatttaaaaaaccccacagttgactattttatgctatcttttgtcctcagtcatgacagagtagaagatgggaggtagcaccaaggatgatgtcatacctccatcctttatgctacattctatcttctgtctacataagatgtcatactagagggcatatctgcaatgtatacatattatcttttccagcatgcattcagttgtgttggaataatttatgtacacctttataaacgctgagcctcacaagagccatgtgccacgtattgttttcttactactttttgggatacctggcacgtaatagacactcattgaaagtttcctaatgaatgaagtacaaagataaaacaagttatagactgattcttttgagctgtcaaggttgtaaatagacttttgctcaatcaattcaaatggtggcaggtagtgggggtagagggattggtatgaaaaacataagctttcagaactcctgtgtttatttttagaatgtcaactgcttgagtgtttttaactctgtggtatctgaactatcttctctaactgcaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtgtgagtttcagatgttctgttacttaatagcacagtgggaacagaatcattatgcctgcttcatggtgacacatatttctattaggctgtcatgtctgcgtgtgggggtctcccccaagatatgaaataattgcccagtggaaatgagcataaatgcatatttccttgctaagagtcttgtgttttcttccgaagatagtttttagtttcatacaaactcttcccccttgtcaacacatgatgaagcttttaaatacatgggcctaatctgatccttatgatttgcctttgtatcccatttataccataagcatgtttatagccccaaataaagaagtactggtgattctacataatgaaaaatgtactcatttattaaagtttctttgaaatatttgtcctgtttatttatggatacttagagtctaccccatggttgaaaagctgattgtggctaacgctatatcaacattatgtgaaaagaacttaaagaaataagtaatttaaagagataatagaacaatagacatattatcaaggtaaatacagatcattactgttctgtgatattatgtgtggtattttctttcttttctagaacataccaaataattagaagaactctaaaacaagcatttgctgattgcacagtaattctctgtgaacacaggatagaagcaatgctggaatgccaacaatttttggtgagtctttataactttacttaagatctcattgcccttgtaattcttgataacaatctcacatgtgatagttcctgcaaattgcaacaatgtacaagttcttttcaaaaatatgtatcatacagccatccagctttactcaaaatagctgcacaagtttttcactttgatctgagccatgtggtgaggttgaaatatagtaaatctaaaatggcagcatattactaagttatgtttataaataggatatatatactttttgagccctttatttggggaccaagtcatacaaaatactctactgtttaagattttaaaaaaggtccctgtgattctttcaataactaaatgtcccatggatgtggtctgggacaggcctagttgtcttacagtctgatttatggtattaatgacaaagttgagaggcacatttcatttttctagccatgatttgggttcaggtagtacctttctcaaccaccttctcactgttcttaaaaaaactgtcacatggccaggcacagtggcttacatctgtaatcccaatactttgggaggctgaggtggggggattacttgaggccaggaattcaagaccagcccaggcaacatagtgaggccccatctgtctttattaaaacaaaacaaaactgtcacagcttctttcaagtgatgtttacaaattccctatggtttagtcacaaggaagttctgaggatgatgtatcacgtcatttctgttcaggcttttgagcctcctggaggtaaatggtttccttactgaaggcttgttattaccatgattatcactaagcttgaagtaacaaattaggggggcagactcacaacctcttgccctgccatggacaagttcaagaatctaagtaaagtcctctattgtctgatcttggatttgctcaacctgaacaagccaaggaggtgtattaaactcaggcacatcctgaccaatttggaattcttaagcttcagatcactgtggaagaggctcaactctttatggtgctgtagacttacgctcattttctaggtaatttataagggacctaatattttgttttcaaagcaacttcagttctactaaacctccctgaagaatcttccagctgctgagtagaaaatcacaactaatttcacagatggtagaacctccttagagcaaaaggacacagcagttaaatgtgacatacctgattgttcaaaatgcaaggctctggacattgcattctttgacttttattttcctttgagcctgtgccagtttctgtccctgctctggtctgacctgccttctgtcccagatctcactaacagccatttccctaggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaactttgttgttttcagatgcgttcacttgtcatgtttcatcagtctctcactccaatttctaagcttcatggaacatgaaacacgaatctgtcttttagatatagcctcttttgagaattcacatgaattagaacacacatttttagttatctgtttaaactatggtaaaatatacataacataaaattttccattttaaccattttaaagttcagttcagtgtcattaggtacattcacatggttgtgcaaatatcaccatcatccttccacagaatttttttcttgcaaaactgaaactctttttacccgttagtcaataatcccgcatttatctttcctctaatgcctggcaaccaccattttactttctgtctctgattttgactactcgaaggacctaggagtgggatcatacagtatttgtatttttgtgcttatttcatctagcataatgtcttcaagcctcatccatgttgcaacatgggtcaattttcttccttcttaaggttgaataatattcattatagagtagtccccccttatccttggggaatatgttccaagacccccaatggatgcctgaaatcactgatagcactgaacctgattactgtgtttattcctatacatacacacatacatatgataacatttaatttataaattaagcacagtaatagattaacaacaataatcataaaatagaacaattataacaatatattatgacacgagcgatacaaatgtggtctctctctttctcaaaatatctcattatactgtgccacaggtaactgaaaccacagagagcaaaaccttggatagggggaccactctataaatatgtaccacatttttcctcacccattcatccatcactggctacttggtttgcttccactttttggatatagtgaataatgcttctataaatatgggtgtacaaatgtttcttcatgtccctgctttcattacttaggatatgtttgaagttatttttatttttaaatggaggcttatagaacacaaaagatttatattctgcaagtgtccatctatttcttttaaagcttattcaaaaagtggtagctatctcatagctcttggtaagttaaaaatcttcatcaacgaaaatactatttctgcgttggcacctgcatggattttctttgtccaaatccctctttttaattgatgaggcttctttagttcctttttttcttccttgttgagcttcttcatgaaatgtgcagttgctagcatgtggtggacggactgcagatccctactgaatgccaggccctccggccctgtgttctctttcttggagaggtttgttttcacacgtaaccccaagagggcagtctcagagcgtgttctagtctagttctttttttaaaattactaaactttattttttttagggcagttttaggttcccatcaaaattgaacaaaaagtatggagagttcacatataacttctccatacatgatagcctcccccattcaacatcccacactaaagtagtacatttgttacaactgtgaaagcaaatagaatttcaagaccccaagctcactatgccaaagggcaagttaagcttcagagctgaattactcaatattgccttccttttgttccctaacagccgtaacttcacaatcttgtgtgatagcctcatccataaaccaggttcccacaatgatagaaggccacatatctccccaaatgacctccctcacaattgtgcccaaggaaaatccttgtgagaccctatcttttaggatacatatccctcctataaaatagccctaaaactgagttatgttgaatttcaccctgatgatgtcaattaccagcttgtcttcataggcacaggacgcgggcaagaccagaaatcatcgtgctgtctaccctgcaatgaacacataattgacttttcctttactccctctttttacctataaaatttggatttactgaacactaac

SEQ ID NO: 11821 - DNA, 40333 bp, Human
  misc_feature (1)...(40333): n = A,T,C or G
gccaggcatctaagtcccctctggggctttgaggagacagtcgctgtctttcctggtggtaccaccaccttccttcattcaacgccgccgcatctgacaaccctgggcacaggaatctgcaccccaggtctccacggtgaatccagcagtcaattttcagagcttgtcctgcctgccccatccacaccgcttggcacatgggtcagcccgcctttacttaccttcttcatctggcttcccggatgtcacatctcttggtttttggttggtttttccagttggcttttccaatttatacctgcagcatggatctctcctctgaactccagatacataaatctgtctatttgacattgccttggatgtctagaaggcatttcaaacttagcaggtcccacacttagctcctaattgtcagtcctgcctccagcacacgcccctctcggtgttccccatcgcagtcgaggacaactgcattcttctagtttctcaggcctcaaaccttagaatcatccgagactcctgtctctcacatatctcatctgtcaacgaatcccatcagctctaccttcaaaatatgtccagaatccaccacctccactgctaacacctggctcactatctcctagtaacctggagggcactgtcttcagtctgatcttcacacagtagccgcagtatgaagacacagggtagaccatgcctctcttcttctccaaactctccagtgggttcctcctagtcaaagtcaaacctcacttggccctctagacctcacctctgcatcctcccgctggccttatctcctccacctctgacccttgctagctctatttcagctccaccggtctcctggccattccctgaacctgaaacatggtctcctaccccagggcctgtgcactggctctcccggtgaggaaaccgctctccttcccatctccaccggcgcgttgcatccttcacctctttgctcacatatccctttctcagagaagcttttactgaggcctctgctcaccctcttctcccctccacattccgtgtcttccttttctatttcgtttctctctatggtacttatggcttatgtaacaaactaatctattgtttatatatttatttttactgtttctctgtgaaaacgtacactcgaaaagggcaggagttttgtctgtttggatcaggctccacccctggaaggtaggacagtgttcagcacagcaggtgctcaataggtgttgttccgtgaatcagcacatcaattgcagcattgtggctaccagggggtcaggatgcgggcggtggagccctctggcctttgtgtggtagccgaggactctgtgtcagcgaccgttttccgggaaacttccgggcgagactcacatcttggaaattcaaatactcaatagctctcgaattctaggaatcttgagaagaggcctggattaaggattcagacgtgggccctcagatgggtgagaaacggggactctgtgtctcctagcggggacagaagggccaggtgacaggccaggcagagtggacggggcttgggcagggggcgggggcaggcagccacacggggcaggagctgcagagctaaagccaggccatgtggactggctgcgggtttcgctgcctagctggtggcattgagcaagttacttaacctttctgaacttccgttttatgattttggaggaaacagtcatagctttctctctggcagagtccgatggcccgagtcccgctccacagtgcgggtggagggcacggaggggtgtgtgtggggggcgacagcccaggaagtctagggggcggcagggcgcgtgggggcgggggttgggagaccgcagggaggatccccgaccttgtctgaagatccaagcaggcggagccgcggtctggtccgcggggtaggcggggcgcaagagtgttcccgggggcggggggccgacccgcgtctaaaggtttccgcgattcacccgccggcgcctggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctgtgagtcgggccttgggcggtgggccccgtcctgtctgtctgcctggggagcctgcccggcgggctgacgttgggccctctgagcctcctgccgtcagcctctgtctgtccgtctgatgtctgagcgcctctctcgctctctgtctggtagcccctctctccagaagctggctcagcctcactcaagtcctcatctcctcccttgaccttggaggggcccacctgggggtccgtctcacaggtgtacacctgattccatcttgcattcctcttctctgccctgagcagcctgcctcgtacccctctcagccggccaagtgtgggcacctggcctgcccgtcatacccgccctagcctcagacaggaaagtgctagctcaggtgccttccttccccatttcttctttgtcctccttcactctttctgcaattagggacccaagtcaggtttctaatccagttatctctgacctgaaacaagacctgttaggagcgagtgtcccccccgccccccccgcaagcaggctgggaggtctcctgtgtgtccagagcctttaggagcagcagggcttgtgtgcaaaggagctcccgtgggctgccccttgctgggacagttgccatgctgtgccagaaacaggaaacacccagggcttcaaaacccctatcgatttgcaatgatggtgtgtgcagcctctgcccaattagtggaaagctcaaaagtggtttgtagaatggttctgaatgcgctatggagtgcatctcgaacgtcactgggcacaggaatcatttggggatcttggtaagatgtgtgccctccttccatagctctgggacaggtcctgagattctgcatttctaagaagttctcctgtggtgggtgctgcccatcagatactgtttgtctactcatcacattgtgagtagcaaggggtcaagtggagtggagactcaaaggaccccttcttgtgaggttttttgtaagtcacacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccatacactttagtaacattccccgcacttatgcacactataataatgacacatgaatgggctgggcgcgtaggctatagcctgtcatcccagcactttgggaggccaaaacaggtggattgcctgaggtcaggagttcaagaccaacttgatcaacatggtgaaaccccgtctctaccaaaaattagctgggtgtggtggcaggcgcctgtaatcccagctactcgggaggctgaggaaggagaattgcttgaacccaggaggcagaggttgcagtgagcagagatcgcatcattgccctccaagccctgcgcgacaagagcgtgactttgtcttaaaaaaaaaaaaaaaagacgcatgatgctcagagctgacctgaacaaatacaaccctgctacttgggtttggaatgcatttctccattcttaaaaactcttctccgccccgcatcctgcaatctagattccttttcttactggcaggctgtctggctttggtcccacagtatggactggtggaggtaattcatgtaaaggagtggtatgatcacatttatttttgaatattaagcagacatgttaaggaaggtgatgactccattactgttgcctctggcccctcttaataatacattcctaaggattcttattttagaaacatacccaggtgaaatcttaagctttaatttacagctagtataggtggctcacagctttaactgcctttgaggaccagggatatattttaaaaagagggcttgtcgactgggtgtggtggctcacacctgtaatcccagcactttgggaggctgagacgggtagatcactcaaagtccaggtgtttgagaccagcctggccaacatggtgaaaccctgtctctactaaaaacacaaaaattagccaggcatggtggcaggcgcctgtaatcccagctacttgggaggctgaggcaggagaattgcttgaacccgggaggcggaggttgcagtgagcccagatcgtgccactctactccagcctggcgaccgagtaagactctgtctcaaaaaaagaaaaaaaagggcttgtcatgtctgatattgtttaaaaaatgtgtcagtacctttcacacccctagagagactgagaaatgtaagatgtgttttgaggtgtcccactgtctaagtaaccttagacagtgggaccttggatagtgagattttgatggtggggcctggatgaagcatgttaattttggctacgtaaggtatgcgttttatttatttatttattttgagatagggtcgcactctgttgcccaggctggagtgcagtggtgtgataatggctcactgcagcctcaacctcccaggctgaattggtgctcccacctcagcctcccctgtagctgggactacaggcatgtgccaccatgccggataatttttgtgtttttgtagagatggggttttgttatgttgcccaggctggtctcaaattcctgggctcaagcgatctgcccaccttggcctcccaaaatgctgggattacaggtatgagccactgtgcctggccaatatgtgtacttttatactagatagttgtgaataccaggttttaaagaaatactatgttgcactcattgacaaaaatttaaaccattcaaaagaattcaagggaagagtgaaacccaccccctatatatcccatggggtatccactgcaaataatttactgcttatttttccggatactcttttacagtcatataagtttacacatgaacacatatttacatatgcctataatagcagacaaaatgggatcacaatacacatttctgtagtttgctttgttatttaacattattcaagaaacatccattaatatcgggacatctacatctacctccttttaactgctgtgtgctgctcccctgcacacatcatgaggtattgaagtttttctctattttggggcactttggtttttactagcctttgggtattacagtgctgtacccttggaactggtgtgcatgcctggttgttggggtagctgacaggactagatgctggacactgaggtgatcttgtgggaagttcagcgtttggccattttcagtatcacatgtcatcaggcaggtagcatgattctcaagccaggcccccaacctacattcattccaggcattgaaatccagaaagaaaaaccagcattcctgcaaagatcttgttagtgctgaagaccggacctagaagagcatgtacccagagggacggggtgattgcagatttgcaggaacctcactggagccagtttagggagctcacccaggatcattatggaaacatcaggagtttaagcacagagcctggtgtaacctaaagttgctattgtagtcactttcattgctcctgttaaaatgttcatggaatcattgagttttagactgaaagagactcaacagtcagctagtctatcacctcctcatacagaagaggaccctgagaccgaggaagatgagatgacttggcctgtggccgggatctcaggaaccccggattggaggtcttttggccacactacacatctcttcctttattttttagaaatcaattagaattcaccaaactctaaatctcatctattagttaactggtttttttttttttttttttttttgagacagggcctcactctcactcaggctggtgtgcagtggtgcaatctcagcttactgcaacctctgcctcccgggttcaagtgattctcctgcctcaatttcccgagtagctgagattacaggcgtacactaccatacctggctaatttttgtatttttagtagagatgggattttgccaagttgaccagggtcgaactggcctcaagtgatccacctgcctcggcctcccaaagtgctgggattagaagtgtgagccactgcgcccggcctaatttttgtatttttagtagagacagggtttagccatgttggccaggcgacatttttgatgtgaattcaggcttagataccaaggagtcattgctttgggcaaatgtgccctgggagacttccctctgggcttctggctccctccatccactcttgggagagaaactgtgcagatcagaacagtctgcaacttgaagtcaagctgatgaagttgtggttcaaatgtcaaattcgagtgttgtccactttgcattcctttgggagaaagtggtgctccagtggcttcaggttttttgttttgtggagttgacttccctttgtatccatttccaaatcactgactgaagaattcactgatttcattcaattaacaaaatattactgaacatccaccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcgccactgcactccagcctgggcgacatagggagactccgtctcaaaaaaaaaagaaagatgctttcatagaggtgccaaaaatacgattcatggtgaaggactgtggagcgccaagaatgggcacgtgcaggggaagcaaaaggcccggcggctggaccgcagttcaggctggaggtcacagggggaggagtcctgaggtgggaaagtgtttctggaaaagttgcccactcaatttgaccaaagcatggagtactcatggtagggcgttcgtggatgtgaaattgtgggtacattggggaagcatcaaatggcaagggtgaacactttacacttttgggggtatagaaaaggagagatcaaggattttgaaagttttttgagtggggcagttgcgtgactggagacaaatctggagaaggtgtggctggaagtatatcggaagagcgaaagataggatatgggaaaaccagtggcaagggggagccgtcagttgagtagccagcagagctgcagccttggaggggagaggaaggatttggaagaagtctgagcatggattagatgagaagggctgtgagggagtttctgaaatcgctggtcctagcaattgaatgcagagcccatgccaccacaaaacaaaacaacacaaaaacaaaaacaaggaggagctggtttttagtctggggaaggagggaagatgatcccaacattttggaaacgctgaacttgagatgttagagggtgatctgttgggagatgctgtccagctgcaggctgttttgcctgtctgttttggcacgcttgccctgaggcagagaaaagaggaggagatctggaccagtttagcagacaggaatgtgcagggattcagagcacgttttggagagagatggagccaagcttagattcctggccctgccattcaacatctgtgaggattgggctgttgatgtgacatcactgaacctgtttctccaattgttaagatggagacagcctcagagactcataggaggatcaattaagtttactaattgggtaccaatgttattaatatcattgttttcctgaaggctatatttctttatttttcagacagagtctagctctgtcacccaggctggagggctgtggtgtggtgtgatctcggttcactgcaacctccacctccaaggttcaggtgattttcctgcctcagccttccaggtagctgggattataggttcctgccaccacactcaactaatttttgtatttttagtagagacggggtttcactatgttggccagtctggtcttgaactcctcacttcgtcatccacccgcctcagcctcccaaagtgctgggcttacaagtgtgagccaccgtgcctggtctattttattttcatttttttgtaaacttttatttgcatgttttgttcttcatttcttagcagtagcctgtatgctatcagcagggagagagtccaggctagcatgttacatattagaacaatgttgcacccaagagtggctgcaggaaatgtcctcccatcagactcatattatgtccagaagagttacttttatatatggggtcctctcagctgtttgacagaagaaataataaagagcttcagatttcgttttagaatgacacgtcagctaatacacgtttaggcttatcttccaatttgcagtttttggcattaagcttttagaaactttaccagatttattttatgtttcttgaattctcttctccacatgaccaaggagtgaaattgcaagtttgtttgcataaaagaagcgcagacagccacgttccatcctgtttaccagtttaggccccggtgaatgcaagcagaggcaggtatttgtgacctttgaaagcagctctcactagcacctcttcaatgtatttctgaacctttggatgttcctggctgggcaaatggttgattaccatggaatcaagcagtaacaagccagtcttacctttgactttagtgataaggattaagtaataatctccctcccttttggttgagctgcgtgttccgagcccgagtctggttcttctgtgtgctgtgtgaagtgttgctgctgcaatcgtgttactcagtcacagtgacttcgggaggagatggtcctaagtcagcagatccaggcagccctggagggctctagttctgtcagcccctggctccaatccttgtgtccttcagtgttttagagatgctgtggaaggcagcctcccccaatcatcacaaatctgcatgttcagtgtcacaaagtccatggctgtgaaatggttcattctgttttagaaaccatttgtaaacttggaaaacaatgctaaaatttaattaaaatatccaaggatttcaaaatactggccacattaatctatgcttctaaggtgttctccatcatatgaattaaaatgacttagagctctttaaatttttcagtgggatttacagtaaaagtaaagaagagatattataggcagtttctccagttgagttctgctccccaaactccaggaagagctccttcgtatctctggggctggaaagggaaaggacacagagacttcaaccctgcctggtgcttttccactttacttgggctgcagggccaactaatttgaataaaattgaagtgaaatgtcaagaacatctcaaataaataatattcccagtgagattttatcaaatgtaaacttggagcacttttttcttcttttgccagttccttattggctgtcctccaagaagttgcctgcaaaactggtttagagatacctccccttcccccaatccccagatcaacccacacttacttagtggatgcctgcggggctctattgtcatgtggctgccttggtggggagtactatgaaccaggtgcaccgcgcgcattatccatgatccccacaaacatggccagaaacagccactcaggggctttgcacaacttgatgtcacatcatcagtaagaagcaaaggcagaatttgaactgaggtctttctggtgctgagttcttgcttctccgcatggttgtgttatgccaagggagctagaggtggaaacggtaatatttcttgcacacttgcctatgcaccaggcacttttctgaccactttacctgtatcaactcagttatgccccctctctgtagactatgaagcagacacactacattcccatattgcagatgaaccagaggtcacagatgctaagtgactttccccggctgctgagcatggagcagagctgggattggaaccctggtggtgtagagtgccagcctggggccttgaccattacactctagtttcctgaggaaccgggtgaaaggccattgcatttgtctaacgctaagtttgcacagcaaacacacttttaccaagaagctatgctaatctggagggtttttttcaggagttgggagtgttggatggtagaggttatgcaggcaggcattaccaataccactgggtctaatggagtttatgatcttaggaattcttggatccttttattactctctaaatttattcatccatttacattgagaacttactatgtgcaggcattgttctaggtgctaaggatacatggtgaacaaaatattcttttttccaggatcaagactgataggtctttcttcctccagaggcacattcagatgtgccatgtttatgtaagagtttcggtccccttggagtatacactcggcatttacctggtgccctgtacttttgcttcagacctcactagaaaaacctctggctgcctgtaaggttctaatttcgaatgtcccaggtagagggctgtgccatcctcaggatggcccaacaggtgaggtgagctcagaggccctccactcttggcattcttgtacaaagcaggttgggcccaggcctcttaagatcgaggttttaggtagcatttccaggggtggcagccctgtctgtgccctccctcccagtggctcttagaagagagtgggccattcctaaggccatgaagacaatgccccataaaggtcatgcttccatgcctgagggctctcccggtcctctcttggtgggggttgagagactagaccctcccccctacctccccaggagtgggggttatgtgatgtcaccaatgctggtgtctcactcttgcacacattttccaggctcctggcaccatggaagatctcctggaggctggtgccttcagcttcaggctctgatccttccttgttgctttaattatccgtcttaccacccaaatcaattaacaggcttcctagttaacaggcttccattttctaggccaaggcttgagaggtgaattagttcttccaagcagctgtggttttatttccagaagcgcccccatatcaacagctgtgcctattcaatggccatggatctgtgaagggcacgagcaggactcatgctaatcagctctgctttttctatattaaaaaaaacctttggccaggtgtggtggctcacgcctgtaatcccagcactttgggaggccaagatgggcggatcgtggggtcaggagttcgacaccagcctggtcaacatggtgagaccctgtctctactaaaaatacaaaaattagccaggtgtggtggcaggtgcctgtaatcccagctactcgggaggctgagacaggagaatcgcttgaacccgggagggggaggttgcagtaagccaagatctcgccattgcactccagcctgggtgacggagcgagactctgtctcaaaacaaacaaaaaacaacaacaaaaagcctttaattgaaattacccaatagattgcatgtaatatatacttgttttataaacttgatacaacatagaacgagattttaaagtatttaaatatagtgtgaatcatgattagtgtttcctcatcattgttctctttgctattctcaagaaaatctcagcttcaacttggatatatggaaaccaaatatccgggtctctggaacagtgcaatttaaaagcatgtcctagaattttcagccgtggtttgaaagccacctattgattcacacatgcctggaagtagctgacatttgtgcaacactgtgccctgattcggctggggctctggggttctatgcagcccgtttggcctccttgctgtgaggtgcggggcatttaaattctgttgccaacagtagcggccagtggtgctctggcctcagcaggtgccctgttctcttgtttgctgcctgctacttctcaaggaaggcctcaagccactttgctccttatgctctgacatttctcctcttaggcccaatacagaaaaggtggagaaaacctcacaatgttgcctttcccctctatgataaatttttttttttttttttgagacagagtctctgtggcccagtctagagtgcagtggtgtgacctcggctcactgcaacctttgcctcctgggttcaagcaattcttgtgcctcggccttccaagtagctgggattgtaggcatgtgccaccacacctggctaatttttgtatttttagtagaggtgggctttgaccatgttggcaggctggtctcgaactcctgtcctcaagtgatccacatgccttggcctcccaaaatgttgggatcacaggcatgagccactgtgtctggccacctctgtgataacttttattcagaaaacatttccttggcagatcaagtcactggctcaatcaaaattgcccttcctgcccctgcatgatcagcccccaactgctactgttgactccttttctggcagtggggctgaggggcagagcaggggagggaggtaggggaagggagctaggcctggaggtttacatctggctcagttcagcccatgtcttggccatttcacctgttcctctcctttaattgtaaggcacagttggcctggggagggcttttttggacagggtcgtgtgatggtttcccatatccctccagcctcatttgctgccttttcccatccctagagaatggcaaattgggagctgatctagaagggagctgggtggtgtgtgcaaggctccagtcgagtcccacggagggtagttggtgtcatcacctctggttcacagctgcctcctggaaacgccttccaaggcaggatggtcttctggatccactgggctctcctggagtcttcctagaacttcagacgggggatggcagccgctgcattcgctagggctcagggctgtctcaccaggagctgagacccacacctgctattgactctaggctgctgagcccgccctctctaggtggtgattggaatatagagtgaatgctcttgttaatctatccttcagggccattcaggaatgatgactgatcagcaggcagacatttataatttcttttctttttctttctgaggtggaatttcactcttttttgcccaggctggagtgcagtggtgtgatctcggctcactgcaacctccgcctcccgggttcaggtgactctcctatctcagcctccctactagctgggattacaggcgcccgccaccacgcccggctaatttttttttttttttttgagatggagtttcactcttgttgcccaggctggagtgcaatagcgtgatctcagcttactgcaacctctgcctcccgggttcaagcgattctcctgcctcagcctcctgagtagctgggattacaggcacatgccaccatacccagctaagtttgtatttttagtagagacagggtttctccatgttggtcaggctggtcttgaactcccagcctcaggtgatccacctgcctcagcctcccaaagtgttgggattacaggtgtgagccaccgcgactggccaatttttgtatttttagtagagatgggatttcaccatgttggccaggctggtctcgaaatcctgaacctcaggtaatccgcctgccttagcttcccaaagtgctgagattacaggtgtgagccactgtgcctggccagacatttagtatttctaagggggcttctgaaaacttatggagaaaataaactgcatgtgatcttcagctaattaagtccttgagcttgtttctgaggactttttcctctctcagaatcacggaagccttgcctgcttgccacttttcattgacctgtgtaaatgtgttactcggggaaatctcaagcccttcttagggtccccgaggtgtgacgggggaggcttgatggagcctgcgtctggtcctgactgctcatcatggctgtgcagccctgacaggactaagccagggtggtgggaccagcacggtgtggccagcttaactcactgcggctcagaggagacctggagacatgagggacacctggacattgttgctatcaacatggcagcatagttggctggcagccgggggaatttattctcttgacccactgtttctaccttaggatccttttcctgtgcttttctggaagcttttcctaacgccaggattaaccaggagaagccttccctcaagatatcttagcaaagttataaagtacgtgaacattgagttggagcagcccagagtaatctatcttcatgtgttctcttacacttcaaagacaactggaggatagctggagaagggtccttcctgctagaagaggggagggacgcttactgggggtaaagagaagaggcgttcccaagaaaggggcaggaaccagcttaacgcatctgtcaccacccagcggggtcatggaaacgcaaagcaggtggagcccatttcctgccgtggtttggtggacgcaggcagccccatccatgcaggtgctaaaggccctgtgtggcttggtggatgcaggcagccctgtccatggaggtgctgagggtcctgcgtgatttggtggatgcgggcggccctgtccttgcaggtggtgagggtcctgcgtggtttggtggacgcgggcagctccgtcattctttctttttgacggagtctcgctctgtcgcccaggctggagcgcaggggcgccatctgggctcactgcaagctccacttcccgggttcacgcctttctcctgcctcagcctcccgagtagctgggaccacaggcgcctgccaccgtccccggctaattttttgtatttttagtagagacggggtttcactgtgttagccaggatggtctcgatctcctgacctcgtgatccgctcgcctcggcctcccaaagtgctgggattacaggcgtgagccactgtgcccggccccagccctgtcagttctgtggcgagggcctgcatggcttggtggatgcgggcagccccgtcagttctgtggtgagagccccgcatggcttggtggatgcgggccgccctgtccatgcaggtgctgaggaccctgtgccatgcgtccttgcagagtgctgtgtggccccacaagcctaccatcgtgaacggtgtaccaccccttctgtggccctcagcttctctgtgttggttcctctgtgtgccaagggtaggagccatctgagactcttggaatggcagtggggagggctggctggtggtcatgatttgctaagtcacccaccctgacactgactgtaacctctcgtaggtctgggcatgatctggggcaacagaagttgcttctcactttaatctggccaactgctgagtctgcaagctcggaaaatgcagtccactgcatgaggaaatagcctactttcatttaatcccacaaaacaagtcacggtgcccctgtgtttgggacacagttacaggataacttgtctgtctctgggtggtggggctggcccaggagtactgcaaatcagagccatccttacaaggactttctccctccggtctcctctctctgaatttagatgcttcctggatccaggcatcacaggaaaaagacctcaggctttacaaaattacttgtataaatgtgcacatagtacccactcccttccatttggaaatatgtgaaaaatgtacttactgtttcctttggctaaattgctaacaaacagctcttctctggagtcattactagctgacttatttgggcttctttagggctttttcatttcctcccattctttcttttttttatttttttgagacagcgtttcgctcttgttgcccaggctggagtgcaatggtgcgatctcggctcactgcaacctccgcctcctgggttcaagggattctcctgcctcagcttcccaagtagctgggattacagacatgtgccaccacgcccagctaatttttatgtatttagtagagataggacttcaccatattggtcaggctggtctcaattttctgacctcaggggatccacccgccttggcctcccaaagtgctgggattacaggcgtgagccaccgtgcctggcccatttcctcctgttcttttttttttttttttttgagatggagtctcgctttgtcgcccaggctggagtgcagtgacgcaatctcggctcactgcaagctccgcctcccgggttcacgccattcttctgcctcagcctcctgagtagctgggactacaggtgcccgccaccatgcccggctaattttttgtgtttttagtagagagagggcttcaccatgttgatcaggctggtctcgatctcctgacctcaggtggatccacccacctcggcctcccaaagtgctgggattacaggcatgagccaccgtgcccggcctatttcctcccattcttacgaaaaacattcaaagtaccattcagcttgaatgcccccctagagatcttcctgaccatctaaattaaccatctagcctctcatctccctctcctgtcaccttgtttttgttttatgtcagcgagcatctgtcactatctgacatatctttttcattccaaaacacttatttatttcttgtttgtgctcaccccagtagaatatacgctccacaagggcgggatctgatctaccgtgttcggcactgtaaccccagcatctagaacggttccccgtgcacagcaggtccctggtgaatatttgtagaataaatgagcactcagatagctgtctaggaagattttgagtaaaagagaccacatggcctgaatgttcctgagggaagtgcctgagcagatgggacttgggccaaaaggtaatataggactttccttctgcacctgcctcagtgcctcatccgtgtccagtgccttcggcccctctgcccagccctcccggccccccgagctgtccctgtcaggctgcacctattagtgctaggccttttgtgtatgtcatctcatgcaatcctctgacagccgcgtgggggcagacttcacttccctctttggacacatgtgaaagggagggaggctcagaaagagcaggggagcctgggagctgaggcctggacctggtctctgccttgaagcccttcttctggtccatcggtgctatttgccctccggaatcagaagtgagtttgacagtgggctgggcacggtggctcatgcctgtaatcccagcactttgggaggctgaggtgggtggatcacttgaggtcaggagttcgagaccagcctggccaacatggtgaaaccctgtctgtactaaaaatacaaaaattagctggatgtggtggcatacggctatagtcccagctactcaggagggtgaggcacgagaatcgcttgaacctgggaggcggaggttgcagtgagccgagatcacgcaactgcacaccagcctggacaacagagtgacactgtctccaaaaataaaaataaaaataaaaataaaaataatcataaagtgactttgacagtgcaactctcaggctggaaaggagagagcactgctgctagtggggtcaccgagggagctgcatttgagctggtgggccctgccaagtccctctggcctcccagattttggctgccttcttcctgcacaagccccagcctcacaattggggtcagaaaaagatcatgtggaaataggatcgaaagcccagggacatggggtggagctcaaagctcgatagacatcttggtcttttactcatgaaataggagtgatgggtgaaaagagaagcagcaggaggagggctggtgggatgagatgtgctttgcaggctggaaagggaatgatgccaagagtggctgaaagacgctgacaggcgggcccgagaagacagccggagctagctcctgagatagtcaggccggaccaggcatgtgggtttggatggtttctaggaggggctcagttttgcccagccagtcacagcgagttatgttttgggcaaatgcacttgcaggagctgaagcagtcacggccactggatcagggaccgtcagttcccaggcgagcgcacatcgccatcatggccaagggcgcgggtgtgcccttaccacccactttcagaggcttgctggtgtcttcaaagacccatcttttccccttcccacatcaaggctctcgccttgctctgtgcatccttcctgtgagacgtctccctcctttctgtgttcagggcaaccccaggctatgacaacctgccgcttctgtaagtctaagaagctaggctgcgtttagacaagccactggattctgggaattctataattactgacttgcaggttgcttaaaaatagtgaaaactccaggatccctgcaacttccatgccctaggactcctgccaggggcccagggtgtcaccaagagagccctggcctgggagtcataggcagggtctcgcctccaccctctgcctgggagtcataggcagcgtctcacttctaccctctgcctgtgtggagaagtccacaggagtcttgggtctgagttttctcctctatgaaatgaggcagaggggccggttgatgctttgtttcttttagggtctttttagttataaagccataaaccccttggcttggctcgaaactcaggctacccccgacccaggcttccttgcttgctgggtctctctattgattcgtttaacccgtgtgtttgggggccaacactggttctttctgggcaaaaccaaaaacacccgcaaactttttatgtaaaaagcactgagacacatactgcaataaacagatatctactatatctgtagtattaaaaatatttcatgggggagtatggttgaggaaaaaatgttctaaaaagctccctaggggaatcataatgaaaacaaagttaagaaacactgatttaaccacaaaagtgtgcagggcaccatgacaggttcgaggtgaagaggcagatgatagtatctcctcctctctagggtctgtccagaccttcctgccttgttctcccaagctgatgtcctccttcctttcttctaaatatatatatatatatatttttttttagacggaatcttgctctgtcgcccaggctggagtgcagtggtgcgatctcggctcactgcaagctccacctcccgggttcacaccattctcctgcctcagcatcctgaatagctgggactacgggcgcccgccaccacacccggctaattttttgtatttttttttttttttttttttttgagacggagtctcgctctgtcgcccaggctggcatgcagtggcacgatctcggctcactgcaagctccgcctcctgggttcacgccattctcctgcctcagcctcccaagtagctgggactacaggcacccaccaccacacccggctacttttttgtattttttaatagagacggggtttcaccatgttagccaggatggtctcgatcccctgacctcgtgatccacccgcctcagcctcccaaagtgctgggattacaggcgtgagccaccacgcccggcccttttttaaaaaaattattattatactttaagttctgggatacacatgcagaatgcgtaggtttgttacataggtataaacatgccatggtggtttgctgcacccatcaatctgtcatctacattaggtatttctcctaatgctctccctcccctagtccccagctccctgagaggccccagtgtgtgatgttcccctccctgtgtctatgtgttctcattgttcaactcccatttatgagtgagaacatgtggtgtttggttttctgttcctgtattagtttgctgagaatgatggattccagcttcatccatgtccctgcaaaggacatgaactctttcttctaaatcttaccgaacactcacttttggtgggtttatggactcatctacatgttctggtggtcatggcttattttttgtggcttttgttccctgtagctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaagggtgggtctgtacttccaccattgagggttttaatgtagccggtcttcttcccagcttcataattgactccacttgttcagctgagctgggtttctgggagtccctctagatccctgctgtggtcttttcatagcttccacctcactgctgccatctctcgaatcctccctgagccactgtgcagatgagtgttgtggctcacgccgccttctccccagtggactcccacaaactcatctccatttctaactttttattgccatgtttaaggctcttcaaaccctggcttctgttggtcacctcttgtactacatccctatccaccaaattcctgaccttcacactgaccctcctgttgacctagactgcttgaaacttccatccctgatgcacgcattggagtccctattggtctgtctctgcttcttttttttttttttgagacagtgttttgctcttgttgcccagtctggtgtacagtggtgtgatcttggctcactgcaacctccgcctcctgggttcaagcgattctcctgcctcagcctcctgagtagctaggattacaggttcccgccaccacacctggctaatttttgtatttttagtggagatgaggtttcaccatgttggccaggctggccttgaactcctgacctcaagtgacccgcccaccttggcctcccaaagtgctgggattacaggtgtgagccaccacgcctggcgttatctctgctttttgagagcagaaaatgaatcttatttgtctctgtgtcccagtgtctagtgcaatgcctggcacattggagggcctcaacaacaaatgactgttgaaaaagattgttaaatgaaagagtattcccagcttttataaaacaacaattgtaattagaaaaaaaaacttctgagattagaagtgcagttatatgggcttactatctttcccagtttgagaggaactgggaacatgaaggagtagaattaggaaaaaacaatgagaagatgaagaggctgcctgtcctcaccctattaagagggcaggagccacatctgatgaagttgtttttcatcattcctaaaatagccgtacatgccagacttgaagttcatgtttttctcagctgggcctttcaaggtctttggcagctttaggcgtatggcttagatttgttgtttaatattctccatcactcacgccggacttctcttgtctatcatgggccttcatgataggcagcttcctgtgttccagtttccagttcctcctgcattagtgagggtggtctgtgaagagcaagagggcagggaatcatgttaatctgctacagacatttaaaaacgacattgtaaagtggctaatttggagatggaaaactcccagtgatgtgctggtaaactgggtctcaaagcaaacaaacaagtctctgatatgtccacttgcctctgtcaatggtgtgaatactctcccatcgttgattttaagctaccaatgtgatatcactgaaggcagagttgggaagagatgtgcaccgttagctcctgagagccgataccagccagctcctgcacaccactgaaaatcccactcaaaacaggaatctgcggtattcccactaccactgaaagttatctactttgggaattacgctagaaatttgttttgtttagttttgtttttagagacagggcctcattctgtcacccagactggagtgcacagtcatggctcactgcagcctcgaactcctggctcaagtgatacctcctgtctcagcctcctgagtagctgggactacagatgtgcagcatcatgcccagctaattgaattttttttttttttttttttttttttttttacagaaggagtctctctatgctgcccaggctggtctcaaactcctgggctcaagcaatcctcctgtcttagcctcccaaagtgctaggattaggcatgagccaccgtgcccagccaggatatttttgaaaactctatgcaccccaacctcaaggggcatctgtaagacctccatgagaagtttcttatagatctcaaccctagcaaagtctctgcttcacctaaggaattatttttttccttacaaataaaggaaaatgagtgactaaccttctttttcctttggctgccaggaaactcaatgcaaaattatgatttgattatatcaacaatataggaaatcatgacttatctgtattccattaccttcatctgcacctcttaagtggtattttctctgtttaatggtcttgtgtgtatgtgtgtgtatctgtgcattctgtatgccatctcatgccttccatgacagtacaaataaataagacccacattttttgaactttcttctaaattcccattcttagcccctaatgtatactcctttagtgtatcttgctataacattttaaggttgtatttcttttttctgtgctcagggtaaatatgtggtctgttttgatccccttgatggatcttccaacatcgattgccttgtgtccgttggaaccatttttggcatctatagaaaggtaaaacgtgatatcttaagcacttggtttggggacagaagttaagattgagcatccagtcctatttcactgtggcagagcagccggagtggagatcatgaaactgtgagactgaagtagatttgtatctcaagttctgagcttttcagcactaattgcatgacgaagacccactagattgttgaaagagaatatagggtaaaatatgggtgggaagagaaggatatttcactctttttactatgtcttactttttatgatagaaaatgagatttaaaaaagaggcagtagagggtaagtatagtgatgatacgatgtgaactcagagttgagagtgtaagacaacaatagagactatgtcaaaactgtcctttaagtcccctagtcaatggtctataagctatgagccccgggctgagtccagcctgtggcctaatgtgtacagcctgtgaacaaagaataaccatttttacatttttaaatagttgaaaaaaactaaagaacaaagtttcgtgatccattttaagttttactcttcacgaatgaagctttaattggcatttggtcacattcattttttcacatactgcctttggctgattctctgctgcactgtcaaagttttgtagttatgatagagactgtatggcccataaaactgaaaaatttactatctgtctgtctgtagaaacagtttactgagctttgctctaagtcgtagaaagcacacagcataggatgagaatccagccctgctcgggtctcctaacacctgactcgggcagtcacccctcctccagagctgctttttctgagagagagagagagagagaaagagagagagagagaggagagagaggagagggaggaggaggaggagagggaggagagggagagggagaggtgctcaattatacaaataagtgaaaaatagaatgaaaacccatccacccatcaggaaacatgataaaatccaaggtacatcctcttagctttagctcttgttttgttttattttttcaaagtatatattttaggccggatgcggtggctcacgcctgtaatcccagcactttgggaggccgaggtgggtggatcacaaggtcaggagattgagactgccttggctaacactgtgaaaccccgtctctactaaaaatacaaaaaaacagccaggcatggtggtgggcgcctgtagtcccgggaggctgaggcaggagaatcgcttgaacctgggaggtggaggttgcagtgagccgagatcacaccactgcactccagcctgggcaacagaacaagactccgtctcaaaaaaaaaagtatatatatatatagttttaacagctttggggggtacaaatagtttttggtgacatgaatgaattgtatagtggtgaagtactgagattttagtttatacctcacgagaatagtatatattgtatccaatatgcagtttttttatccctcatcccctcccatcacccccttctaagtctccaaagtctaccataccattctatattcagctcttgtttatttcagaactgaaacctcacaggctggaatcgactgaagaggttggttcagctgaactctgttctaggacacaaaggcattaacttaagaactgagacccttggcctagcgagatggctcacgcctgtaatcccagcactttgggaggccgaggtgggcggatcatgaggtcaggagattgagaccatcctggctaacacggtgaaaccccgtctctactaaaaattacaaaaaattaactgggcatggtggcgggcgcctgtagtcccaggtactcaggaggctgaggcaggagaatggcatgaacctgggaggtggaggttgcagtgagccaagatcgcgctactggactccagtccgggtgacagagctagactccgtctcaaaaaaaaaaaaaagaactgagacccaaatttgcactttatctctaaaagtgacttattgtctagtattatacataatttcctttcaaatatgtgaaaagtagagcccccatggcacagttatctttggtcattggaacgtattttgctttttatcttgggtaagaggcagatccacatcacaatcagtttgaggaatagaagattcaaattctcatactagaaaggcaaaaaggcaacaatttatccattttccaagtcatgccaaggaacataccatttctgttgtagacatggaagaatgcaattttccttgcaaaatatcaaatccacagaatagcaggagaggtttgtagcaaaattcttccttgcagaggaagacatctggctaatgtgttaaccacaactaaagcagtgttgatgtttactaagcccattctccatctcagtccccccaaataatactttttaaggaaaaaaaacctgggaaattgagagacattggctatcaactaaaaaaaaaaaatcaagccagcttgcaacagcagcttgaattatgaatgacagaattctcaacaataaggctcggctgtcttctcaataaaccagaagtgacttttttaaaagacagaaagtggggcctggtgcggtggctcaccccggtaatcccagcactttgggaggcccaggcgggcggatcacgaggtcaggagattgcgaccatcctggctaacacggtgaaaccccatctccaccaaaaatacaaaaaatcagccgggtgtggtggcaggcccctgtagtcccagctacctgggaggctgaggcaggagaatggtgtgaacctgggaggcggagcttgcagtgagccgagatcgcgccactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctttttttctttttttgagatggagtctcctgtgtcgcccaggctggagtgcagtagcacgatctcggctcactgcaagccctgcctcccgggttcacgccattctcctgcctcagcctcccgagtagctgggactacaggcgcccgccaccacgcttggctaattttttttgtatttttagtagagacggggtttcaccgtgtgttagccaggatggtggcaatctcctgacctcgtgatccgcccgcctcggcctcccaaagtgctaggattacaggcgtgagccactgcgtccggcctttttttttttcttcttttttttctttttttttgagacaaggtctcactctgtcgcccaggctgagagcagtggcgccatcatggctcactgcagcctcaccctcccgggtttaagccatcctcctacctcagcctcctgagtggctgggactacaggtgcaccaccacacctggctaatttttgtattgtctgtagagacaagggggtctcgctatgtttcccaggctggtgttgaactcctgggctgaggcgatcctcccgcctcgacctcccaaagtgttgggattacgggcatgagccacggtgcctggccccaccagtgtctggctggagacatcctgacagggcgaattctcctgcaaagctgggtaaccatcatggtttgtccaaatattgagttgaaatctgtttcattttgctcacttggctgtttagagcataagaaaataagattctttgacatgtttggaaacagtgtttctgccctcccaataatgcccaccacacccactttttttccctttaagctgaacatctttcacaggagagggatctgagacttctctctagcctgatcaccctctactggacatactctaacttgcaatgtcctttacagctcccaccacaaaagcagagattcagaaaagtagggtttggtttctgctccgaggaaagaccactgtggacgtgacagtctctcctcccccaggccctccgtttctgtgcctacttctccttatgtgatgacatggaataatatgtgatgacatggagccagtgcctacagcaggtggtggcctcagataggcagagaaaggaagggtccagaggtttctgattttgccaagtgctccgtgctcattggtccctgggcatctgcaggagaatggaatatgtttcccttggaggaaaggcatgcattgctgagcatttggaggaaggaattagaaagggggctgatcccagctctttgggaggctgaggcaggcggatcacctgaggtccagagttcgagaccatcttggccaacatggtgaaaccccatctctactaaaaataaaaaaaaaaattagccaggcgtggtggtgggcgcctgtaatcccagctacttgggaggctgaggcaggagaatcacttgaacccaagaggtggaggttgtagtgagccaagattgtgccactgcactccagcctggcgatagagcaagactctgtctccaaaaaaaaaaaaaaaaaaaagttgggggctgggctagaaaagaattcctccaaatccatggctcagtgggataattttctcttcgttttgagtatgtgggtcatagacaagtattactattattttttattccgtgcgaggaagtgtataaatgtagagcatttggtgaccgtatgtcagggaagggctgtttacttttgcacctttgccacaggccggcacggatggttctgggcgaggtgaatctctgggaaaaggggcctttattggcagagaactggttacttgaagcctgcagtgggaggagaggagagttagagtcctgagtccacccactgtgtacctggcttcaagggaagctggtgattgttaaaatgagcctctgacaggcagcgcatgttgacaaaggccattaatttcatttttcaaggttgtgcattggcaaaacttggaattattccctcaaagttttgatcctgtaagtttagtctgtgtttagctccactgtactgtctggtgaatacaaaccaaactgaatcaaataacccagtgcaaccagctaactaaccacctccccaggtgaaaactaggaggggcagggaagcggtggaaagaaatgggtttgtggttttctggtttgtggttttctcatttatatgagtagttgttatgcttgaatgtgaagttcttacacttgagtgtgaaggtcaccccttcacattgcatagtgcaatgcagattctcaggccccgccatggaaagtctgacagtgtgtctaggctgtagccccagaatatgcatttcttttctttttcttaaagaggcaggttctcattctgtcacccaggcatgtgcagtggaatgataatggctcactgcagcctcgacctcccaggttcaagtgatccttcagcctcagcctccttagtagccacaggcacatgccaccatgcctggctaattaaaaaaaaattttttttcgtagagatggggtctcccagtgttgcacaaactggtctcaaactccttgcctcaaatgatcctcctaccttagcctcccaaagtgctgggattatagggatgagtcatgaccccggctgtgaatgtgcatttttaataaatatcccaggtgattctaatgcaggtgctctgtgggccacccttttgaaagttatgggaagaaattacctggaatgttttgctgggatgacttccttctccagctgcgtgatacagatgcccctgcttacgctcagctgcaggaatctaggaaaagaataagtgaagttcgagaaattgcatatttttatttctgcttaattcaagcagagagtagttaagctgaaagatttgtttggggctgtcttgatgaccaaagaggtcaatccagtgttaataaagaagatcaggctgggcgcagtggctcacgcctgtaatcccagcactttgggaggccgaggcaggtggatcacgaggtcaggaaatagagaccatcctggctaacacggtgaaaccccctctctactaaaaatacaaaaaattaactgggtgtggtggcaggcgcctgtactcccagctacttgggaggctgaggcaggagaatggtgtgaacccgcgaggcggagcttgcagtgagccgagatagcaccactgcactccagcctgggcgacagagcgagactccgtgtcaaaaaaaaaaaaaaagaagaaaatcattaatagtaagaaatcagtggttaggagctgtctccttaaggggctcccttccctagtgttagaaaaactctggaccacatgacccagtgggctgtgtttttaatgaaaaaatggattacggcacatgccacgttctaagtgtaggtattattttggtaactttttggtgtgtgtgtgggggcactggtttgtgatgtaaaatgtgcttcttcccatgcatcacggttaaaacactggacagcatctgctctaccccataatgactctggggagatattctgagttcctacgtttctgagaatttccctgacgtgtgagtgatatagaccacatgctcagcagagtatgggctgcagcggcaagagctcacaaaactgatttcctccgcagactggctgccctgcagcccagtgttaatttatttaaataaagatggagtaggcaggtgacagagatggatgcccgtaataagattaaattagtgggaactggcaagaaggcatgctcttttttggaactgatagtggagagatgagggaatatcacattagaaaaattggaggagggccctaattggaaagaggaatccagatgcaggaaatctgggttctggtgggaaggctgccgtgataatctaatcaggatattgctgatgtgtaggggaaggcccctctgggaagatgccctatttcattagaagagcaccttgagaatgcctcctgttaatggttgaactgtaaaaaagaatcacaaaacaaaacaaaaacattctttgatttctttcttgctctagaaatcaactgatgagccttctgagaaggatgctctgcaaccaggccggaacctggtggcagccggctacgcactgtatggcagtgccaccatgctggtccttgccatggactgtggggtcaactgcttcatgctggacccggtgagagacctcacaggaggctgggggcttggctggtgtctgtgagcaaatgaatgatatgtgtgggggattggcaggggtatgtggaggtgggaggtgatgcccatggagggacagagatgatgatgtgtggtggaaagggggcaggagaccaagagagagtgtatgcctcccgagcagactatggaggtgagaaatgccatctcagactggcacaagagggggtctttgttccaatgtgaattcctcagagcagctgttactcaaatgacccaaatgccaggtccaggcaggccatagggatgatgaagtgtgctggggaaggaaggccggggggcaagggtggaactggggtgaactgaagagttccagcaattacaattgggaggagggggcccgccttgccaaggcttctattaatgcttcaagaaacactggattgtaaaaaacataatgtttctgcatgtgtgcaacactatgctggccaactaaaatgcatttatggacctgatggggctgtagatattctgtttgccataaactgtatccatccatttctagcttttctactttagtcaccaaaaggctgttttcctgagacgaatgggtgtgccaactgaagcagtggacgacattgcttcttcaaaaatagctcccacatttattcgtgtacatttacacaaaccttcagttaactggtgcagtctttctttctttcttttttttttttctgagatgtagtcttgccctgtctcccaggctggagtgcagtggcgtgatctcggctcactgcaagttctgcctcctgggttcgagcgattctcctgcctcagctcctgagtagctgggactacaggcgcctgccaccacacttgtatttttagtagagacggggtttcgccatgttggtcaggctggtcgcgaactcctaacctcaggtgatctgcccgcctcagcctcccaaagtgctgggattacaggcatgagccaccatgcctggccaacttttttaacttttagagatgtcctcctatgacattagtgaactatgtgtaaagtgctttttgctggcaaactgaaccccaggaacagacaaggaataggaaccttctgtgcgagataggctgctggaggtgaggccgggtctgtgtgtggcaggaaggctaactcaacacaggctgcctttgtcccaggctgtcagggaagtggactttcacctccttggaagcatgggcacttaacaaataaacaagggtagggtaatagcactagttaaagtcgccaaatgtggtgacctgggtaggggtggggtgggggagttagtggcagaaccagagcaaagttccacctgagcccaggatggaatttcgggcaccactgatgtttgctgactgtgatttgccgggccctgactgcttcccattcttctggtgccttctcttgttacctttgagttggtggaagcagagaaaacattcaatcccttcttgtttccagattgcaggggagcatccctgtagggaagcttctgtgtgtttgatagtcttttgccctcctcagtcctgaatgtttggaagcgcaatgcagggctgctgggatttgattccagcccttctgtctgcggtgcctgacggggctgagcctcccgccagggaggtgctaagtgcttcctctttgtttgcgcttgctgcaaagccaggctgacggtttctgctgaaaacactgctacagctgtactcgggtttccagcggcttcaactttctgggagcttttatgttttgtctctgtacacagacttccctcctttgcaccatggacagtctggctgggccctgcgctctgcacccagcaactgttgtgagatggctttcttttctatatagttttttgaaagacatttatttatttatttttctaccaacgataaaagaatattccggtatacttgtggtcaaaaattttgaaaatattaaaaaaggcataaaagtaagaaagaagaatcacttccagtgacacctttcaatggccactgtgaattctcccctccctttctccctgtctgtctggtttcaacgtattccatatgggtaggaaccaatttctgctgtggaataaatggctaggtagagaggtgtcggtgggccttttttcttttcaactcttgtgtcaacgtcaagcccctcctaaatgggcagagcctcgatcaccctcttgccaaaaacacacaggaacccataacaatcctcaatccggagcaataggacttctgcaacacttttcccccaaattcaaatctcctttgaagagcctaaagcttaaaggcataagcttaaccctgggctatgtgggaagaggcagtctgagaaaaacttcacacgccagcgagcaaaggccatcggaagttacgtacgccagactcaaaactcagggttctactttgttctataagaacgcccagaaaggagaactcccatcaaggtagaaatgtaaagccgagaacagcgctgagcacttgggtgtaactcagggactgatcctgcggtggcccgtctctcctgagagcccacctcccgcctgaaccaacccttttttctgtttggtaaaggcatacacatcttatattgctttggacacacggttcttactctcttgcaggcttagcagttgtttcacaagtctgctctccctatttttgtgtggtttctttcttgtttgactgaaatcatatgcaaacaaagtcgaaagtgtctgttatcaccctgatggcttctgcagcattgtcttgcttcccctcaccccattcacagttcccagagagcctggcaggtgtctcggggccccaagatgagtggtgcccgtgcgccgcgaccccagcccagcgtagcccagcccatcgctcgcctcatccaggcctgggggacccagtgcgctcgtcatctctccacctttccttccttgtctaaaaaggccatcggggagttcattttggtggacaaggatgtgaagataaaaaagaaaggtaaaatctacagccttaacgagggctacgccaaggactttgaccctgccgtcactgagtacatccagaggaagaagttccccccagtaagtgagggcccggggagggtggtgcaggttctgggcatctggcaccagaggccgttctggaggcaggggcatcccccggagatgaaagggatccttgggatcgagggccttgggcctcatgtggggctcctgagcagtgtggaaatctattggttgatgacttaccctaaaggtgaaaggaagcagggatggagtggattgggcttccgtctacactgagcccacgatgaagttctcacctcagtactggagactggaattctcaccctgagacatcaaaaatcagtctccatgtcagcctttgctactttctcttggcagaagaaaattaggataataaagttaaacaaatgaatgaattcatggcagtaaaacatcttcccttctggggtccatggtcccagatgggatgaaatgtggttcccccactcaaatgcccgtcaagtggtgtctgccccttgctaggcctgcctgaggtgcatctatcagttatctcgagaccgagagtgcccatcgtgacatctccctaaagaggttacaagctagtgaatatgaagagaagaaatggctgtgtggagcttgctctatatggaatatctgattttgtcctttctttgtttaaaagccatcgatggctgctgtttgctagagatgaagctcaaatgtttgcaggacgttcaaggaggcctcagatctgccccaggctctctctccagcttactcatctctcctttcaccttatcctggattcccctcctgcccccaagctccgcacacgcacacccgagtcccgcaggctcctcctccaggaccatatccctctccacattgctaagcagacacttgtgcagtttcctctcctgtaaattacacactgcctcccacccctgcccggttccttagcttggtaacaaactttctcagcctttaaggtgttactaaatggtacagtttctgtaatgcctgcctcagccccataaccagaatcaaccataccctcgttggggcttctgtgggtaatctgacctattgtgagatgatgagaggctgtctccatttttccattttctatttattgggaacaggattctcatcacattttttagcacagccccaaatacataccttgtaggtgctcggtgaatggatgtggaatcaaagaaacttaggagacaccaagaaaactctctttcttattttctgcaatcctaattcttgctggtcttaacttgcaggataattcagctccttatggggcccggtatgtgggctccatggtggctgatgttcatcgcactctggtctacggagggatatttctgtaccccgctaacaagaagagccccaatggaaaggtaagggtgtcccctggagagggagtgaggagcagatttcacttgcagcccacgcgatttagtttaggaagaagaaaggttttgctagctattacgctccatgctaggttgctacgtgtgtctgtagcatattcttttgtggattaaaggtaaagccagacgatatcaactaaagataaaaatagtctcttgagagcccttccagtgctatggcaaaagagaatgaacggtcaggacgaggactgaaagtccttagggcttccagtggatacagggcttggctggggcaaaatgaattccattcataaagtgaaatgaaacaacccagcctcacttccaaggcagcgaatcaaatgtgtatcctcagtagaagtcttctttgattgctttcaaaaggtgtaaaacagaggtaactagtgagtcaacatccactacttggaaaacgataccttttaggggaggaaagaatctctggggaaacctagagctttcaggtgagccgtcaccaccgactcactagtccaagcccatggtgttcccagcaggctgcagggtggctgtgctccctcacgctcgctcagagctgccctgctttccttctgccagggtgacagtgtgcttccttcccaagtattgtgtccttcttatgttttcccagtggacagatggctttttaggcagagtcttactcgtcgcccaggctggagtgcagtggcgcgatctcagctcactgcagcctctgcctcctgggttcaagtgattctcctgcctcagcattctgagtagctgggattacaggtgcccgccaccacgcccgactaatttttatatttttagtagagacggggtttcaccatgttgaccaggctggtcctgaacttctgacctcaagtgatccacccgccacagcctcccaaagtgctgggattacaggcatgagccaccacgcgtggctgcctttttttttttttttaatgcaagaggagaacaggaacaacagttcccttaaacacaaaacctgtgtgtttggatgtatttgggtctgtttgcagcatgtggcatccagaatgaaggcatttctatttactgaaaccatcatccagctgtagctgcctcgggcatatcaacctgtgtggttagcctgctttccagcacttttctctaaagtcccccgaaattgttcctgaacacaaatattgaggctccttcttttttttttggtttttcaaaactagccatgacacctatgtggaaatagactcaggaaacacctgcagaaagctgtcgctcagtaggcagactgcatgaaaaggcatacaataaaaaagttaatatttaaaagtgaatgccaagacgtataatacactgaattccaacccaaaagccttcggagaatcgtaaaaggaatgcacacagagttgcaaacaatatcacactgtttggaggagccggtctgctttccagatgtctgtagccagacaccaccatggattttttttattgcttttagaataggcgaagctccatccaacacacacagaatcactcattaagtccagtttccatggtataaagagaaggcaatgatcgcttctgccaaaatgtcattctgtccagtatgcaggtggtctgtctcacatttgcatcgggtaatctattgctggcactggcttgatgaatggttgaatttaaccaaatggttaactgttttgtctcagatgcaacctggggtgggaggaaacttttacagcctcacaggaaggaaaaatacagtattcgttcccttggaaactcccaccagctctgcatgttttgctgcagaaaagtctcttttttacgcaataccttctgatacaaggaggccgctacccggtcttgttttccagctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgcatccggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaagtctcccttgctttgtgtcaaataataatgatgatgacaataataactgctgatgcatataacattagataactcatttaatcttcacaataacccaatgaatcagatactctgaataatccattttatagatgacaaaatggacgaggagaggtgaagtaattggctcaaggcttccagccaatgagtggcagtgtggggacctgaatgcaggcagcctggccactgtgagccagcatacggcttctccttcatgtcgtcccgttcaggcctggcccatcattccccagccttgttcaggattgcagctgaggaaccatgcagcctgaacatggcgactcacgccctcctagaaatgggggagctaatggcttagtggtggtaactgcatgtgaccctctggcctcccaaacatggatgtaaccatctgaatcccaagtgaaagtttactgtttacccagtggtgatttttctttttctttctttctttctttctttttttttttttttttttgacgcggagtcttactctgtctcccaggctggagtgcagtggcgcaatctcggctcactgcaacctctgcctcctgggttcaagcgattctcctgcctcagcctcccgagtagctgggataacaggcacccatcaccacacccagctaatttttgtatttttagtagagacggggtttcaccatattggccaggctggtctcaaactcctgacctcatgatctgcctgcctcagcctcccaaagtgctgggattacaggtgtgagccactgcgcccagccacccagtggtgatttttctataaaagcacggcacttaactcacaaaggctaatagttcctacagtctagttaccataagaaaaaggattcactacaagaacagggtttaaggaaatgcaatttgttgcaagcaagcaggcttctcactaaactctctatagaaacagtttctccctccgctaaccctggtcttactggaccagagtccaagatcgtggcaagctctgtcaggcactaagtaacacctgtggccctccttgagctctagatataaaatggatctatccatatgattccacttgggaactgaaaacatgtgtgtatgtgaatcctgcttcttcccctccaaacactccccattcatttcacattttcccagcaggaaattgatcttgagcattggatctgcttctgcccactgaccagacagacccaaagccaatatttctccactccagctggggctgccctctgggaaagtcccctgacgcacaaagcacctcttgagttttaaacttcttgtaactcagctggcatctggttctcaaagcatgaagggagagaaatatggtctgggagccttttccatatatatatatcagggtgcagtggctcacgcctgtaatcccagcactttgggaggccaaggcgggcgggcggatcacaaggtcaggagatcaagaccatcctggctaacacagtgaaaccccgtctctactaaaaatacaaaaaatagttgggcgtggtggcgggcgcctgtagtcccagctactcaggaggctgaggcaggagaatggcatgaacccgggaggcagagcttgcagtgagccgagatcacaccactgcactgcagcctgggcgacagagcgagactcgtctcaaaaaaaaaaaaaaaaaaaagaaaaaagaatgagggtctttgcagatctaattaaagtaaggattaagatgagatgagcctagattacctacattaggatgggtcctcctctgaagccatgcatttttgtacaggttcatgacatggcaggagcctggaggcctaagccaccgccatgtcgatgtcagcctgggaccagaaggagagacaaacctttgctgtgctaagccgtggggatttcaggtttatttgttgctgcacgataacatacgctatcctgactaaactagaccaagcttggcaatatttttaacctct

SEQ ID NO: 11822 - DNA, 5173 bp, Human
tcccccagtgcccgaggcagccctaacacactgttcaggcctaaataccacccatgacctaacgtggaagaagtcaggtgacaggtgtgagaaagtgtaaagcaagtggcctcggctcaaaccttctttaaagtagggccggaatggctgagaagatggagccgcccaggctgccccacagcagtagcaggtgttaaactgtgctcctttcctgccgaggccttttttttttttttttttttttttttttttaatgagagggagtctgagcttccatcagattgtcaaaggattcaagactaagattaagagcatcccccaaagagaagcagctgcaggttgagaagtcctcggaccgcctaatttccgccagccctgggattggtggcgccgcctctcagcgcctcctttcccggggaacctgcaaacctggcgcggccgagaggcggattactgacccaaatacggatggggatattgggggaggggagccagggcgacagggcggcggccccagactgggagggcgggtcacagatccctcccagccccccactttcgtagagcgtgggcaggaggaacctctgggttccgcggatcagaaaaactccaaaggccgggttgtgagtcccgggaggggaggtggagggcgggggcggggaggggcgcgggaggggcgggggcttgctccggccccgccccctgcgctccggtgcaggtcgggctccccctggcggtccccggccccgttcctctcctcgtgcgcccccctcccgccgtcctagacccctgcctagcccaggtcggtctccgcggacccacggacggacagacagacgggaggacggccagccgcgagcgcccgggcggcgggagggggcggggaggcgacggccgtggcgtgaggagcaggagcaggtgcagcggcggcggcgggcggggccgggacccggcgcggagcgggagccgcggcgcgggcgggcggcagggaccgggaggccgcgactcggagtcagccccgccgggtcgcgcgcaggtccggggagccgcggttgagccgggtggggtggtgactccagagaacgcaggatcccaaggagacagagaggacgagagctggagggggatccggaaagcggcgggggcgctccgggaggggtggagtaggacatagggggcgcacctggaggagagacggggcgggggtggccaggacctgagctggagcctgggagcccgaaggccagacaggtgaggcgggagacccggaggtgggggtgaggtccggttagtgggagagatccggaggtgttaagttctgagctgggctgggaaggcaggctgggcggggagaagggctcttagcgggaggcccaggggtggtcagctggtgggggaagctgggggaggacgcagggccaggtggagagccggcagggttgggggctccctaggcgccaggcaggtgggctcaagggtgaggctgttttttttgttttgttttttgtttttgagacggagtctcgctctgtcgcccaggctggagtgcagtggcgtgatcttggctcactgcaacctccgcctctcgggttcaagcgattctcctgcctcagcttcctgagtagctgggattacaggtgcgcaccaccatgcccggctaacttttgtatttttagtagagatggggtttcaccatgttggtcaggctggtctcgaactcctgacctagtgatctgccctcctcagcctcccaacgtactgggattacaggcgtgagccaccgcgcccggcctgaggctggtattaagaagtgaagtgggacccaggtggaggtaaggaagagtctggtggggagttatctcagaagtgaggccagcacaggctgagtgcagccccagggtgagaaggtgcccaccgagaggactctgcagtgaggccctaggccacgtccgaggggtgcctccgatgggggaagcccctccctgggggtcaccggagccatgctgtcccgcaagggcatcatccccgaggaatacgtgctgacacgcctggcagaggaccctgccgagcccaggtaccgtgcccgccagcggagggcccgctttgtgtccaagaaaggcaactgcaacgtggcccacaagaacatccgggagcagggccgcttcctgcaggacgtgttcaccacgctggtggacctcaagtggccacacacattgctcatcttcaccatgtccttcctgtgcagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgatcctcatcgtgcagaacatcgtggggctcatgatcaacgccatcatgcttggctgcatcttcatgaagactgcccaagcccaccgcagggctgagaccctcatcttcagcaagcatgcggtgatcgccctgcgccacggccgcctctgcttcatgctacgtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactctacgacctggcacccagcgacctgcaccaccaccaggacctcgagatcatcgtcatcctggaaggcgtggtggaaaccacgggcatcaccacccaggcccgcacctcctacctggccgatgagatcctgtggggccagcgctttgtgcccattgtagctgaggaggacggacgttactctgtggactactccaagtttggcaacaccatcaaagtgcccacaccactctgcacggcccgccagcttgatgaggaccacagcctactggaagctctgaccctcgcctcagcccgcgggcccctgcgcaagcgcagcgtgcccatggccaaggccaagcccaagttcagcatctctccagattccctgtcctgagccatggtctctcgggccccccacacgcgtgtgtacacacggaccatgtggtatgtagcccggccagggcctggtgtgaggctgggccagcctcagctcagcctccccctgctgctcatccagggtgttacaaggcacttgtcactatgctatttctggcctcagcaggaacctgtactgggttatttttgtccctgctcctcccaacccaattcaggactggctcacccctctcccccgcccaaggctgcagaggctgtgggaggtactgggccctagagctgtgcgtccagccagtcctgggtccccacgattgaccagccacactctgggccggtggctggggaagaacaatccccgagggctgctgctttgcgtctgtggctccaagaagtgcctgtggtcaggccccagctctacttggtccctgaaaaagcacctggctaagggctgggcctggccagcagggagggcagttgatgagagagggtgttcccgctggagggttggtgctgtggagcctacaccggcagggacagcctggggctgacagggctcccctccgagggccagtttcaggtctggaaggggaggaagcaggggaaggtgacctgaggaggctcggctttgtagagccccgctcaggcacagggaggaggagatgccagggctcctgccttttgccacatcggcctcgtgcagtgagggctctgtgggctggggctgctgcccctgcctacctcctgcctgtccccagaggctgaggagagggggtactgtgcccaccacacatgattaggcctcagacccaactctggtcctggctccacaacagtggctgccactcactttgtccagaaggtggcttgggggtggatatctttgggttgctggaaaaggtgtgggaaggttcaggatggtgggagggactgaggtccctgaggtgaagaggcccttggtcctgacgggtttgacccgtgcctggacccttggagcagtgttgtgtgaacttgcctagaactctgccttctccgttgtcaataaagcctccccctcatgacctaaactctgggcttttcttgctggggaggcagcaagcatgctggtgggaagggaggcagggactggcagctgccacccccttcaagaggcgccatagaccctagcggggagggcaggggagggacggaaggctggcacctcttccaccagttcagggggactttcccctctcctgtctcaggtggcccagccctgtcagcctgtctggccaactcagcctttgggcactcaccaggctttgcagccctgggctctgtctctactcccagggacctgctggaaggctggagtgcccagggagaggtatagaggtgtcataggcattagtgtagtaattggagcactaactctcgagccaactgcctgggttcgaatcctggctctagctgtatgacttttgtcaagtaacttagcctctctgtgtctcagttgcctcttctataacatggatgctaatagtacctacctcatagaattgttttggaagtaaatgaaaaatatgtaaaatgctgaagtgcctggtctacagtaagtgctcaataaatgttaactattgtgattgctgctgaatcagctacatgctgaggaaacggccaaacaagtgttaaagagagacggtgcttttattttgcccttggtcatgtttctttgccaggtctttctttccacacggtgtcccctcctagctgagaccacgattttaggggctgtggcaatgcctgtgacctggtccccttgtctccatctcacccactgtagtccatctgccacgcagcctccagggtggtcttagaagcgtgggtcaccccccacccccatcatgaaataccttcggtagttccccatcacctctgggtcaaggctagcttcttagcagccatttcaggctgtgactgcctctccggccttatggcccactgttttcttgccaggagtct

SEQ ID NO: 11823 - DNA, 24496 bp, Human
ggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggctcaagcaatcctcccacctcagcctgccacgtaactgggaccacaaatgcgtgctaccatgcccagttaattcttgttttttttgagacagagttttgctcttgttgcccaggctggagggcaatggcatgatcttgatctcggctcactgcaacctccgcctcccaggttcaagtgattctcctgcctcagtctcccaagtagctgggattacaggcatgtgccaccatgcccagctaatttttgtatttttacattttgtgtaaaattacaaattttgtgttttcaaacccgtctctacaaaacaacccatgttgcccaggctggtctcaaactcccaggcccaagtgattcaccagcctggccctcccaaagtgctgggattgcaggcttgagccactgcgcctgccctgggctttgttttcttatcagagaatgaactggtaggaattgggaaaggcatgaaagactcggggtccttccccacttgtcagaccctcttttctctccggaacacccagggatccttctcaaccaggctggatcccatccctggtactccaggggtatttacccaacgtcccaatccccacagtataggactcttcatcagatcctcctcttaggcaagctaggtccttccaggaccctagcgctgaaggtccatgggacggacaccctggattcccatggacacactacaccggctaggaaaacccggcccccttaggaaaagcacttctgctcctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgccccccaccccgattggcccggccgggtctgggggcggggcgtttgcccggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtgagtggggcctccgagctgaaacgtacaggaggcagagtgaaacccagaatacagtctagaggtgtgggtgggtctgtcctgtgggtgtctagtgaatggctgatgatatgacagtgtggtctgagtgcgtgctttgtgtcattgcgaggtctggctgtgcgcatctgagtataggactgtgtctgattgtacctgcctccgtgtctccgggatgcttgcctagactttgtctgcacttaactgtgggattggaggggcaggaggtggcagggggtgagcagtgtatgtgtggggggaggtgctggctgagagctgggactctggagtctgcctgaaattccagcctagctcttacacttcctgagtgtgtgacgttgggcaagtcacctatcctctctaagcctcagtgccttcatctggaaactggggataacatcaccccacctcccacggtggccgtctgctgtcggcaaatgctgaacaaacatcagctacttctattattattttcccggagtgtgaatgagagctgccctgtggggttgtgcaaagtggagttgtatctatgagcacaactatgtatgtgtgtgtcctgcctgggagggcctggcctcctctgcacataggcgagatcaggcctctctgagtcactcacctctagatcaagacttactctgcagcccccgacctcgggggttattgacaaggtatgtgtgtttggggtccctgtgcagacatgccccacagtgcagccgaacatgctgaacgtgcacctgctgcctcacacacatgatgacgtgggctggctcaaaaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacagggtcttgctgtcatccaggctggagtgcagtggtgcaatcctaactcactatagcctcaatctcccggattcaagcgattctcctgtctcagcccccctagtagatgagactacaagagcgcaccactacgcctggctaatttttaaattttttgtagacagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcctcggcctcccaaagtgccgggattacaggcatgagccaccgcacctggcctctatttttaacatttttatttatttattattatttttttttttttgagacagagtcttgctctgtcacccaggctggagtgcagtggcatgatctcagctcactgcaacctccgcctcccgggttcaagcgattctcctgcctcagcctcctaagaagctgggattagaggcacctgccaccacacccagctaatttttgtatttttagtagacagggtttcgtcatgttgaccaggctggtcttgacctcaggtgatctgcccgcctcaacctcccaaagtgctgggattacaggtgtgggccactgtgcctagtctatttttaacatttttattgagaattccttttttattttttttagactcactctgtcgcccaggctggagtgcagtggcacgatctcggctcactgcaacctccacctactgggtccaagcgattcttctgcctcagcctcccgagtagctgggattacaggtgcccaccaccatgctcggctaagttttatgtctttttagtagaaagggggtttcaccatattggccaggctggtctcgaactcctaaccttttgacccacagccttggcctctcaaagtgctgggattacaggcgtgagccaccgcgtccagcctttaacatttttataattaaaaaacattattttttcacagagataaggtctcaccatgtggcccaggctggtctcaaactcctgaactcaagtgatcctcctgccttggcctcccaaagtgctaggatataggtgtgagccaccatgcctggcataacacgttctccttaaaaaaatttttttttcctttctttaaaaattgatggctgggcatggtggctcacgcctataatcccagcattttgagaggccgagatgggcagatcatctgaagtcaggagttcaagaccagcatagccaaaatgacgaaaccctgtctctactaaaaatacaaaaattagtcgggtgtggtggcgcacgcctgtaatcccagctacttgggaggctaaggcaagagagtcgcttgaacctggcaggtggaggttgcagtgagccgagatcacgtcacttcactctagcttgggcagcagagtgaaactctgtctcaaaaaaaaaattgttttagattaattttttttttttttcttgagacagggtcttgctgtgtggcccaggttggtcttaaactcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccacattcaaaatctattcttggctccatcttcaaagccagccacatagcatctttctgaccctgtttctgtaatcacatccctttctctcattctcacctcttctgcctctctcttccacattttatttatttacttagagacggagtctcgctctgtcgcccaggctggagtgcagtggcgtgctctcggctcactgcaacctccgcctcctgggttcaagtgattcttctgtctcagcctcccaagtagctgggactacagtcgcgtgccaccacgcccagctaatttttgtatttttagtagacagggtttcaccatgttggccaggatggtctcgatttcttgacctcgtgatccaccccgctcggcctcccaaggtgctgggattacagatgtgagccactgtgtggcctaatttccctactttaagtttggctgatgaacaacctcaattccatctgcaaccttaattccccttttgccatgtaatctaatgtggtaataggttctggggatcaggacatggacacttttgggcagttatcattttacccaacacagatgtgttagtgttttgcactaagtggcctgtggctgtggctgtgtgcacagtcagtcactctcatcagcacagaaacttgtctcccctctcccatctcagacaccccttcccatcaatcttgtcctcactacggtgcaatctccattcccaccttccactcgctcccagcactgctatttcaccaaaacagctcttttatgtcatttatttttatttattttttctttttaaaattttatttatttatttatttattgagacaagagtcttgctttgtcacccaggctggagtgcagtggcatgatcttgcctcatggcaacctctgcctcctgggttctagtgattctcctgcctcagcctcccaagtagctgggactacaggcatgtgccaccaaccctggctaatttttgtatttttagtagaggcagggtttcactatgttggccaggctggtctcaaaactcctgacctcaggtgatccgtccgccttggcctcccaaagtgttgggattgtaatctgaggtgggcggatcacttgaagacaggagttggagaccagcctggccaacatggtgaaaccttgtctctactaaaaatactacaaattaggtgggcgtgatggcactcatctgtaagaccagctactcggcaggctgaggcaggagaatcgctggaacctgggaggcggagtttgcagccagctgagatcgtgccactgcactccagcttgggcgacagagtcagactcagtctcaaaaaaaaaaaaaaaaaaaaaagtttattgagcacctactgtgtacattgggggacacagctcgtgcaaaacaaacatccttttcctcacataggtcactttcttgttcctccaccttgctcaggtgaaagtgcacctccattcattataaaaattgtgtctaggccgggcacggtggctcatgcctgtaatcccagcactttgggaggctgaggcgggcggatcatgaggtcaggagatcgagaccatcctggctaacacggtgaaactccgtctctactaaaaaatgcaaaaaattagccgggtgtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggctggagtgcagtggtgcgatctcggctcactgcaagctccacctcccgtgttcacgccattctcctgactcagcctcccgagtagctgggactacaggcgcccaccaccacgcccggctaattttttgtatttttagtagagacggggtttcaccatgttagccaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggtgcgcggggcgagacttgggagacacgggggtggagacaggaaggggcggggccagggcctgggaaaggggacagagacaggtgtgaggcgtagccgagagccctgtggcggggctacaagggctcgtgggggcggggcttgtaggaggcggggaaagatacaggaacggggcggggctttggaggggggaaggaggcggggcgtgggcaagaggaggcggagacagctatggggtatagtcaagggcagcagggtggggctagaaggggttttggggcgactcttgagggaggcgggacagagaccggaacggggcggggcctgaggagaggggaggagtcaggcctggcgtcctgaacccaccggtccctttgcgctcttccgcaggttcttctgagcaacgcgctggcgcggctcagaggcttcaaagatcacttcaccttttgccaacagctaaacatcagcatctgcccgctcagccagacggcggcgcgcgtgagccgggacgggaggggtggatctagggcagatgggctttagagggggtagttggaaaatgtttttggaggactatacaggagtgaaattacgtgggctgcgaagctgggtcagcagagagaacaacgcatctcgagggggcttggccttaagtgccgtgaccacactaggaccagccaggggtgtttctgtgcaaagtgggtgggtttggagaaggcctgctgtgacccatgccctctctgacccccgcctccccagttccaggtcatcgtttataatcccctggggcggaaggtgaattggatggtacggctgccggtcagcgaaggcgttttcgttgtgaaggaccccaatggcaggacagtgcccagcgatgtgagcccaaacaacgaatattcccccgctgggactcctcccccagtgggcatttcctcatcgcccccatggatatcgcctgcttccatgaatacctcccactcatgcatatctcttcccccctcttgtatcttctccctctgccccttaatatcagtctccccttgggaacatatgcctcctgtgagtggtcctcccttttttttttttttttgagacggagtctcgctctgtcacccaggctggagtgcagtggcgcgatcttggctcacttcaaactccgcctgctggattataggcatgagccaccgtgcctggctggtcctccattttaataccccgcttccccaggaaaatttattgctgtttatggacatctccttcattccagaaaacgtcctcccccaaacctcttcctcccccgagaacctgcctcaagggtttcttcccctacttcctccttcactcccccgactccatggtctctccaccctcccggtgggtttttttttccacctggtgaatcttctctgcaatcatttccttggaatctgactgtccccccaccacacacacctccatttcctttccccatctcaggactcttttccttccttgagttttttgtctccatgcatgtatagctttccatgggtactcttgactcagtttccctcctcctttatccgaggtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgaggtgagaccccatttcaatcccctttcctgctcctgtgacaaatttgaagtgtcatggtgagctgtgtggactctgggtcagcaggtccctaggcttatgacctcctgtcacaactcccctcattgtgtgtccttgagcaagtgacctttgtctgagcctcagtgtcctttcctgggactgttatgaggacccagtgtgatcatgggtgacacttgacagacatgtcagagttggtggcaggtggtggttcgcaattttggcagggacgtttcagggaaggtgttcccgataaaggtgacatttaagatatgacctgagggagggagccgtgtggctatttgaaggaagagagatccaggtggggagagaataacaggcataaaagccttcgagcaggagagtgtgcagaattccaggagccacaaggagctcagtgtggctgaagcagggtgaacgggtgacaggtcagaccttgagggccttgaggaccaacaggaagactttggcttttgccagtcattgttgctcatgtgtctactcctagctctttgggaggctgaagcgggaggatcacttgagcccaggagttgtcccagctaattgggaggcccagatgggaggtttgtttgagctggggagttcgaggttgcagtgagtaatgattgtcccactgtactccatcctggcaacagagtgaaaccctgtctgaaaagaataataataaaataggccaggcatcgtggattatacctgtaattctagcaccacgggaggctgaggtgggtggatctactgagctcaggagtttgagaccagcttgggcaacatggtgaaacccagtctctacaaaaaattagctgggggtggtggtacacgtctgtaatcccagctacttgggggctgaggaaggaggattgcttgagcccaggtggcagaggttgcagtgagccgagatcatgccactgcactccagcctgggtgacaaagtgagaccctgtctcaataaaataaaataaaagaagttctgcagtaggactgttcatgttaggaagaaaacatctttttcatatttttattaaaataaaataaaagaagttaaaacgttcccacaggcccctaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcgggaggctgaggcaggagaatggcgtgaacccggaaggcggagcttgcagtgacctgagatggcgccactgcattccagcctgggcaacagagtgagactccgtctcaaaaaaaaaaaaaagaaaaaaaaagaaaaaaagaaaaggctggggtgggcacgttggctcatgcctgtaatcccaggactttgggaggctgaggctggcaggtcacctgaggtcaggagtttgagaccagcctggccaacacagtgaaacctcgtctgtaccaaaaatacaaaaattaactgggcgtggtggtacacacttgtagtcctagctactcgggagggagaggcaggagaatcacttgaacccaggaggtggaggttgcagtgagccgagatcatgccactgcactccagcctgggggacagagcaagactctgtctcaaaagcaaacaaaaaaaaaatcaggttgaatggctgggtgtggtggactgcttgagcccaggagttggacactagccccaggcaacatagtgggacccccatctctagaaaacaaatttaaatttttttttttttaatttagtagagatggagtttcactatgttggccaggctggtatcaaactcctcacctcaggttatccacccaacttggtctcccaaagttctgggattacaggtgtgagccaccacgctcggccctaaaaaaattttaaattgagaaaaaaaggggccaggcgtgttggctcatgcctgtaatcccagcactttgggaggctgaggggggggtggatcatgaggtcaggagttcgagaccagcatggccaatattgtgaaaccctgtctctaataaaaatacaaaaattagccaggtgtggtggcatgtgcctgtagtcccagctattcaggaggctgagtcaggagaattgcttgaacccgggaggcggaggttgcagtgagccaagatcacgccactttctgcactccagcctgggcgatagagcgagactcagtctcaaaaaaaaaaaaaaaacaaaaaacccaggccaggtgcagtggctcacgcctgtaatcccagccctttgggaggccaaggcgggtggattacctgaggtcaggagttggagaccagcctgaccaacatggcgaaaccccgtctctactaaaaatacaaaaattagccaggcatggtggcatgtgcctgtaatcccagctacccaggaggctgaggcaggagaattgctggaacccaggggcagaggctgtagtgagcagagattgcgcccctgcactccagcctgggcgacacagcaagtttctgtctcaaaaaaaaaaaataaaaatccggctgggcacagtggcttatgtctgtaatcctagtactttgggaggccaaggtgagcagatcacttgagttcaggggtttgagaccagcctggccaacatggtgaaaccctgtctctactaaaaatatgaaaattagccaggcggggtggtgggcacctgtaatcccagctacttggatagctgaggcacgagaatcacttgaacccgggaggtggggggtgcagtgagccaagattgcaccactgtactctagcctgggctacagagtgagactcagtctcaaaaaaaaaaaaagaaaaaagaaaaattaaaaaaagaaaacacacacacatacacacacaaacccatctgtggacccttttctgcccagcacatccgggcaacgtttgatcctgacacagggctgttgatggagattatgaacatgaatcagcaactcctgctgcctgttcgccagaccttcttctggtaagggaagatcaccaggcctgagggtggggtggtggtgctcggcatggagctagggccccttacctgactctcacctgccccaactccaggtacaacgccagtataggtgacaacgaaagtgaccaggcctcaggtgcctacatcttcagacccaaccaacagaaaccgctgcctgtgagccgctgggctcagatccacctggtgaaggtcagggactaggaatgatgagtgggcagttgggaatggggaagttatggagcccaagagggtggtgggccatgtgtagagtgagggtaggggaggatttacttttccttcagatcagtgggctaagacccacagatcagcgggggaaatatttgagggtccttccatagaattgatattcatagctggtcgtatgagagtctccccataggacacatcatacaaagccattcacatctgctgtggacgtttacatacttagttttggaaattgggggtggggcattcccacttggcccatgaatcaggagagccaaatatcactgcttgaagaattcaccaaagtctgtagtaagaggagcttctatctggagtgaatatttgagagtccacccttggattgattgggtttgggtgagtctcagggtgaatgcctatgggtgcatctggctaggaacagtggtttcccagggcctctcattgatgtttgactttcatagatgacaaaactcacatttgtccacattcaagagcctcgcgtttcatgtgagtccctttgagatgaatgtctgcatatctgtatatagttttgcctgttctaacagagttacccaaattaactgtgactagaataagatagaagattattttcttctaacaaaaagtctggctgttagtccagagaaagtggggtggttccataatcacccaggacctcctcttctatcttgttgctctgccttccccaatattcagtttccacctcatggtccaagatagctgctgaagctccagccgccacatttgtgtttgagtcagtagcagagggacaggggcaaggaacattgttgacaccacttggatcactttctatggggcaaactggtcactcagctactgatagcctcagggaagactggacaatatagtctttatcccaggtagccatgtgccaagctagaatcctattctatggggcaatggtgaacaggaggcgtttatgccacgctcaagagtgatgtggtaagccagatgcagtggctcatgcctgtaatcacagcactttgggagactgaagcaggaggatcgctgagcataggagttcaagaccaggtgggagcatttgctgattaggtgcctacatagtgatgccctgtctcaaaaaaaaaaaaaaaaaaagaggccgggtgcagtggctcacgcctgtaatcccagcactttgcgaggcagaggcaggcagatcatctgaggtcaggagttcaagacaagtctggccaacatggatagaaaccccgtctctactaaaaatacaaaaattagccaggggtggtggcaggtacctgcaatccctctactcgggaggctgaggcaggagaattgcttgaacccaggaggcggaggttgcagtgaggcaagattgtgccactgcactccatcctgggcaacaagagcaaaactctgtctcaaaaaaaaaaaaagaaaaaagaattatgtgggccaggcgcggtggctcacgcctgtaatcccagcactttgggaggccgaggcgggctgatcacgaggtcaggagatcgagaccatccttgctaacacggtgaaaccccatctctactaaaaatacaaaaaattagccgggtgtggtggcgggtgcctgtagtcccagctactcgggaggctgaggcaggagaatggtgtgaacccgggaggcggagcttgcagtgagccgagatcgcgccactgcactcccgcctgggcaaaagagcgagactccgtctcaaaaaaaaaaaaaaaaaagaattatgtggcggtgactgaaggttgaccttgatgtaggccttaatggggtttatggccagggttgggggacatttgtaggactcacctctgctcaggtacagactgacatccacctcacccgtgtgcccgcagacacccttggtgcaggaggtgcaccagaacttctcagcttggtgttcccaggtggttcgcctgtacccaggacagcggcacctggagctagagtggtcggtggggccgatacctgtggggtgagtggcacaggctgggagaggggtgtggaagcaagggcagaggggtttatccaaggctcacaaccttgccatcccattgggtacagcgacacctgggggaaggaggtcatcagccgttttgacacaccgctggagacaaagggacgcttctacacagacagcaatggccgggagatcctggagaggaggtggggggtgactgagagcactgagggggtggtctgtggtgtgttggggcccaggggtggtgagggaaatttgctgattacatgagtgtgggagacagaggacgaagggagagtgaagggcgggggagccaggcagggtgcagtggctcacgcctgtaatcccagcactttgggaagccgaggcgggcagatcacaaggtcaggagatcgagactgtcctggctaacatggtgaaaccccgtctctactaaaaatacaaaaaaatcagccgggtgtggtggcgggcacctgtagtcccagctactcgggaggctgaggcaggagaatggcgtgaagccgggaggcggagcttgcagtgagccgagatcgcgccactgcactccagcctgggtgacagagcgagactccatctcaaaaaaaaaaaaaaaaaaaaagagtgggggagccagatcccaagcctgatcagctcacccccaaccccaggcgggattatcgacccacctggaaactgaaccagacggagcccgtggcaggaaactactatccagtcaacacccggatttacatcacggtagctctcccccatcctgcacctccccacctcgatagaaagggaatcaccccttatctgcagcatctcaaagctgcctggggttggggttgactgccctctactttcacccttcaactcccaggatggaaacatgcagctgactgtgctgactgaccgctcccaggggggcagcagcctgagagatggctcgctggagctcatggtgagtgggtcagagccccatccgagccagggtcctcccaacctggacccctgctggaccttgaaggctgtttctggcccagttctctgctttcaggccccactaagctgaggactccgtttctttcttttcttctctttgagacggagttttgctcttgttgtccaagctggagtgcaatagtactatctcagctcactgcaacctctgcctcctgggttcaagtgattgtcctgcctcagccttccgagtagctgggcttacaggcacacaccatcacgcccggctaattttggtatttttagtagagatggggtttcaccatgttggccaggctggtctcgaactccttacctcaggtgatccactcacctcggcctcccaaagtgctgggattacaggcgtgaaccaccgctcccggccaaggactccatttctgtgtgtggcttttcctctccgtttttctccatctcctgcccaggctccctccacgctctggcgtgccatatccaggcccccctgttaggcatttacctccttccggcctggttcccatgcctacttggatcctgcctctgctggggttgccctaccagaccctcaccttcatcctcatccgttcctcccaccctttaatttcttttgacattcccacacgcccttacccagtttctggcccaaggacacccacaaacccacgactctcaccccctcctggccactctccccccaggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcaggtgaggggcagcggggtaggcagagaggaccggattgaagtctaccagggagccgggtttgggtgcggagtttcctaggctcagcggggatccatttggccataattagccccaaaccctcgggccaaccccatcccctgggcagtccccgcccagtgccagcccagtcccaacccccctggactgtgtagaggcacagccctagctcatgcccctaaaccaccaactcacctccggccccgcccatttcactttagccccgccctctcaccgcccccaggctctgtcctgcctcacccagccccgcggcttcagccccgccgtaactcccaaagtctcaggtcacatcagttctgctccatcgggactcgaaccctaagcttgggaccgacccatctccccattggctcagtcctccctgtcacggccctggccgctcctctcggctgagccttgcccctctccggcgaaaccccgcccctacaacctagccctgcctcctgacctggctcggccccgcccttctccatccaggccccgcccctctccaactcagccccgccctctctcccgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggtgagaagggcaaaattgagaaggagatcggagagaggcaagagagagggagagaagagaaacctggctttgccccaactcatctgggcccatccccttccccgcaggacctgttctccaccttcaccatcacccgcctgcaggagaccacgctggtggccaaccagctccgcgaggcagcctccaggctcaagtggacaacaaacacaggtggggccctggtcaggggtagggaaggggtggagtcttacctggggccggcaggtgggggcaatgtgtgaggcatgggatgttggccaggacccaaaaaggtcatgagggtatggggcagagtccagacccaggttaggggcttaaaggatctgaaatgggtgcggcaaaccaggaatgggtcttgaggtttgtgggtgctgtttagtcccaagaacaagatttgaaaatccccatccatgtctagttctgggagggtgttcatcacccctggggtcagattgagggtacgaggacagtggccagattgagggtatgaggacattggacctgggggtggtattcggggccggggaagcaggttaagagtctgggattgaggccctggagacagattcggggatatgcagctgtgtctagacccaggggaggaagcatcgtggggtgagtcagaggaagtctgcacctcctcactcctccttccccctgcacctctccaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagtgtgggttttttttgtctgttatttgcttgttagagggggacagaatttatgacccagagccgggtgtggtggcttgctcctgtaatcctaacaactctggaggctgaggagagagaatcacttgagcccaggagatctagactagcctgggccacaaaatgaggccctgtatgtacaaaaaatttaaaaaattagctgggtgaagtgtctgtattcccaactacttgggagaattgcttgagcacaggaggtcaaggctgcagtaagtgataatcacaccactgcactccagcctgggcaagagagccagatcctatctcttcgtgtgtgtgtgtgtgtgtgtgagggacagagtctccctctgtcgcctaggctggagtgcagtggcgcaatcttggctcactgcaacctccgccttccgggttctagcgattctcttgcctcagccttccgagtagctgggactacaggcgccccccaccatgcctggctcatttttgtatttttagtagagatggggtttcaccatgttggccaggctggcctcaaactcctgacctcaagtgatccacctgccttggcctcccaaagtgctgggattacaggcatgagccactgcaaccagtctggatcctatctcttgaaaaaaaaattaaaaattagaaaattatccagataggatggcgtgcatttataatccccagctactacttgggaggctgaggtgggaggattgcttgagcccaaaagtttgaggctgcagtgaaccatgatggctccactgtactccagcctgggtgacagagtgagaccctgtctctagaaaaaaaaaaaaaaagtaggcagtgcgtggtggctcacacctgtaatcccagcactttgggaggctgagtcacatggatcacaaggtcaagggattgagaccatcctggccaacatggtgaaaccccttctctactaaaaatacaaaaattagctgggcatggtggcacacacctgtagtcccagctactcaggaggctgaggcaggagaatcacttgaacccaggaggcggaggttgcagtgaggcgagattgtgtcactgcactccagcctggtgacagagtgagactccatctcaaaaaaataaataaatacaaataaaaagtttttaagtgttctggggtcagtttgcaagcaccaacagcatatgtttcttaggccccctctgatgacaaggactggcccagggtggacagggaagcccagggagggtggtatcatgttggtcctctaatgtttcctctgagaacccctccaatgggccagttagcatgggccacctagggatgccagggtggggtgccaggggacactctgctgtggtcccacttggggcatggtcaccagatgtgctctttttcttttttttttttttgagatggagtctcgctctgtcgcccaggctggaatgcagtggtgcgatctcggctcactgcaagctctgcctcccaggttcacgccattctcctgcctcagcctcccgagtagctgggactacaggcgcctgctaccatgcccggctagttttttgtatttttagtagagatggggtttcaccgtgtaaggcggaatggtcttgatctcctgaccccgtgatctgcctgtctcagccttccaaagtgctgggattacaggcgtgagccaccgcgcccagcccagatgtgttctttttcaagtttccttcttgacggagggctgggccagcttgtgaggcctgaaaagggctccctgcacctgtctgccgtattggacctgttactggaggtatcacccccaccaaaaatatttctaagtccctctcctatggtagtgactggcctgggctgagtaaggaggactgtggagtactcttcaggctcagccctggtcccacatgcgtccctgttttaacatgtgactcctccgcagaaaacttttataagtccctctccag

SEQ ID NO: 11824 - DNA, 126200 bp, Human
  misc_feature (1)...(126200): n = A,T,C or G
cagggtgcgtggggggattatatcactgttggctgatctcctccctgctcttcagagcttgtctaactcatttgttatcttcacccatttgaggggtgagtgatgaggattgaggggagaatgttaaaggcaaatcatcacattcttgggcttcagaacatcttctaacaaagattaatgttctgaagcctttgcatcgtgttttagcatttggtttcaaattacctagaggaagcatcagtcacatttggagaagggaaagaaaaggagaaagatgaagatgattttcacaaactagaaacccataggacttccgggggcatgaagaggctccaagtctcaggagcaggtcattgaagatgtgttattttatcattttcatgatgagatacagcctgaaagcagatcacccatgaaaacatgtcatctcccagtgttcggaatgcagtcatggtgaccttcctacagaacatctctgtctttgtggggactcttttgatgggtgcatgatgaggattgaggggagaatgcatgctggtgaacacacactgaactgtgctcatttttcacctcaacaaattggaaaaaagtgtactttattcacctcttagtgataagaaaactaggggcttggggacaggaagcaaaaggctcagagttgtagagcgagtcatcggtgggcctgggagctgcacccaacccaatcctcggaagattaacagcccctttttcacagggtatttaactgtgaaagtaagagggaggaaaatgcaagtgtcacaagtctggatttagttggtttattctttctccctgtataatttttcccctcttcttcctaactcattcggccagaggctggactgcatgtggaccccgatgacatggcactttgtttctgaccagtcaggacacacaagaggcccggcgcaaacacaacaaagcccgcagacattctgtccccacgaagaacggacgccactcgacttcctagcatcttgacgggctatccaagcgcggagtcagtttataaggtgggtaaccaagtccctggaaggcaattaaggcgcccatttcagaagagttacagccgtgaaaattactcagcagtgcagttggctgagaagaggaaaaaaggtcaggttgtaaagctttttatttttccattttctaagagaaattcatcattggaacttgtaaagtggcccaagagtggctgtaatttgggccattatagcaggtatgggtggcgtctctcagcaaagctgactgactgactgatgagtgctgtttgcaatgacctccgctggaacatgtgagtcctgtagggtcgattcctagatcaccgtctactgagacacattcctgtcagcatggactcactggtgctatcctgcttaacaaaattagtggctcaaaaatagccacagaaagcctaagagaagaaaacaaggatttgaaagtagaaatgatgaattttgaatcttctgttttgtcttaacaactagaattctaaaatcattttatggacataagaatgctttaagaaattcaataggcatttaggggttttatttatcacttttataaagactaaatttctaatagtactcactttttgccacatagatgcattaggggaaacagatttttttcattcccaataattattcccagtactgttacactatttgacattaccaaaaatttaaataggttattactgagatatattggcaactggagctgccaacataaaaactctgtttttgaataatgggggcctgggaggcctgctcagcgctgcagtttctgtaacctcctgacatggacggcgactctggtctcgcagaccccaggcctgtgagggtcgctcactgcggtagaggctgcgtggagtcagtggagggagcccctcagcagggagacaaggacacagcggttcccatggccttgtcagtgcttgattacatactctgtctccttccgttaattttagaatgagagcgctcgctgtgctgtctgtcacgctggttatggcctgcacagaagccttcttccccttcatctcgagagggaaagaactcctttggggtaagtagcaaacacattgcggtcttctggccttataaagttatttttcacacttactaaaatagagggcataatggtagctcctgagagtcactttaggcccctgtagtgtatgctttgttatgcttaagaaaaaaaaattgtaattcttgattttagaaggattgaaatatgtacatttctttctttaaaaaagagctgattttccttggatgacacaatagacaattttcacttttacctattcatataactgaaaaaaaaattctttgggagtgtttttcttcctttgctacagaattattttttattaaataacttctgtgatgtattttctggaatcagtgtgctactatgtgaaaacaagttaagaaagctactgagatgcagtggttaaaataatcacagatcaagctctttgcttttcttttaataaaataaataaagttccaaaccctgagaacaagtttcactggagtgaatactgcaggggcatttgcctggacattttaccccatggacaccgctggccccgggagcaggtgacacctcgctgggcaggtccctgggcctctgcacacagtcccggggcccctggagcaggtgacacctcgccgggcaggtccctgggcctctggacacagtcccagggcccctggagcaggtgacacctcgccgggcaggtccctgggcctctgcacacagtcccggggcccctggagcaggtgacacctcaccgggcaggtccctgggcctctggacacagtcccggggcccctggagcaggtgacacctcactgggcaggtccctgggcctctgcacacagtcccggggcccctggagcaggtgacacttcgccgggcaggtccctgggcctctggacacagtctcggggcccctggagcaggtgacagctcaccgggcaggtccctgggcctctgcacacagtcccggggcccctggagcaggtgacacctcgctgggcaggtccctgggcctctgcacatagtcccggggcccctggagcaggtgacaccttgccgggcaggtccctgggtctctggacacagtcttggggcccctggagcaggtgacacctcactgggcaggtccctgggcctctgcacatagtcccggagcccctggagcaggtgacaccttgccgggcaggtccctgggtctctggacacagtcttggggccatggcacagcactggcacctctgccctcaccagcctttcccaggactggaggccttgtctgtcgttcagggtcacagaatctggagtcctcgctgttcccagccacacccagcccagcctcctgctgggggccacattttaccccaatttttctgcatctcaggacttcacaaccatattaggagtggcagtgaagtccataacagactcgtaggctccttaaaaaaactctccctccacagcccccaggacttcctggtcactgcccgctctgagatcagggaagccgtggggcctctccctgccagcttccatccatgccccaaggatgggctactcacccctaattcctgtccctcccctgcaaatggagaacactggaaaattactcatcgcagtcattatttgtgagcaagaatgagatacttcatttaaagcggtgaatgcagtacctcggcaatcaccaaaaaacaaaaaataaaaatggagtcacaatataaagaacctcaggaaaaagtgattttgcatcttcccagaataaatcagtcactctatcacctggaacatgctagatgttcagccaatggtttgtaaattaattactttgttattttatttcatatttagtaggacctggttgtataaaaccagagtaaaacatgttagaagtcaagagctagttctgagcaagttgtgatacatgagagctattcaacaaaatatttaaaactttgtaacatgttttttaattttaaaaatcacatttaaaaagccatcaggaatgcagtagccacagcttttgctaaaacagtttttaaaaattatttttccatatctgggagatttgaccttttcgttttgcttaaacttttggttgacacatcacgagtgcacaggacagcagctgacaactgccccgcgtgctgggcacatgcttctgcctgctccaatatttcaaagctgacttattgtttgcttgaaatgtgaatgagttactgaaaaaatattatgtgtctcacagtatttctattttacagcctttaatagttgttttgcagctttaaatctgtttggaaaatgatgcccaatgactgtgtgtgggtttatgtcacctgtgctcacagacatgtgaagcaaaaaccttggcctgctccccagcctctgtgcaggacaagccaaagagcaggcagcggcagggccaagaggatccaggctccccctggaccacacacggtcaccgtaagcacatggtgctccggggggtcctgcttggtgggtggctcacccttatgtgtcaggcacccattttatagatcaaaacgtagaggtctggaagtctcagaagcagcaaggctgtggccgctcagtctcacagtctcacgtcccaggtctttacagagaaccaacacacatcctcatacttgaagctcgatgataagtactcagcgaaaagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcatcaggccagtgccgtgactcacatctgcaatcccaacacagtatcaggccagtgccgtgactcacatctgcaatcccaacacagtatcaggccagtgccgtgactcacatctgcaatcccaacacagtatcatcaggccagtgccgtgactcacatctgcaatcccaacacagtattaggccagtgccgtgactcacatctgcaatcccaacacagtatcaggccagtgccatgactcacatctgcaatcccaacactttgggaggccaaggcgggaagatcacttgaggctaggagttcaagaccagcctgaccaacatggcaaaaccccatctctactaaaaatacaaaaaaaaattagctgggcgtggtggtgcccacctgtcatcccagctactcgggaggctgaggcacgagaatcagttgaacccaggaggtggaggttgcagagtcgagatcacaccactgcactccagtctaggtgacagagtgagaatccatctcaaaaaaaaaaaaaagagagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgccctgaacagaatgttcttcaccagaaccctgtgtattcatcaccacacaggctgagaggcattccagcatttgtgcaacatcaagatttatgtgcaattatctttatggcaaatgttccacaagttatagctgttaaaagaaaataagatgcaaatgaacaagaagaagcagaggcgctgcctgcagcctgggaaaatttgggaagctagcctaatgagtgaatttgttttaaaaggaaagttggcaaaccttattccagttcattaaatttcaacaaacagcaaggattaaagtaagaatcaacacacaactctaaacaggaatcaagcgcttagaattaggagcaaagctctggccctgggggcttatggttttggagaagaaagattttggctttcatatatatatttaacataaacagcctttggaacaaggcaacttccttcttctttctgaaatgtggtatgttcttgcctaatgtgtccctgaatcccacctcttttatgaacaatatgaatatgcataaaggagaatttgggggaaccgtgccatgcgcccctcagagcaggagcaatcttgagaaggcgcaggcagagagcagcgggcggcttctccagagcaagtaattaagtcccgtgactccctagaactcagtgttcagttctgaaaaaaaacttcgggttcaaactccctaagtctatggtccttgcatcagacgcctcttccctgggattgctgggaactgaggaaggaagggcgctgcagagctaacgatagcaaggggctcagagctggccaccccagctccctggtggcaggagagctaatgtgagctgatggaaactgagaagcagcagataaaggaaaagccatctgccctgcctctattgcctaaaagtagaacataaatccacaaaagtgaccatttccctctccaacagaaaggacagaaattcatcaccagggaccccaggccctcaacagcctggaaccagccccagaggcatttgtgtggcaaacctctgcagccccggcctcccttcctgtagttgccccagagaggcctcctcaaaacgtgtttcctgggaactcaaagtcctttgctttggtcttgcagcttcttggaaaacgattgttcttttgctgaggggctgtgcagcagagttctaacgatccattcgagtttccatcttggggcgctcagggggctccctcgtggaagcaggagtccaggctaataacccctgtgagttttcctcctgtgactctgccttttgtcagtctaatttcaatgccccagaaaattaatctaagatgcagggagagaaaaggtttcttcttcccctacagatggatgtcagtcatctctattcagccaagaagtagttaacctaaacaatgaaaacaccaccggttccagtagagacttgagactatctgatgagagttatgtgtctctgggaggaagttttcaatacagaaatggatttattttatgaaacttaaaagactaataatctgcaagcctataagaatgttttaattctgtaaaatattttacaataagaaaagaaactagagactaagcaacatatgatcagttaaacttgaataacaatatattaatattggtcaataacaaggaatgatctctctagtaactgccgtttccaagcatagtagagaaggataagcatgtttctttatatttaatcagttggttcttaaataattgtcaagtgcctgctgaaaaccagcctttggtcttggtcgtgaatagcgcagaactttgcagagccctgaagagactctcagtgataggatgcatatacacaggtggtgtgagtgacagagctaattttttttctggtacctaaagatcagcaggatcaaaatttcataaaggaagagctgggagcttgagattgacaatttcatgagatgaaggataaattgtgcgttacctccacagctctgcaacatggagattggtcttgggcaggtggtggacgtcctggattctgaggaagacctgcacgcaattcagtgggcatcaggagccttcagatgctttcatcaaaggcacaggcacaagcaggccttggtttagaaaggtcacttgggtgacagcaggagggacagaaggatggtggggagatcagtgcaggagccagtcaagagctccttctactaaggcagtagaaagtgagactgacaacggccaggcaggagcagaacgttctcccagagacattatggggaaattcacaccacatggtgagtgaaaggcaaggaaagccacggctgggcttcttgcttggggacttgagctggtagggtggttatttcaggctgttaacacccctcaacagggaacagaggaggatggcgtgactcaggagagaagttcaagtggaaaacgggcgtttgggagaggaccaaaggagggtgagaggagagggcaaagatcagaggagccagaaatgcacccgaggtgacactcacaggagggagaccatggagagaagagagccacagtgaccgaggctgagagagagagtggccagagactgaaagcaaaaggcacgacggccgggagcactgaacgcttgccaggccctggaccaaaagccgtgcaaacctctctgtaaaaccatcctaagacgtaactctgtgcacttgccaggccctcagcccagagccgtgcaaacttctctcttcagagcacacttgcgaggccctcggccaagagctgtgcaaacttctctctaaaaccatcctaagatgtaactctgcagctaggagagaaaaccgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcggtcgtgactgaccacagaatacaaaatgtgagttgagttgcctgggcagttgcagtgggtttagaaggaaataagaggaaaataaaggaaaattccaggtgtcttatatctcaagcttttgtgggaacaggaggttccctgattcttgagagctgaaagaaatctccataaagcccggaatgctggtccttgaggtccacacctgccaccgatcctgcgacgcccaggccgcccctcccctctcggctcctactcactcttggtggcatcgtcccacattgcactgtccccagcacgcacacattggcgtaaagccaggtcccctcttcagattccacacccagagcctgcagctctgacggctgtgctgggggtccccggcgagctgtgagcccgtgctaggtgttcctccctccctcctgcccttgccccagggagccccacaccggggggctctgttcattgctctctgcccaaccctgaggggtcaccctctgccccaagtgcttaaccactggttactcatcccagaacccaagagagatccagcacggaggttttcttaactttgctgtatcacactgtaagaaactgggtggccaatggaacagacggagcagggcagagtgagcaggaagaaatgatgctggggaatttgtgtgctccttgggtggggacgagcatggaaggcgcgtgggactgaagccttgaagaccccgcaggcgcctctcctggacagacctcgtgcaggcgcctctcctggaccgacctcgtgcaggcgccgcgctggaccgacctcgtgcaggcgccgcgctgggccatggggagagcgagagcctggtgtgcccctcagggacttctatttgcttttaggagccaattcattcctttggtgaagtattgatgctacgcaggtgaatttagtaacaggactgacgtgtgaacatggccggaaacacttgccgtcttcctgttaccgcgtccggaacttcacggtgatacccagaaatgggatcttaacctcttacacattccaggtgctaaaacaaataacacaggagtgctttcattggaaactactggtatagtggaattattttatcttttattaaatacacaagataggcaaatcttatcaactttaccactggctcaggtaaccagtgatgaatgttcagaacaaaagttattcggaatcatttgaagtggtttgggcaagtgcgaaattaaggtgagtagctctgatcccatcctccaggcagctccgtgcagtgggggtggacgcccctctgtagcggggaagtgaaggcctgtggagggaagcgaccccgggacctggctgcctgcctgtcccggaagccacgtgggcatcaccgcagcaagatgggcttgaggaacaaagcaacactgtcagtgaatcgctgaactgtcattgcgctttgactgtgtgacattctgttccgtaggaaagcctgaggagtctcgtgtctctagcgtcttggaggaaagcaagcgcctggtggacaccgccatgtacgccacgatgcagaggtgagccttgcggaggggccgccgccccaaatgccaccgacaggcgcatcctccctgacatccacacacgtgtggcctgattttcgcaattgcagatgaaaacctgaagcttgccattgttaatttacttccccagtgtcatgtgcaagcagcagacagaactggtatttaatctccaatcctttcttaagcaagacacaaaggaggagcaccctgatgcaattagcaattacgtataccctggttaaaagacagtagaggctgacgtcctgatagcaaaaccagcctctcttctccaggattaggacagattaaggaggaaaagagagacctagatcccagatctttggtgttgtgatataactgtaacattacctgtggcatagaataaagaattaaatggggctctcccccatttttgaaataattagcatttgtaattatataacagacaccactattaagaatattgtggtctcatattacctgtctagaaaaagaaaagaaaaacaaaaaacaaaaaacctgtaaagcagtttgccctcccaagcttattattttgtaggaagttgactaataattatataagttcttgagatacaaaatatcaaaagacagcagttaatttattccaaatttctattattccagccagaaaaataccttactgttcatattggctgcaaacaaattattatttattttctaaaaattgaatcaaagggaaaagaaagagaaacactatttctcataaactcacgcacactttaatatgtctaaaatgggcaggaattcctggggaagacatggcagtgggggtggataccaagtgcgtagtaagaagtgtgtgctgctctcttagtaacaatttgtgaacccaagtatctaagacagatctcagtcaatttagaacgtttattttaacaaggataaggatgcacctgtgacgcagtgtcaggaggtcctgaggacatgtgcccaagatggctggggcacagcttgcttttacacatcttagagagacataagacatcaatcaatacgtgtcagatttacatggtggggagcttccaggtcataagtagatgtaacagttttctgactgacaatcagctgaaggaattattatcagtaggacggaatgtctgggttatgttaaggggttgtggacaccaaggttttatgagcttcacagagaagagatggtgaatgtttcttatcagacttaaggtctgtgttgatgttgatgctggaggggtagaaggaggtgtgtctgacccaccaccttccatcgtgacctgacccagcttttcaggctaactttggaatgctcttggccgagaggtgggatccactcaggtggttaggcgaggacattagaattttatttttggtttacaaattgcatgttaacagaacccttttgaaatcaatgccttgatcctaaggatgcattagagtgagggaagaccaggagaggcatcaactggggagactattggaaagatttgccttttgatagctctcaaaaaaatacactatactatacacctattccaactatgtttctttccttaagaaatactgtttctactgtggaacagtcattgttctagatgccgggatacagagatgagttcgatcatttcatatcctcagaagtccgtgctccttctgtaaagtcattgttctagatgccgggatacagagatgcgttagatcatttcatatcctcagaagtctatgctccttctgtaaagtcatttttctagatgttgggatacagagatgagtttgatcatttcatatcctcagaagtccatgctccctctataaagtcattgttctagatgccgggatacagagatgagtttgatcatttcatatcctcagaagtccgtgccccttctgtaaagtcattgttctggatgctgggatacagagatgagtttgattatttcatatcctcaaaagtctgagctccttctatgcagtcattgttctagatgccgggatacagagatgagttagattatttcatattctcagaagtccatgctccttctgtaaagtcatgttctagatgccaggatacagagatgagttcgatcatttcatattctcagaagtctatgctcctcctgtaaactcattgttctagatgccgggatacagagatgagttagatcatttcatattctcagaagtccatgcccgttctgtgcagtcatttttctagatgtcgggatacagagatgcgttagatcatttcatattctcagaagtccgtgccccttctgtaaagtcattgttctagataccgggatacagagatgcgttagatcatttcatatcctcagaagtccgtactccttctgtaaagtcatcgttctagatgccgggatacagagatgagtttgatcatttcatatcctcaaaagtctgagctccttctatgcagtcattgttctagatgccaggatacagagatgcattagatcatttcatatcctcagaagtctatgctccttctgtaaagtcattgttctagatgctgggatacagagatgagttatatcattttctatcctcagaagtctgtactccttctgtaaagtcattgttctagatgccgggatacagagatgcgttagatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtctatgctccttctgtaaagtcgttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatcatcaggaaacatgatggtttgttggttggagaactgacttactttgagtaaaagttttaataataataaaatacttttatccttcaaaacacatctagttactttagagccgaaaaggaaaaaaaataacttttctaaataataatatccaaaactagagtgtgcctaaatcatttcttccactcactcatggacagtggtatggccctaggcttttggaaagtgataggaaagcacagagcctgcctacggaagtgtttacgaaaagggagagtctgagaccaccctaccccctcattcatcacttcacttacctggatagcatggggccagggacaaagggactttgctcccaaggtagatggggccagagttttagtgtttacgctcattccctgagaccagctcccatagagcaatggaaaggagaccagggcaggctgcacacagaaggggccacatctggggaggggggccctgtgcctggggacccagatctttatgatgtgcagtgagcttgccggcccaggctctggggaagagcatccctgtttgactggagagtgcagtgtgttctgaaggaagatatgatgtccagggaggcaggggagggttctggggcctgcggcccaggctgcatcagcaaccaggttcacctgcagcagccagaccctgtgagggaggcaggcattgtgtctgggccacctggccaggtgtggctggtagtgagtggccccatgagtgtgtgggggtgagggtgagtgtgcccttgacctggcaggcacccctcggacagggcagtgtgcttttctcccaccatggcaaagagcgggcactgcagatctgctccctccacctgccgtgagagtgggagcaactgtctccctttctccgcttcataattttataatttcggcatggacagaagaagcgtctgcatgaggaggctgtgggtccgggagaccagaggccgaggaaccaaatgctcccatcagtctcagttgctcaccccatgatctgtctgggctcacactccttgagcagtaaattcattcccttttagcattcagggaccatttccaatattcacaatttgctgtgagttccagggtgtattcagcctggaatatctgcatctagattggtgataccatttgagtctgtttactgttcacggtgaaacactctgggcattactgggatgacagacagaagagctaaaggagtgttattatttaatcaaatgaagctattggatgatgtccccaaaccgagagcgatccagagaattcgtgggaacatacatttgatgcatggctctgtgtgggctcttcacattaagaatgcgaaaccagctagagtcaaagtttccctaatttgagtttgattttcagatattttgctgcaattaagagcctgaaagtgtcacctattaataccttgcttatgttctgaagctgaggtcttaaagtaacatgcagccctgggctgggctgcaaactgtctgcattcggaatgacccatggctggggcccctgggaaatagcagcagatgaacagagcagactgtggcttgtggggtggttgaagcacctttccaggctctcctgaactgagctccccacaggctgggctctgcagaacatggacatgacgggaaagtgaccagccagcaagggagagtcctctgagctacacggcagttgcagggacaggaagggctggcatgggcagcatggcctggggacctatccgggggatccactgggtgataccctccacgtcactgtcaagagctgagctcagtttcccagacccctgctttcctgacgtaccccttttgggcccagattgtgttgtcccatgggtgccaggcaaaagaagggatgagacaggtgagccctcgagtgggtgcaggtgatgttctaggaagcagagaaagtggatttcatcaaaaggagcacccttggccttcagatctccagagaattcttgttcttcctattagccaaatgtcttgctcagatagattttagataaatgtctccaaggaaagcacgcgttttggggagggttgctatcctgtctaccatggcgagtcctggggaacctgcacaggtgcttacactctggctctgctgctgctgtgactgacaatgtcacttgtgtctgggccgagagtctcctgtctttggctggcatccatgaactatggctggctaatgtgttagttgtaagtagctataatctcagtgtcctcaaagttcatgactatatagtaccttttacaaacatgtcagccgatataaaacacgtgttttatattttaagttaaatgtcatacgcatttgtatgtacatgaagttatttctaatatatatggtgagtgatttgccccatcccgttggtgataagggagtttttgctcagttacttcacgtgagatctggttgtttaaaagtctgtggcatctcccccactctactctcctgctcctgctcttactccgggacctgaccactccccattcaacttctgccatggttgtcggcttcatgaggccctcaccagaagccaggcaggtgcaggagccatgcttatatagccagaagaaccgtgagccaattaaacttcttttctgggtaaattaccaagtctcaggtatttctttatagcaatgtgaaaatggcctaacacagaaaactggtactgaggagtagggtgtttctataaagatacctgaaattgtggcagtggctttggaactgtgtaatggcaggggttggaagagtttggagggctgagaagaagagagaaagacaagggaaagtttagaacttcctagagacttgccaaatgactgtgaccaaaacgctggtagaaataaggacagtgaaggccaggctgacatggtctcagatggaaatgaggaacttactgggaactggaggtagaggccgcctgtgctatgcctcagcaaagagcttggctgcattgtgtccaagtcgtgggcatctatggaaatttgaacttacgagtgatgacttggagtatctggcagaagaaatttctatgcagcaaagaattcaaggggtggtctggcttcttctaacaaccaaccatcagatatgagagcaaagaaatgatttgtatttggaaattatatttaaaagggaagcagagcataaacatttggaaaatttgcaggctagccacttgatagaaaacaatatcctgttttcagggaaagaattaaagggggttgttggagtaaccatttactagagagattagcatgactaaaagggagccaagtgctactatccaagacaacaggaaaagggcctcgaagaaagcatggtataagtcctcaggacagcccttactgtaacaaggccagagatctaggaggaaagaatgacttcagagtctagaccttgggcctctttgtcctgtgcagcccagggacactgatccctgtatcccagctactctggctctgggcttggctcagaggggcccaggtactactcaagccacagcttgaacagtccaagccgtaagtgtctatagctttcacacggtgttcagccttcaggctcacagaatgcaggagttaaggaggcttagtagcttcccctagatttcagagaatccatgaaaaagcctagtgcccaggtagaagcctacttcaggggcaaagccctctcagaatgactctactagggccatgctgagggggaatgtgaggttgaagcccccacacagagtgcccactgagacactgcttaatggagctgtgggaagggggccatcgccctgcagaccccagaattgtagatccaccagcagcttgcactctgcaactgaaaaagcctcaagtgctcaactccaacccatgagagcagccaggtgggctgtgttcagggaagccacaggggcagagctgcccaaggctatgggagcccattcctcacaccagggtacaggacacggagtcaaaggagattgtttcagagctttaagatttaatgaattgcctgctgagtgtagactggtgtggggcctatcaagccttcctgttggctgatttctcccttttagaatggaaaaatatacccaatgctggtgcccccattgtatcttggaaacatataactgcttttttatctcagaggctcataggtagaaggacctcatctccagatgagactttggacttgggattttgagttaatgccagaataaattaagactttgggggactgttgcgaatgcgcaattgtattttggaatgtgagaaaggtgtgggatttgggggaacgggtagaataataaggtgtagatgcttttcccccttaaatctcatgttaaaatgtgattctggatgttggaggtgaggcctggtgagaggcgattggatcacaagggcaaatccctgatgaatggtttagccccatcctcttggtgatgagtcagttcttgcccaggaagtccatgtgagacctggttgttttacgttgtgtggcacctgcccgcttgacctcttgctccttctctcaccatgtgagacacctgctcctgctgcaccttccaccatgactgtggcttcctgaggtctccccagaagccaagcagatcctgggtccatgtttgcacagcccgcagaaccttgagccaattaaatcccttttccttatgaattacccattctcaggtatttctttacagcaatgcaaaaaataggttaacaagtaagctttttaaaaatttatttttattgtatgtatttccgatgtgcaaaatgatgttttgatatacaaatacataatgaaatgatcactaccgtcaaacaaagttaacatacccatcaccttccgtagtgattggtgtgtacatgtggtgagagcacttaaaatctctcttagcacattagtttttagtattcaatattattaactacggaaggaatacaagtgcttagcacagcacctaaaactttattttcactcagtaagcactatgtattttggggttattattaataaacaaaaatataaacaatgcatttaattatggcagaacaactgaagagaacaactaggtcacttttcccaaagccacagtaggtgattctgagccctgagcctcatgtctaacttgcagagggaaggaggttctcctgccagctctgtagttctgtctggcgtctgacactcgcacacctgccaacacctccccaactctactctcttgctcctgctcttgctctaggacctgtccactcacacacctgccgtggtcacttgggcagtgctggcctcctgtcagctggagaggccccgccctgcaggcgactcagccagggcagctgtctggagcccccagagcacagtccgctgtggtcactctgcttcttctttgaggcctggccctgccagctttgctgccaaaggtgattgactcaacattcagacaagaaggatggtgaacttgatgtagtcctcccttgggtcctggggactcagtaattccattctgcaggtgcctggacaatgctctgatccacccaggtgttggcagcattgttgcaaaggtcacctctgtgctttctctccaggttccccaggtcctcaaatgctagtaggcaagccagttgtgaaaccttggattggttccgtgtagctgctgctgctgagaatctaaaaaggccaggtgcttgtgtgggagaccaggagtaaggggaggcctgcaggtgaggggaggccccaggtgtggagaggcctgcaggtgaggggaggcctgcaggtgaggagaggcctgcaggtggggtgaggcctgcaggtgaggagaggcctgcaggtggggtgaggcctgcaggtgaggggaggcctgcaggtgaggggaggcctgcaggtgaggagaggcctgcaggtggggtgaggcctgcaggtggggtgaggcctgcaggtgaggtgaggccccaggtaaggagaggcctgcaggtgaggggaggcctgcaggtgaggagaggcctgcaggtgaggggaggcatgcaggtggggtgaggcctgcaggtgaggagaggcctgcaggtgaggagaggcctgcaggtgaggggaggccccagatgaggagaggcattcagatgaggcaggcttcacatatttcttattctatgagggtgtgtttagctctcactgtgaacagctttgctgccccgttctagggctgcattgagccaatgctctgcactggagtgggaagggaagaagttggagctgggacacatgcagcttctgcaggctttggctctgagatcagggcagggctgtgcgcttcccagtctcctgtttcattagctgggatgtaaacaaatcatatcttggtttggatgtgatggcctgtccgcaattgttatgagaatccaattcattctgatttggcagttttgtaaagggcaagtctgtgccattttcctcatcattcaatactgatgcatcacttacaccctattcctgttcctaaacccagtgaccccgtggacagcaactgcacatgttttacctgtgcacaccccgcagtgcctgtcacattgtctgggacacagtagttactcaataaatgtctgcttaattaattagtaattaagtaccaaagataccatagacaaataatctattttatatcttctttatgtgccatagaaacctcaagaaaagaggaatcctttctccagctcagcttctgtctttttccaaacttcctgagccaacaagcggagtgattgcccgagcagcagagataatggaaacatcaatacaagcgatgaaaagaaaagtcaacctgaaaactcaacaatcacagcatccaacgggtaatgtgtgcccctctccccactgaggagcggcaactcccgaaggaggacaccttgactttgtgcaggggctgcttgctcagggcatgttttttacttgagaccaagcaggatgggactccagctctttcaaagcatacaagctgcaatttttaaaaatgcttaccaaacagtctcaatatcttatttttgttactctggaaaatagccatttctctcctatccaaatcaaatttgagaagtagctcaataagctaaacatccattttttatggtataaaataatttaggaattttcccatagcccccctcttagttaaaacttggcaagctcattcataaaacctctacagtgaaaggacttcatgtgtgaggcagcgcattgcagggagccccatcttcccactgagttgctggtgcctcagcagaactacccaggacatttgagagccaatttactcatctctaaaatgaggacagtggcactgctcactccaatggctatcagaagaccagtgcataaaccaggagcaaatgtcgtcatttcttcagctctaaagcactctatgggcataagatactgagatggtaatgcaggcattcaaaagtcatattggtgcttcctatgatgcagagcaagtaagcgaaatgtctttttaattaatttatcaagaattttttctctgcagcgccatgagctacttggcctctgagttcttccttctaactagctatagatcaatttggtgctggttacttagcttttagaataagacaaacttggctaaatcagtattgaccagaattctcaaatcctaaacttaacagtgaagtttaattaatttcatagcaagctaagattcaccactttgaaatgtcctttctttcaaaccatatggctgaacgatgtttctaagaactctcggtccactgtcctgttacgggacactgtcctgtccactgtcctgtcaggcctcctatggaaatggcagttcctgacgtcagaagatgtgggtctttctggtccatgccttagagccacatgctcactgccgggtctgtagacatcgatgtttaggagaataggctgaggtatttggtccaggctataatgtagaacttaagaactccataatttagaattttttaaaatgatttccgttgtaagtatagcccatcttgaaaatttagaacacgaggaacctaaaaaggtttcccattacttcatcaccaagacagaattccattaaaggtcagtgcctgtccttctaggctgctccttcatgttggtcttgtgtgttacatgactatgacctcatagttcttttcttctttttttttgttgagatgaagtctccctctgtcgcccaggctggagtgcagtggggcgatctcggctcactgcaagctccgcctcccaggttcacgccattctcctgcctcagcctcctgagtaactgggactacaggcactcaccaccacacccggctaattttttgtatttttagtagagacggggtttcaccatgttagccaggatggtctcgatctcctgacctcgtaatccaccctctttggcctcccaaagtgctgggattacaggcgtgagccaccgtacccggccaatggttcttttctatcgcacatgatttgttgtctgcaagcacctgcttgagggcattcctgtcaagaagaatctgtgctcagctttttgaagaatgcgtaatcctccactaactgaatgcacactgcagtccaaggtttacttaactgttcccatagagccattcccgttggactgttagtgagcattcatgattgaaagactagtttgtttctctcatatctgaaaatggaatgcattccttcctggcttttttttcttttgaatatctcaatttcactggtatcttgttaatcaaagttttgtggcattatcctcaaagatttatataaaccatattggagaagtaatcgatgattacctctactaatggacaataaagccactctcaccttgatttgttgaataacatataaattatagtgacagaattaatccaaaaaaaagaaaaacaggaaattgtttcctgggttctcgtctcatctggaaagatttacaagggaaccaaaaatcaatacaaaggaaaaacgaaaggttttatagataagcgtaccatcttcatcaaggcaagattttttctacattagggttcgggataaattctactcctcactgtcttctaaagcactggggccattactaggcacacatgcctcactgttcgaatatgatgaatgagccctggagatgtgcttagtgagagttgatggtaactgcaaagttacttgctggcttatccccctgagggctgagagctcctagattgcttttctgaaagatcacagagcaaaaataaattttaaaacccccacatttctagcaataaggaagctcaagggaattaaatgagtgagcacttgatgtaaagggagaaggcagattttctcaaaaacagtgaccccagttacatatgaatcccaaattcagatgctggagtcacttttgagactgcaatagaatatttgttaggtggatttgtggttacaagcacagaattcatggtttcctatttttcacagatgctttatcagaagatctgctgagcatcattgcaaacatgtctggatgtctcccttacatgctgcccccaaaatgcccaaacacttgcctggcgaacaaatacaggcccatcacaggagcttgcaacaacaggtattgtttgtggattttcttaatcttctcgtgaaagttggatctgaacatgactagatgccatcatgaaggaacttctaccaccactggtggatctgtatccacccctgagcccctggttcctgtccttggcctccccgacatggcctcctgcatgcctggtggtgcctcaagcagcgtgccaagcagtactgtcattcccagccacaacgtcccatccacataggtgcttacaggtgactcttaacttcctaaccccacaaattccaccgcccttcacctaagagctcaagccacgtgcttaggcgccatccttgatttcgctagctccgctacccattgtttccaatgcacccccaagactgtcacttttacctccaaaatgagtcctctccactccctgtcaccttagctgaagccaaaataaccatccagctgccatcacgtggtggtcccctcactggttctcctaatttaactcttgctttccccattcacgctccctgttatggccaacaccatctcagcaccctccttctcaactcctccctcagtccccactgcactcagagtgagttcagatccgcccaacagtggtgactgcccacctcctctggtccacaatggcaggagatggacaggagctttggccacacacagaggcatgtgattcagtctggggttcagaatggttttctgaagaaggtgatatgcgagtgagccaaatcttaaaggatgagtgggcatttctcaaatggtccacagggtagagaagagggctttgcaaaggccggaaagagcaagatgcgtttgggctgaaacgtgcagcctttggcacacagaggggcagagggagagcagccgggattgtggcgcctgtggggtctgggggaaacagtgtgcccggtggtcacctagaagctttgtcacaatagtgtggcgccaggatggctgcaggcttgatgttcaccgatgcaggcagcaaaggtgcttagcatggaagaactcctcaaagggactcgagctcctcactgctgggtgtgctgaggtcagaaggaagatgccccccccgagagagggatcagcgggacccaggcagagccctggcttggacaggccctgtcctgagacagagagcaggggctttgcgacaatgaacaggaatcggggtcctgggtatatgatgatggttaagaacaacagctttgcaactggacagccctggatttgaaacctggaatcaccacctatcagagggcagtttgtttcaattctttgagctgtaagagcttgtttgttaagcccacagcaggaatgcataacctggccatgtgtgaggatctgatcttaggactgcggagccccggctggaagaggcagcctgtgctgaacacagagatgggtcagggccacacaggaggctgctgtccacccctcctgccctgaagcctgggggggggtctgtgccttcccgtggaagtgggctcagaggtggagatggcatgtgtcctgtcctcagagctcagtgggagacatagatgtagacaaaggatgcacaggagatgatgcctgggagtatggggacactgagatggctggtgggatgcacggctggagggaccaggcctggatggaggaggggatggggctggagggcctgggtggaggagggcagggggtaggtgcactgttgagtcagaagccggagcggagatggcttggactacacggggaggagcagggtcttcagaaggacagggtggggtctaacgtgcaggtacatgttgagggtggggatcccgggggacagtggcgttggagatgtgggggcggggctgctctctgaatgggtttcatacttctgattttattaaagaaatataagacattgaattctgcattcctaagcacaattatcttaagaatcagcgagtcatactttccatatgttttcaacacctctagcgtgtcttaaacagcgttaacaagtctgggactctccgtggcccgaagcactttcaccagaggggtccgtgatggagctccttgggttctaggttttccttgagacctcctaacttttttccatttccttttctgcctgctgccttctgtctgtcagccatgacccagacctcaggtgcattctgatggctctccctacggaggtcgacccaggggccaccccccacccacccccaccctgccccacgtccctcctccacgtcagggggatgatgaattcagccatgtgcaacatcgtgggcatccttaaagcaaattgcagtggagggtgaattacagtgcttggggaatccctgagcaaagccagtaggcctcacacatgatctaaatcttgcttgatttgcaaacagaagagaaacttaactggagatttttttttttttttttgcaaatgcctggattaaagaaaaatgaaatataagcccgaccattccgaaactgccaactaacctgtttaactaggaaccttccagcaggacagaccaaataatgcgaaactgaagccagtcaaagcttttctccaatgacgtctacatccacctgcaaagcctgcccctgggtcctgcagtagagcctgaacctttctttggtttgatgcttcctgattcataaatcatgatcactcaaaaaaaactctttaaaaaatgtattgtgcctaagtttacattttaacaacctcaagaccagggcctcagccggcagcagtgagttcctgctcggcccttctgaaaggccctgctgctgtcttgggcgcctctgccccagctgctgggcgggctccactgacgctcctgggagaatctctgctgaccacacaatgacattggcactgggagctgtgatctggggacacttagatctgagctggtttctctccttctgtggtaacagctacagttttcattaagaattcacagcatctggatctaaaatctcctacgttcaaggcttcacacattgtattccaccaaaaataaaacatctgctcagaaatcggtcacttgttgttataaaagtgagccacagagggcccctgacccttggcccctgggtggtttattttttctctgcaggcctgttagtgccaaagcccaccaagaccaagctcaaatttactcatgcccaattgtgataaaaatagcccaaacaagcagacttttagccacttggagcctacctctttgcatcttccacaaaacctctcccagcatctcaggccgttggtaagatacagcctcgtggtcatcagaccccaggtcgctgctgtctctggagttgcctgcccagagactccccctctccccctcaccatgttgctgagtaatgtcaccagacatggagaccctctgatgccccactgtgagttcctcgccatcctccccatctgggtggcggtccctcaccttagcctctggatggtcccctgccttgagggatgtcccctcttctgcacctgtgcccaagaaccaccccaaaggcatgtgtgtgtctctgcctccccgatcctaacttttgccttgctcagccctgagttcccagagcttccccacacccactaaattgctaagttcccccccagcggtctcctaagccgcttcggcgtccctctcagtcaccagcacctggttccccacccacaccttcccatccttgtctgggctggtgctgcatttccaatgtgctgcgtttccactgtgctgcgtttccaatgtgctacatttccactgtgctgcgtttccaatgtgctgcgtttccaccgtgctgcgtttccaccgtgctgcatttcctgcattccaaagcgacctttgggtgttggctgcaatgacatctttaagacaaatgttagttggaattaacttttgaaattctaaatgtcgaaatggtggattttaaaactcatccatttctactagttttcttgctttatggtgtgatgtctgcatgtcacaagtggatggcagggtttctaaggcttgtttttcctttgttggtattttcctaattgcctaggacgtatcacataaaattacttaacaagtagtggaaaagaatgatttttctttcaccatttcacctggacattttgtttgtatggtgtagtcggtgccgcaggagctaccttgttgaaagagaagggggcaggctgcttctcctttgtgtggtgtagctaatgccacacctgtacttcttgtttgtatgaagtggtcagtgccacaggagctaccactttagaagggaatggagcaggctgcttcttgtttatatggtgtagtcagtgccgcaggaggcactatgttggaagagaatgggcaggcttcttcctgtttgtatgatctagtcagtgccgcaggacgtactatgttgtaagtgaatggagcaggctcattcctgtttttatggtgtagtcattgccgcaggaggtactacgttggaagcaagtagggcagggtccttcttgtttccatggtgtagtcagtgccgcaggaggcactacgttggaagggaacagggcagggtccttcttgtttgtatgatctagtcattgccacaggaggcactatgttggaagggaatagggcagggtccttcttgtttccatggtgtagtcagtgccacaggaggcactatgttggaagggaacagggcagggtccttcttgtttgtatgatctagtcattgctgcaggagctaccagttgtaaatgaatggagcaggctccttcctgtttgcatggtgtagtgagtgccgcaggaggcagtacgttggaagggaatagggcagggtccttcttgtttgtgtggtgtagtcagtgccgcaggagctaccgtgttggaagggaatggggcagactccttcttgttggtacggtgtggccaatgctgcaggacgtaccatgttggaagagaatggggcttgagtttgttttgctttacactttgtcataaaggaaattatcagttctctgcataagcccctattttttaacaagggggtgtgtgtgcatgcacggcaagctggtccctttaaacattttagaatctctaaatataaagcttaagatattaggaatgctgttgataactgtgcatttggggtgaaggtgttttggtagtatcatttaaaggatttccagcttctttctgtttctgttaccaacctgtggagacctcttcatcatcctggactcagatcagggtcctcgactctgctgcgctcccagccagctgaggctgttgttcctcacctgtgtgtttttatagaagtctaggagctggggggtaggaggtgggtgtgggcaggggtcacgtcacttgcaggttgcctttgctagaagcagtcacattggctgagaacagaatccccagggcctgaggatgtcctgcagaaatttgggttttagtgtgtagcttggcatcagcctagagataagacaaattctattttaaaaatcaagtgctccatggcgggatggtgatatagttggctgtgtccccacccaaatctcatttgaattcccacatgttgtgggagggaccaggtgggaggtaattgaatcatgggggcaggtctttcttgtgatgttctcgtgatagtgaataagtctcacgagatttgacagctttataaggggaagttcccctgcacaagctctctttctgcctgccgccatccatgtaagacatgacctgctcctccttgccttccaccatgattgtgaggcctccacgtggaatcgtaagtccattaaacctccttttcttctcagactcaggtatgtctttatcagcagcatgaaaacagactaatacagatggagtaggggagggctactgaagaaatgaagcctctcagctactggaaatagatgcaatcagggtggaattactcacggacagtcctccagaggcagtggggtcattgtggagatctgtgtgccacaacagccagaaaacaaaggggccacgagccactgtttgctctgtggtctaaatcaatggactatcttaccacatgcaatgttagacagtgtattacatatgattattcataagcagaaatacaaatatatattatatactgtaagacagtattcattatatgataaatatgatgaattcacctagatacttcatatagaatttgccttcagttttagattgatacatgtgataagaacttctctgtgtgttcttgagaaagtgctcacattcccatgcataatggaaaggacattgtattttgaaatagaagacgaaattccagccaccactttgtcagttacaagctgcttagacttcatgtcttgcttagtttctcaaattctctgcacctggaaactggcaaagatagtgatgctcatttctagggttgtcatgaggctgaagtgagacaatgcagcagaaataatttgtgagcaataatgatacaaaggtcagtgattgattatgtaaataatggccacctttgaagcccctttcttcaaagagtctgagtcttgattcttgaagaggtgtgatttttctttgaaaaattgcattatttcttgctgggcactttggctcacgcctgtaaagacagcactttcggaggctgaggtcgggggatcgcttgagcccaggagctcaagaccagcctgggcaacaaagcaatacctcatctctaaaacaaacaaacaaaaaattgtgttatttcttgagttttgatctgatgaactactgcagtaaaccactgtgtctcacagtgttggaagggaatggagccagctccttcttgttgtatggtgtaggcaatgccgcaggaggtaccgtgtttgaagggaatggggcaggctccttcttgtttgtatgatccagtcattgctgcaggaggcaccgtgttggaagggagtggggcaggctccttcttgtttgtatgacccagtcattgctgcagaaggtaccatgttggaagggaatggggcaggctccttcttgtttgtatgatccagtcattgttgcaggaggcaccgtgttggaagggaatgggcaggctccttcttgtttgtatgatccagtcattgttgcaggaggcaacatgttggaagggaatggggccggggccttcttgtttgtatgatccagtcattgctgcaggaggcaccatgttggaagggaaagggcaggctccttcttgtttgtatgatccagtcattgctgcaggaggtaccatgttggaagggaacggggcaggctcgttcttgtttgtatgatccagtcactgctgcaggaggcaccttgttggaagggaatggagctggctccttcttgtttgtatgatccagtcattgctgcgggaggcaccatgttggaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccatgttggaagggaatggagctggctccttcttgtttgtatgatccagtcattgctgcgggaggcaccatgttagaagggaatggggcaggctccttcttgtttgtatgatccagtcactgctgcgggaggcaccatgttggaagggaatggggcaggctccttcttgtttatatgatccagttattgctgcaggaggcaccatgttggaagggaatggggcaggcgccttcttgtttgtatgatccagtcattgctgcaggaggtaccatgttggaagggaacggggcaggctcgttcttgtttgtatgatccaatcactgctgcaggaggcaccgtgttggaagggaatggagctggctccttcttgtttgtatgatccagtcattgctgcaggaggtaccatgttggaagggaatggagctggctccttcttgtttgtatgatgcagtcattgctgcaggaggtactgtgttggaagggaatggggcaggctccttcttgtttgtatgatccagtcattgctgcaggaggcaccatgttggaaggaaatggggcaggctccttcctgtttgtatgatccagtcactgctgcaggagtcaccatgttggaagggaatgggcaggctccttcttgtttgtatgatccaatcactgctgcaggaggcaccatgttggaagggaatgggcaggctccttcctgtttgtatgatccagtcattgctgcaggaggcactgtgttggaagggaatgagcaggctccttcttgtttgtatgatccagtcattgctgcaggaggtaccctgttggaaggtaatgggcaggctccttcttgtttgtatgatccagtcattgctgcaggaggcaccatgctggaagggaatgggcaggctccttcttgtttgtatgatccagtcattgctgcaggaggtaccatgttggaagggaatggggcaggctccttcttgtttgtatgatccagtcattgctgcaggaggtaccatgttggaagggaatggggcaggctccttgtttgtatgatccagtcattgctgcaggaggtaccgtgttggaagggaatgggcaggctccttcttgtttgtatgatccagtcattgctgcaggaggtaccatgttggaagggaatggggtaggctccttcttgtttgtatgaaccactcattgctgcaggaggtaccatgttggaagggaatggggcaggctccttcctgtttgtatgatccagtcactgctgcaggaggcaccgtgttggaagggaatggggcaggctccttcctgtttgtatgatcccgtcattgctgcaggaggtaccatgttggatatggtaccatgttggataagtggcacagtggatagaatccatcgccatagtgaccatgagtggattcctgctattaaattggggtacgacttatgcagggcttgggggtgaatctggagggacaggtggccgagtcttccatgggcctgcacccccagatgagaagcccccaggtgcagatcgagaactgtacaccccagagggctgccttctggcccctcctaggttttgacatctacccagaggtgaccattgctttgatcttcatcaccatagttagttttccctgacctggcttttataggaaggaagttagatggtaacccctgggcctggcttctccacctccaggatttatttgctcctgccttgctgagggagacactcatcgttacagggcaggcatgggcgcctctctgctgagcactggtcaatgcttccaagtggctgctccaatctgcattcccaggagcaaagtgtaagagccccacagccctcaccaatccccgtcactgtgatccctttcattttggcccttcttgaggggagggtggcatttcctgtggtttaacttcacattttcctggtgactaattgtcttgagcacttttaaaatacattcattggccatttggagactctttttcgggatgtgccagttcaaacatttttcccattttttaatgaatcttttttgatttatagatgctcatattttctaaatatgtcttcagtgagaaatatgttttacaaatgtcttctcccagctgagattggccttttcactctccatgctgtcttttgaagaaacgttgttcatatttttaatgaagtcccctttatcaattacttatttcatggaaagaaaacttttttgttatgtttaagaatcttgctttctctgaagaatgtgaaggtatttttcttgtgttttctgctgaaaatgttattgttttacatgtcacatttagatctgtgacccatctcattttatgttttctgcaacatacgaggtggcaaccatgaggggtgtgtgtgtgtgtatgtgtgtgtgtgtattgtaaaccaaaaataaaattctaagtcttgcgatcatctgaattgacccctcctgttggcaagggtgttccaaagctaacctgaaaaactaatctgaccgtgatggggagagtgaggtcagacgtgcctcatgacaccctcctcccttttggaatttctgctagaacagacttcttaactctgagaagaaacatttacagtctcttctctcagaagcctgctgcctggagacttcacctgcacgatgaaaccttggtctccacaacctgtgtcttaacccagacagtcttaagtccttagacgataactttactctttcaaaaaattgccactcagaaaatttttgaatctacctttggcctagaagcccccgcttccagatgtcctgcctttttgtactgaaccagtgtacatcttacatgtatttgattgatgtcttgtgtctccctaaaatatatgaaactaagctgtgcctcaaccaccttggacacaagttctcaggatctcctgagggctgaatcattggccattggtcactcatatctggctcagaataaatctcttcaactattttacagagcttgactcttcactgacaatatctataagtgtttgtgtatatatagaggcatgtatatataggtagatttgtatgtgtgtgtgtatatatctataataaacacaggtctatatagaggggtgtgtgtgtatgtatgtatagatatgtgtgtgtgaaagcatgtgtatatgatatttattcagaaccatcctttacccagtgaactgcacccatgcctatatcatgaatcgagtagccacatgtgtgtgggcgaggactgctagactcttaccattatgtatacaattatgagagagagggagagaacctgagttaaacaattagccacatttctctttaagcctactgagaaaaagacacagggacccagcagacatcagaacaccttgttggggcagctcgcactggggcgcaggtggcagaagcctcacgggattctgtacagcaggaagagaggccggcttcagcccctcctgcctgacagcacaggggtcttgcctggcctgggaggagccgggattggaggcaggggctgctcctgcctccagaggtttccaggagactgcatgttgtgccctgccggcatccacacatttgtgtagtacccactcccagacaaggacactcatagacttcctccggcctcgcgtgggagccgagcctgtggtctgcatctcgctgtgctccacgcagctcctgcatgcagctcctgcacgcatcggctgggctcgcagatgtcaggtccgcctcctttcctcttccctgagcctctgccgagccctcccgacccgagggtcggctgctcccttccccgcctgagtcacttccgtgactctcttcatcctcagagccatccccttcctcatctgtaatgtgggaagaacacccacctcgcagggttgtttctggttgaaaggcagcacttgtcaggctccttgcacgctgtccacagccggccatcgtaagagttacggcgactgtcacctctcagccactcctcggcatcggacctcttggctcctggccatggcattgaccacagaatgtcataaacagcccagtgtgtttttccacgagagcagtggtcggaggctcctgcaggtaaatggctggagattgattgacgtgggaatatcacggcatcacagaatcagagcacatttgttcacggtgcaggaataacatcaagtgagtggtgagctctaaaggacctggccctcgaggtagctcacaccctcgatgatgaatggagccaggccacaggtgaaatttccatccaggcgggacagactcaagccgggactgggttcccctgacgcccggcttcccaaatgtgcttccctcccggatgcacagagaacgaacgtggcatggacattgtgagctgcaggaagcgatcccaccagggatcaaaaagccaacttcctccagcggccattctgcactaagcctctttcgtggagttcacgttctgtccaatacagccttaaagcccatgaacaattctgggggagacgatcaggtctgaaaggaaaattccatatgggtatttaagttattggaagaacccttaagatctacctgggtttaacatagaatttgctatatgtaacttggtatatcattctctatagtcatttgcctaaaaatcatcaaaagtataaattcaatgttgcatctcccatccagatattttgtgttaaaaacacctcatatctgatgtctgacagctattttctttttttctatgtatttgccttgaattcacattcgtagtcaccttttttccctctcactttgtttttcatttgcattttgacctaattcatgaaattatccagcagggagagacctgatggagttttgctggaatgaagctccttgacacaatcgtctcctttttagaagtgcctgtagattgaaagttcaattgctcaaaacagtttgctaaagaacaaatgtgtgtctattaagagtttaagttgcacttgtaaatccaccaatggcactaagatatcatttagcaatattgacacttgaagtgataaaaaaacagaaaatacctttgacgtcaaataaatgtattagtctttaagaaaaaaagaggtggaattgaccttggtgtcttatgaaatcgcagaacatatgatgggtataaacaatgccagaataaacaagattttcaaagtttttggaaaaagctgagctcatgccgattatagaaagcatttgcatcttttgaagggttttcctctgagggttcaaatgtccctcagggatcatgctggtgataatcccagctcacaaactgactggtcttaattgccttcaatcaagtagctccagcaggagacgggaaaaatcaccgctgagtttcctcatacttctggccacctgacagggtgtcaggcgtttttggggacaaaatgaatcctcgcacacctggcccagcaggatgagggcatcccgtgtcccgctgctgccccgctgagaaagaggtgccgttacaggagtggaaagctgacttcgtccacagtttctctcccagcatttcacactgcattgctgtttgcttcttttcatgggcggcacacatctctggcactcagcgtgtccatgtgctgttactggatggccatacctggcaaacatattgacctgtgtcttgcggcctcagtccacagctttatgctcaagcgctcttcaagatggaagtttagaatttcttctttttggaattcagaaatcacaaagtctccagtgccaggtgcctgggagaggggaactagggtcccagggaaatcagagtgactcggagcctcagcaggagcacagacctcagtctccctcataaaactctcctccagaaatgtttctctttgttcattttgtcagctttatgagcctttttccaatgctgccattaattcagatctaagaaaggaacagtgtggtacaatagatttccactgggaaaggatctttccaacaggagctgatcaaagtctcagagggacccttctcagtcctgctgacctgctgaccgtgaaggtcaggtgacacatttgcggagggtccacaacaaatgtctgtgagtgcccttgagccattgtaatgtcctagtgaactgctgacatataaaagtcaatcagcaaaaaaaatcactgcttaagcagttaaattaacattatttttaattgagtaatctaacacctccctatgagccatactttatggaatttcaataaagacaaaccaaccataacgaatctgaacactttattaaagcaatctttccaatcttcagttgctgacgtattgcagctgattatatgcattactctcccatacatttttgcaaattgagccactttggtgtgctggagattaatgaagtattaataacagaattattctccccttatggtccctgcagacatagagaagtaaccatgtccccaagcctcctgccgctgctgaccactcatcatccaatgtgtcctggatgaggtagcagctggtgcacaacagtaagaataaaagctcctctcctctaatgtacggagctgcgtggtggccttagagacttttaaactggaagagtctcagctcttcagtctacctcaaggacaaaacggatctttccttcacaaatgttgcccaggttacaaacagttcttagtagaaccttagtcctttcattcctgtgcagaacatctaaatcggtcacatttaatacgaatgactaatgtatgttataaccataaaggcgatggtaatttatgacaaaaccactaatttttaaatatttatattcccaaacactccaaatgttttaaaaagttatttatcttgtcacgattcttgtagacttcactccttgtattttttaagtgtgtacatatcagatacatgggaggattttcaaagcctgcatcctagtcacgcctgactcttttgtcatgtgccttgcaaagcctcccaataccagttgtccatgatgcagcttcagactctgcagactcagccctggttgtgttgcatgactctgcagctgccacacacagaacctcagtgctggttgttcccacacgggcgtgactgacagataccaatggaacccggatatcatgacaatgttagacccaaaacaatctgtatttatttttaacaaaaggaacctacttttttccacaaaaaatttctatttttttctctttgaattgacttttatattctaattctctcatatttccttccaaatgcagaataatttatgccttataaattgagccattttcttccaaatgtagaatattttatacttgagaaatcctttatttttaataagttttacatatttctttacctatcctctacagatatgtatgctcatgttatatatttgatacattcatttatatattcttcacattcatatagtcttaccatgcatttatatatttgaatatgtattttattttgcatgttactttttatgtattttataaatttaaatttcatatttagaaaatgttcagtgagcacaagggcctcagtgttcattgttttcttcaagatttagttattttttacacattattagaacacaattgatttaataagcacggatctatgacagatgttggtaattattatgcatagagataaatatttattggaattagtttattgatgagatgggtggagttccagttagttccttcatcagttggctgaacatcacctgtgggccaaggggccatgcaccctggttacccgagatccttcctatttatgccttctgtcccaggaaattattaataactaatagtgctcctgtctcctcaaaagtattccactttggttaggaattatacggttgccctacatactatagatgagacagttcagcagcaaccctgtgattatttttacctttgcagatggaaggtgcctagaaacctgctcctgtgactatgtcgctgggaacagttttgccataggaatgccatctggccctcaaaactccttctgagatatagaagaaaatgaacatgtaatgagctatcattaaaatgatttttattcatgtatcagcaatcaattcaataacattgtcctccaaatttctaaacaaaatattggaaaatacctcatttgcacaaaggattagttaccaatctttagtcttttatttcctcagtttctagaagatgctctgagacatatcaagtgactgttaattgtgcctacaccccttcaacttaggggcaccttgcttaacacagtacactcggaactaagtgtgaaatcaaaatattcaacacacctttaccttatcatgcacttcaaatacatttttgtcagaatatattttgaccaatagaacaaaactgcagaccagcctacttatgggaaacttcaccatctagcctattggctgaagccattgtcatcgccaaatcaaacagccaaatacaactgactctctctctctctcaggagagacttaactttatttttaacttactttattttaattcaaattcatttattaatggttcctttgacaacccgctcacttctgaaatcagaaaaccagcaacttcctcagttcccacaagttcgcctggacaatcacacgggcaggaacaggcgcgacaccctggtggcttcatggtgctttgattaaaggatgttttatgccacaggatttcaaatgatctctttgtttggagtaccagaagtttctgtcctccagagaactgcccctggtacattctagaagggtgggagaccctccttcggaaaacaggggagtgggaaggaaccctgcaggcagccacctccagacagcatgtgctgagctcgggagagggtgcctgtgggaaccaagcctctggaatgagctcccttgaagccagtcatgacctgggcctccaggaggcctttcgggtcttctggggagctgtgccccttgggcctccggagagaccccacttattctccctgagaatggtgtcttatatctggaactcactgcttctgtgttcttctcccccatctcaaacacatccttgcatttgtctccacagagaccaccccagatggggcgcctccaacacggccctggcacgatggctccctccagtctatgaggacggcttcagtcagccccgaggctggaaccccggcttcttgtacaacgggttcccactgcccccggtgggtactcagaacgctactatcctggactaagattgggtcctgtgatgctgagggagggaaatagccttttactgggttcttgctcgtgctgggtgctgcgtgcaatcccttcagatcctcccagcctccctttgatgtagcaatcactgtttctgccctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacactcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgcttgccttcttggcctcagttggacaatccctaaagtgggataacactgtcttacccaccttatgctcaacagtggaccagttcaacccccgaggctttttaaactctcagtattatgagattgtgattctgtaaacccatatttgctcagaattatttcactattgagaaaaatcagagttcaagtgtctttaaatgaaattgtgttggttttctacccagctgtgacaaattgcttcaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcacctccttccaagccggcaatgttgtctgtctctgtgcctttgtttggagtcacatctccacctcccgtcaggagagggcctccaactttaaggacccatgtgactggattggacactcgtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttcccccaaaccccatcccatgacggcaccaactctaggcccaaaatccaatccaaatctcaccacataaatcatccacatcaggtagggcaggctcagggtaagatccatccaggacaaaattcctctccatctggacctagcctgtgagacagggaagcttgtcgtctgctctccagatgccctggcggaacggtgttaaacataacagcaacagatgtctgcgtggagaatggaaaggaaggggagtcactcctcccaacccacgttgaaatccagccaagcaactcccttaggcttcaaggccaaggagtactcgcttgtggctggaggctctgccctctgagtcatgaactcaactgtcctaaagcctggctgttttgtcaatgactcttcacttaatccccacaacaacactgaaagctcaacctttccatattaacttacagatgaggaagtgagggctgagggaagttaatgccaggccctccagccaccacaaatcaaggcagggattcaagtccaggggcatctgtcttcaaagcttatgctcctcctgccctaactccagggcacagatctcctaggggcacctggagctctgtgaacaagaaccacaccaggaagtgcatgatcccaaagggtcatctttctgctaccacagggtcctcctatgtcctgaccaatggtctcttcctacccaggtccgggaggtgacaagacatgtcattcaagtttcaaatgaggttgtcacagatgatgaccgctattctgacctcctgatggcatggggacaatacatcgaccacgacatcgcgttcacaccacagagcaccagcaaagctgccttcgggggaggggctgactgccagatgacttgtgagaaccaaaacccatgttttcccatacaagtaagttttagaaaacgtttctatgtttgttatgaaactaagtgctatttaaaacgtcaaacagaatggtataaaacaaaatgtgaaagtctgtttctttgtcctattcccaggggtagcagttgtgaatatctggtgcatctcactggaaattccctgggtacacgtatatatagcatgtatgatagtgtgggtacacatatatatagcatgtatgatactgtgggtacacatatatatagtatgtatgatagtgtgtgggcagatgtgtacatagcatgtatgatactgtgggtacatatatatatagcatgcatgatagtgtgtgggcagatgtgtacatagcatgtatgatactgtgggtacacatatatatagcatgtatgatagtgtgtgggcagatgtgtacatagcatgtatgatactctgggtacacatatatgtagcatgtatgatagtgtgtgggcagatgtgtacatagcatgtatgatactgtgggtacacatatatatagcatgtatgatagtgtgtgggcagatgtgtacatagcatgtatgatactgtgggtacacatatatatagcatgtatgatagtgtgtgggcagatgtgtacatagcatgtatgatactgtgtggtcacaagtatatagcatataggattatgtgtgggcacatgtattggcacatcacaggtgggctcgtgtgtatatagcatgtatgatattgtgtggtcgtgtatatagcatataggattatgtgtgggcatgtgtattagcatatatgatctcgggtgggcacgtgtgtatatggcatataagatagtgtgtgggcacgtgtgtatatggcacataagatagtgtgtgggcacgtgtgtatatggcatataagatagtgtgtgggcacgtgtgtatatggcatataagatagtgtgtgggcacgtgtgtatatggcatataagacagtgtgtgggaacgtgtttatatggcatatgagattgtgggcacgtgcgtttatggcacataagatagtgtgcaggcacgtgtgtatatggtatataagatagcgtgtggacacgtgtgtatataggatataatatagtgtgtgggcacatatgtatatggcatataagatactgtgtgggcacatgtgtatataggatataagatagtgtgtgggcacgtgtgtatatagcatataagacagtgtgtggacacatgtgtatatagtatataagataatatgcggacatgtgtgtatatagtatataagacagtttgtgggcacatgtgtatatggcatataagacagtttgtggacatgtgtgtatatggcatataagatagtgtgtggacatgtgtgtatatggcatataacatgctgtgtgggcacatgtgtttatagcatataagacagtttgtgggcacatgtgtatatggcatataagacagtttgtggacatgtgtgtatatggcatataagatagtgtgtggacatgtgtgtatatggcatataagatactgtgtgggcacgtgtgtttatagcatattagtttgtgggcacgtgtgtaaatagagcctattatcccatgtgtacctgcactttttctcatcctctgtgtcacatcatgtgcatgctcagtgcctggtaaggaccacttagcaatagttcttatacatgtctgcttaacattaagtgaacagaaatgtaattgtttacaacttagtattccatttgtgtgtgcattataatctatctaaccactttccctattaatgagcatgagttgccttctgcttcattgctgtttttatgctgtcacaaataatgaagcaaagagcacacttggccctcaatctttgtgcccatgtgcacacctgatagatccaggggtaagattgctaagtcacggtggaggtgcctgtggaattttgataaatattgcagaattactctccattaatattgcacaaatgttcactcttaccagaaaagaaagagacaatataggtagatttttaattttatttctctctggaaaccagccttgaagttaacaagggacattttctttttttttttttaagacagggtctcacccagtcgcccaggctggagtgcagtggtgcaatctcggctcactgcaacctccgcctcccgggttcaagcaatacttctgcctcagcctccctagtagctgggactacaggcaggtgccaccacacccggctaatttttgtatttttagtagagacggggtgtcaccatgttggccaggctggtctcgaactcctgaccttgggatccgcctgccttggcctctcaaagtgctgggattacaggtgtgagccaccgtgctcagccaacaagggacattttctacttaagagcacagatggtttcgatctcatgtcctctctaacattcattcaataaaacttcactggcagttattctgtgccatgctgtgctgtgtgctaggcaggctgaaaaggaagacaggctggtccctggaaggtgggcaggacagttacataaaccagcagttacaaaattctgggcatctgcagaggaggtcccagtgggcaaaatcaagacatctaaacaaaatatcccaaaaggaataatattgggggaaaggtggaaaaggagcaccataaagactgtgtcaatcatagaaactgaatttcagccaggtccagcctctgtccctgggaggaggtctctctctctcacacgctggggctcagaccctgggagacagggggccccttgctcttctctgcagagccccctcaccagggcggccccctgcatgtgttccctgctgcatgtacctctaacctgggattctttctttctttttttttttttttgagctggagtcttgcccaggctggagtgtagtggcgcaatctcagctcactgcaacctccgcctcccggatataagcgattctcctgcctcagcatcctgagtagctgggactacaggcatgcgccaccatgcctggctaatttttctatttttaatagagatggggtttcatcgtgttggccaggctggtctcaaactcctgaactcaagtgatctgcccaccttggcatcccaaagtgctgggattacaggtatgagccactgtgcctggccctagtgttattcttcaccactcaggaccccaaagttctcatctgttaacattagagctgttagatcttgcagaagtacctgtatcttcagcaatgaacagtctgccaagcagaggccctcgttcccagctaagtggctccccagcagaatctgtgcaaaaaaatgactgagttatgcagcctggagaagcagtggagatgggcacctattatctatcaggtcttgggttccaggcttgccttgtaacttattatctgcgtgtatataggtttgttgtccataaaaagagtatatttcccaggctggccttgtaacttattagctgcatgtatataggtttgttgtccataaaaagagtatatttcccacctaataatgtagcaattagaatgaaatgagatcgaatttgcaaaaccaggctcagagaaggaattcaatgaacgtgtattgttattgctgtgttgctggaagcgtagacctctgagagggatgtggggtgattagggaagctcagcagggagggagcacgttgggtagggagctgcactgagagaactactctgtgtggaggttgggctcccctggagctgcactgagagaaccactgtgtagtggggtgggggctccacctttgggctcccctggagctgcactgagagaatcactgtgcgtgggggctccacctttggggatctcctggagtttcgctggtttgggcaagagctggtgaaaagcagccttggaagaaggagggattgttcttgcaagtctgcggctgctattggggtaatttatgtttgtccagacaggtgggacagttgggggccaccatctgggtgggaaggacacgggtagccctgaggccagacaaggaccccaggaaaagcccagcccttcagggccacacacaccgtgggggaggttggggggcctctggccagggcatcatcctgggcacgttctgctggtatccagggtcacgtgatggttgtggtgagccccacacacccgcccccagaggctccttcctccacccacaatactcagttatgtggatggctgcgttcgtataaagataaatatattaatgtgggttcaaacgttctttggcctaaatgtttattattttcttctgattttaaagcaagttaaagattttgtgaccacacttgctcctgtggccctaggcactgtggctatggtgccgcctgggtaggctggccctggggaaactggacttccacctgcctcaggggaggaattggcctttcgtcctaagaaaagtctcctcagaagaacccgagtgggagtgaaaagcaaaagtgagttgggccccagggccccctgccccaccgggcataaatatacccacaggcatgcacacactcacaggcacaggtgaccgtgaccgcccgtacacctgtgtgcacgcccttgtgcacacacacgcacacccacccacacccatacacacacgtgcacacaggcacacgcacctatacatgctcatgacacacagacccacacacacacctgcacacacctcacatgcacacagctgctccaggatccttctgctgacatgcggaccctgtgtaactcaggagtgtattggacgagggcagggggggccgtggcgaggagcaggatactgtgatgcccgtggagacccccgcagaggttccggggggtccgggcactggctccttcggggctccctactggatctcaagggaaaggcgggtgctctcatcagccatgtcactctccagtgtcctcctttctttttagggctcagttagagtgagcccggtcaccccaggtaccgtctctctgccctatttcaactttctcttctggctcttctgggccagcctgtctttcgtggggcaggactggggttgacagcacttcccttccacacggagcacatgcttgtgggaccctgaaggcagagaggctggggcaggtgctgcgggcagcaggcggggaggggctggaccatctcaggcggggagcctgcagggcttgttcccaggagctgaggagctgactccagacctcagggctctgcgctaaggtccctggacacaaactcagggcacagacaagaggcaaaccctcaggggacgacttgaaaatatggaatcacaaggaattgttatcttcattctataaagagctcttataaagcaatgagaaaaaaataaacacccaatggaataaacacccgatgtgaacaagaaaattacaagaaaacccaaatacgtgtgtgtaggtaaacacacacacacacacacacacacagatatcaatgaaagataaatgaacagcaagatgctgtttttaaacatacagactggaaagaaattatgaaattttaatttagtgttgttgagggtattgagaaatcatttgcatccatgcattgctgtgcaaaagtaaactggtgaatacattcgggacacgatgtgacataaggtatgaaatgaaatcaggcccattcacagcaccacaagaatcttccctagggacaatgtccaaactgcccttaaaagtgggtgaatatattagtttgtcacgattgtttatatcaccaaaatactgaaaaactttaaacgttgatcacaggctatgagcatgagaaacacaagcaactttagacaatcatgttatacagtgatattatggaaatggtaaaatgttgcccagcttagtaaaattttagatgatattgtacttgtcacttttcttatttcaaaatgttcattattgagcatatattatctttgtacttagagaaaaataacaataaaattatttgtaaacaattttaaaaataaaaggcaagaccacatctggcagggaggacacctgcgtgcccgtgggtgagaacgtgggagaggccccagggtgggtctccagggcactttccagggctcttggtgtcaggcatgaacctcctggcttgcagttaagagtgtccatcaattattcagatcctgtccatccccagggcagccttcagtagttgagtgattgagctaacagtcactccagtgagatgaaaaatataccgtatactctaggagtagctccataaacccaatagatgacacatcataaatcagtgcttttaaatgtttgatgtcctttacactcaaagcatccagtttggtctctgagtatttacggtggagtgagagggtggaagttcttagtgagcttggagcaagttgggacttttgaatcccaaagcaaaacagaaaatgatccacacaatttatcatatctatgtttattcagttttcctaagagaaacatgtttccagcaactacacgagactataaattaaagtgttttgagtctctgactactgatcactcagcccagggagctgtgagagctttgcagcatcctctattttaggactgggcttttcttcatgaccttgctccttctggtctcggctaagtgggggtgcaggcagcccgatgatgttccactgggtgctgcaaaccccccatccactgcagaaaatatgtagctatgaatgtatcgacaacctcaaagctatgcaagcctcctcatgcacaccaatgtgtatctctaggtacatattacaaagtggagttagtgggttatgaattatgttcatgttggaattttttatttccataagttattgagaacaggtggtgtttggttacatgagtaagttctttagtggtgatttgtgagatttcggtgcacccatcacccaagcagtatacactgaacacaatttgtagctttttatctctcactcccttcccaccctttccccctgagtccccaaagtccactgtgtcattcttacgcctttacatccccatagctgaggtgtcacttatgagtgagaacataaaatgtttggttttcaattcttgagttacttcacttagaataatagtctccaatctcaaccaggtctctgcaaatgccattaattcactcctttttatggctgagtagtattccatcgtatataaaaaatcacagtttctttatccactcattgattgatgggcatttgggttgcttccacagtttggcaattgtgaattgtgcggctataaacacggatgtgccaatgcatttttcgtataatgacttcttttcctctgggtagatacccaggaatgggatcgctggatcaaatagtagttctacttttagttctttaaggaatctccacggtgtttttccacagtggttgtactaatttacattcctaccagcagggtagaagtgttgttcccttttcaccatatccacaccaacatctattattcgttgattttttttattatggccattcttgccagagtaaggtgctaatgtgttgtgttttgatttgcatttccctgatcattagtgatgagcattttttcatatgtttgttggccatgtgtgtatcttcttttgagaattctctattcatgtccttagcccactttttgatgggattgtttggtttttcttactgatttgtttgagtttgttgtagattctggatattaatcctttgtcagatgtgtggattgtgaagattttctcccactctgtgagttgtctgtttactctactgactgttccttttgctgtgcaaaagctctttagtttaattaagtcccaactatttatctttctttttattgaatttgcttttgtgttcttggtcattaaatccttgcctgagccaatagcaagaagaatttttccaatgttatcttctagagtttttatggtttcaggtcttagacttaagtccttgatccatcttgagttgtttttgtataaggtgagagatgaggatctagtttcattctcctacacatggcttgccaattatcgcagcatcatttgttgaatagggtgtcctttgcccactttatgtttttgtttgcattgtcgaagatcaattggctgtaagtatttgggtttatttctgggttctctattctattccattggtctatgtgcttatttttgtaccagtactatgctgttttggtgactatggccttatagtatagtttgaaatcaggtaatgtgatgcctccagatttgttctttctgcttagtcttgctttggctatgcaggctcttttttggttccatacgaattttaggattttgttttctaatttgatgaagaatgatggtggtattttgatgggaattgtgttgaatttgtagattgctttcagcagtatggttgttttcacaatattgactctacccatccatgtgcatgggttgtgtcccatttgtttgtgttgtctgtggtttttttcagcagtgttttgtagttttccttgtagaggtctttcatctccttggttaggtatatttctaagtattttatttttttcagctattgtagaaggggttgagttcttgatttgattctcagcttggttgctgttggcgtatagaagagctactgatttctgtacattaattttgtatccagaaatttttctgaattatttgatcagttctaggagctttctggaggagtctttagggttttctaggtaaacaatcatatcattagcaaacagcaacagtttgacttcctcttcgccgatttggatgccctttatttcttttgtctgattcctctggctaggatttcgagtactatgttgaagaggagtggtgagagtaggcatccttgtcttgttcccattctcagagggaatgctttcaacttttccccattcagaattatgttggctgtgggtttgtcatagatggcttttaatacattgagctatttcccttgtatgccaattttgctgagttttgatcataaaaggatgctggatctttttgaatgctttttatgcatctatcgagacgatcatgtgatttctgcttttgattctgcttacatggtgtatcacatttattgacttgtgtatgttaagccatccctgcatccctggtatgaaacccacctgatcatggtggattatctttttgatatgcattggatttggttagctagtattttgttaaggattttagcatctatgttcatcagggttattggtccgtagttttcttttttggttatgtcctcttctggttttactattagggtgatactggccttacagaatgatttaggaagggttgcctgtttctctatcttgtggagtagtgtcaataggattggtaacaattcttctttgaatgtctggcagaattcttctgtgaatctgtctggttcttgactttttttgttggtaatttttatattaccatttcaatcttactgcttgttattgttcagggtgtctaattcttcctgacttaagctaggagggttatatctttccaggaatttatccatctctaggtttcccagttgatgtgcataaagctgttcatagtagccatgaatgatcttttgtatttcagtggtgtcagttgtaatatctcccattttgcttctaattgagcttatttggattttctcttcttttcttggttaaccttgctaatggtctatcaattttatttatcttttcaaagaaccaggtttttgtttcatttatcttttgtattttttttgttgttgtttcaatttcatttagttctgctctgatcttggttatttcctttcttctgctgggtttgggtttggtttgttcttgtttctctaattccttaaggtgtaaccttagattgtcagtttgtgctctttcagattttttatgtaggcatttagggctatgaactttcctcttagcaccgcctttgctgtatcctagaggtttcgataggttgtgtcattattgtcattcagttcaaagaatttttttttttttgagatggagtttcgctcttgttgcccaggctggagtgtagtggcacaatctcggctgattgcaacctctgcctcctgggttcaagtgattctcctccctcaggatcccgagtagctgggattataggcatccaccaccatgcccagctaatcttttgtatttttagtagagattgggtttcaccatgttggccagactggtcttgaattcctggtctcaggtgatccaccagctcagcctcccaaagcgctgggattacaggcatgagccactgtgcctggccccgaagaattttttaatttccatcttgatttcatttttaacccagtgtcattcaggagcagattatttaatttccatgtatttgcatgattttgaaggttccttttggagttgatttccagttttatttcactgtggtctgagagagtgcttgatataatttcaattttcttaaatttattgaggcttattttgagacctatcatatggtctatctcagagaaagctccatgtgctgttgaatagaatgtgtattctgcagttgttgggtagaatgttctgtaaatacctgttaagtccatttgttccagggtatagtttaaatccacagtttctttgttgactttctgtcttgatgacctgtctagtgctgtcagtggagtgttgcagtcccccactattactgtgttgctgtctatctcatttctcagttctgttagtaattgttttataaatttgggaactccagtgttaggtgcacatttatttaggattgtgatattttcctgttggacaaggccttttatcattatataatgaccctctttgtcttttttaaccactgttgctttaaagtttattttgtctgatataagaatagctacactgctcgcttttggtgtccatttgcatggaatgccttcttctacccctttaccttaagtttatgtgagtccttatgtgttaggcatgtctcttgaaggcagcagatggttggtgaattcttatgcattctgcaattctgtatcttttaggtggagcatttagaccatttacattcaatgttagtactgagatgtgaggtatcattccattcattgtgctatttgttgcctgtaccccttgggtttttgtgattttgctggtttttttaattgtatttttgttgtataggtcctgtgagatttatgctttaaagaggttgtgttttgatgtgtttccaggatttgtttcaagatttagagctccttttagcagttcttgtagtgctgccttggtaggggtgaattttctcatcatttgtttgtctgggaaagattgttatctttccttcatttatgaagcttagctttgctggataccacatttttggtggataattgttttgtctgaggaggctgaagatgggtcccaatcccttctagcttgtagggtttctgctgagaaatctgctgttaatctgataggtttttactttataggttacctggtgtttttgtttcacagctcttaagattcttttcatcatcttaactttaggtaacctgatgacaatgtgcctgggcaatgatcttttagcaatgaattctccaggtgttctttgagcctcttgtatttggtgtctaggtctccagcaaggccagggaggttttcctcgattattccccaaaataaactttccaaacttttagatttctcttcttcctcaggaatgctaattattcctaggtttggtcattagacataatcccagacatcttggaggctatcttcatattttcttattcttttttctttgtctttgttggattgggttaatctgaagaccttgtctttgagctctgaagttttcttttgcttgtttgattctattgctgagactttccagtacattttgaatttctctgagtgtgtccaatgtttcctgaagttttgattgttttttatttgtgatatctatttccttgaatatttctcccttcacttcttgtatcatttttctgatttccttacattgggctttgcctttctctggtgccttcctgattagcttaataattaaccttctgaattctttttcaggtaaatcagggatttctccttggtttggatccattgccagtgagctagtgtgattttagggggtgttaaagagccttattttgttatattaccagagttggttttctggttccttctcatttgggtagtctctgtcagagggaaggtctagggctctagcctgttgttcagattctttcgccccagggggtgttccctggacgtgattagtactctccctgtttcctagggatgtggcttcctgagagctaaggtgtagttattgttatctctcttctggatctagccaccaagttcaaattgttacaaagttcagctggcagtttccttctccctgtggccttttacaggtgcctctggcagccctcctgaaggacccctgtgaggcaaggtggaaatggcttcctaggggacccagagatcccacagggcttttctggctgcttcctctactcttgtattccactcggctctctaaatggactcagctccgggtaaagtcagaatcttctcccgtaatctagaccttcaggttccgcagtgggggtgcatgttcagggtggacgatctctcccacttcctcagtttgggcactcacagtatttggggtgtctcccgagtcctgcaggagccatccgctttcttcagagggtctgcggtttctcttggctttcctaatgtattcctgccgtcgttctggagcaaaagttcacgacgtgaacctccacacactgctctgtttgtccaagtgagagctgaaacctagtcctgcctcttgtccgccatgatccgtcacaaaaaatcctcctcatgttggaattttaataggtactcccaaatttctctgcagcaatgagatggcgaattgtattttctaattgattatttttcagcaacaattaatcttacataattcctattattttccaatgcggtaaagaagaaaatcttgaattttacattattggctttaaaacctgtatctgtgtctcttttgttgacctaaagcaagaagctgaggcacaaaatacattttaaagagtttacttgagccaaaatgagaatagctgcccggaatacttagatccaaataactttggacgtgagctttgttagatctttgctgcaaacaggtttcaaaggcgaaaaaggtggacaaggagtgagccttggtccttcactctatatgattgcttggcttttcattttgtttacggtgccattattcataaatttaggtcgattttcgtcaattttttttcttctctatgacatctacattgttatcttactgagcaggtcttccttatctggtatatataataatatatatataaatatatttttctatattttattttaaacatattaaaaactgggcttgatatacaactttgttttattctgactctattttgtgtagataaaatactgctttagtgagtaacatttaaaaaagccatggtgagagcagcatctgcctctgttcctagataaagggcatgattctgatgtttttcctcacatactgtgtctactaggaatttctgctagacaacttcagttagaaatttgaaaatcttatttgtaatttcccaagaattttaatgaggcttgtgggttccagctttactcaataccttcccagcatcggcagaggaggccacagggcttccacttcacttcattattgtgtgagctacactggtagatttccaacgcagtgccatatttacatggcctgcatgatggtgatgcaggttttcatttattcttggattgaatttgctaatattttatttgaaatgttgcctctctcttcataagcagagttgtgctacagtgctcttttccgatgctgcacctatttgggtgttacaaacacaccagcatctgacagtggtcaggggttgcccattcttttactatgctcaggattaccttgtctaaaatcaaatttgggctttttgttttgaataactggtagagcttatttgtgactctggtcctgataacctctggggtggcagatctttggttatgggctcagttctgggtgcagttagtctattcgagcccataagtctttcctgttctttattttctattaccttcctattacactttttcatctacttcacatttctcaccctcttatgctgaaagcgagttgagttacgttcactgtgtcgtgctttttgacaagtgtagttaagactatgtattttcctgtgacccccccccacaaattttgatacatggtccttacattgatgttaattcaaaataggttttaattcaaataagaatttcttacattaaacttgagcacccacatgtaagtgtaatttcacataaatgtaaaacttaaactgtgcctgactctcccgacacgagtctcttcctctccctccctcatttgctagactctcctcctgctcactcccatgttctccactcatgcccctgcccccaaaccaatcatttgactcccaaatgttgatatttgaagtgtgtgtaggggaaagggggcatgataaatgaaactagaatagtaagaagctggtgtagacagcatagtgggctcaaagggattcactgggcaccccgttttaatcagcatgcccttgctatgatctcagcactcatggcatgcccttcccatgatcctgatgttcatggtgtgcccttcccatgatcctgatgctcatggtgtgcccttcccatgatctgaaagttcatagcacatgcccttcccatgatctgaatgttcatagcacatgcccttcccatgatctgaatgttcatagcatacccatcccattctttgagtgctcatagtatgttcttcctgtgatctgagtgctgatatcatgcccttcccatgatgcaaatgctcacagcatgcacttcctgtgatctgaacgctcatagagtgctcttcctgtgatccaaatgctcatggcatgccctttccatgacgtgaatgctcatggcgtgcccctcctgtgttctgaatgcttatagagtgcccttcacatgatctgagtgctcatggtgtgtcctttctgtgatccaaatactcatgctatgtccttcccttgatccaaatgctcatggtgtgtccttctgatgatctgagtgctcatagtgtgctcttcccacgatatgagtggtcacggtgtgccctttccatgatatgaatgctcacttggctacacctaaagaagtcatgcacaagcatattctcttgaatgttgttaacaaaaacaagactatgctgagtacacgttctgtatcttggattctcactcagtagtgatgtgtcctgggaatccccccagtggagcgccaagccatccctgcttacggctggactgttccacactccgggtcacagccatgggtgtgcccttccgtgttacagcctctgccacagcgtggatcaccagaagtgacactgccaggttggaaggcagctttagcactgctatgctggtactactgtctaaaaattctgtgaccctcacagcaacgactgagtgtaccccttactcacattcgccatccacactggcaacagccttgtttttttctcatttttttctgcttgtttggcggcaaaaaaaaaaaaaaaaaaaaaaaaggagagagagagatatttcgttgttacattagttgctttccctgaatattagtgaattttaaagttgtcctttatttatctttttttggcaatttgtatttgttcaacgaatgatctgttcatagcctttgtccatttttctactatttgactgttaattgattttaattgctcctttccactctagatgttaactctctatctctcacttttcttacaaatgtttttctacagccccatcaatacagaactgtcagcatgaagcactttcatattttataaggccaggtctacttatgtgttgatggcttctaggctcagttttggttcaggaatctcctttgctcgaagtcgacagtgacctcctgggtggtattacagcacgggtttccattcattttgcacagtggacagtctgggtgcgttttattcccattcagatggaaaaccagctggttctgccctccttctccccacaggcctagatagcactttgtcacagaagaactggggtctggttctgggctctctgtcttcttttattaacagattcatctgttcttgttgacaataccgtgtggacttggtcatagcggccttatagtatatcctattatctgtcaagtcaataccgcatcaccattcttttccctagtttattaaggaataaataaataatggaatttgtatcttcatataaactttaaaattaatttatctatttcaaaatgaaaaagtactatcattattattgtaaatgaaattgcatttaatttatacattcatttagagagaaatgatcttttcccaaattttttgtatatttaatgatgttttatgattttctttttgtagatcatgtgattattttgttaaatttacacacctgattttgatcaacttttttgtcattatgaaagggatttttttttctccattaccattcatggtactttgctaaagaacaaaacaaaaaagaaagaaggaaaagaacagttttatacttatcctcagatcgaagacattttttaaagaaatgttatcaattttttagaatttttagatgttgtagacatctaacatagcattaagaaaaaataattttattatgttttaaatcttattttctcttacagtagctttaccagctcttattttattttctagactttggtctaactgagatagtactaagtaccaacaatgatagcgggagtttctgctagtccttaattttaaattaaattgttccattgtttcactgctcgagataatatttgttattgtttctacattatattttagcaattccaatctattctatttctatttaaccaggaatggtaagtaatagtaaattgtgttattgcattttaagtacctatgatattaatttttcttctttaatttgctgacaccctggaaaatacaactctattctccaacacggaaccattctgtgaatagattctatttgactatggtaattgctgttttgatttgctgccctatcttttattattttatttagaagggatattgatctgtatgccctgtccttgtcctgttttcatcagaggccaatacaaaagtttcgctgactctgtagagtgcactggggcccttttcatcttttccatggctgaaatagtttaagcaaccttggagttacctatcctttcgagatttgatagaagtccaccgtcaatgccatctgacctctggatttctgatcaccttgtctatctcttccatcctcattgtccattggagttttacatttcttcttggaaaagctgtggttatttctattttgttagggagtcatcgatctgttcttcattttccaatgtgctgccatgaaaccgcatatacagtcgctcctggttcttctcatctctcctgcatgcctgagccctgctcctttctcatggcaaatcctgcctcactcggtgctctttctttgttttccacactgggttgtgaagcagggcttcatgttttcttcccaccaggtcttttattcatagttaattattttaacttctgcatgcattaatttaactttctcatttatttgtgctttagctctttgttacttaactaaattcttaaaatagctacttaatttcttggtttttgttgttttgatgaaagcaatttaaagagcacagattttcttctgaggaaggctttgctggtgtgcttgaattttcttaacaagtgagttaacttttcattgatttctggagacactttcagctcttcttaagagtctctttgaatcagtgagtaggagaatttgcagctccttgttatttatttgtaattttattattatttgtgctcttcaatttaattcctctatttcctcccattcttggggcctctgggcctgtatattctgaagggcgtgcactgaagttccggctgtcacggttttcttggctttcctactcttttgctgaatttcagctcctccctgggttccctgctggccccaagtactcacctcgtctactctaagcctcgcaggcctccctgaggctctcagtggaagcgctttttttttttcttttttcttttttttgagacggaatctcgctctgtcacccaggcaggagtacagtggcccaatctcggctcactgcaagctccgcctcccaggttcacgccattctcctgcctcagcctcccgagtagctgggactacaggtgcccgccaccgcgcccggctaattttttgtattttaagtagagacggggtttcactgtgttagccaggatggtctcgatctcctgacctcgtgatccgcccacctcggcctcccaaattgctgggcgcccacctcagcctcccaaagtgctgggattacaggcgtgagcccccgcgcccggccggaagcgcttgtttaatgcacgatcttttttaacgtggaccctgtgctggctctgagccaaggctggggcctcgttgctgccccgacccccagctggccttgggctgcacagctgccaggcctgggcgctgcccagaggggttctgacagcatctgctttgctgcttcaccacaaggccgactccctctcacctacattctttctgctgcacctcctgtgcctgggtccatcaggagctcggcctgtctccctgcaccgcacggcaccgagcggccaacccctgagcggctgctggctcgctggccgcatttccctaatgcagcccaggtcttccgttccttcctactcctcagtgcccaggctgcactttgccccgagaggagctttccccttattttcactggtaataataatgtcctattacgagaagaccgtgatcttcaggaagagtctctttcggaatctgtccaaccccggtgatcttgtgattctggatgagcgatttaacctcctaaatctgataacgcccagggtaggccctgaccccgtgacacctcaccagggaggaagagctgacagggaaagggcacatgctctctgcagcccacagagctcgactcttcccaggaaacctgtaaatctggaaaaaatattttagatctccatgttacagatgagaagatggaagctggccacagccagagttggaatcccacccaaggtctcctcactcccctcaagctgcctttacactaaacagtgatgcccacaaaactcggagactgtttactcattgtgctcctaaaccaagtccatggcactggaaaggaagaagtcagctcttccgaaagtcagaaaataaaccagaccggggattccatgagcagctagagcaggtctgagcaggagcgagactggctcaggccaagagcgtctgagctttggggagatgtggactcctaggatgtggggtccatcctctgggttcaacctcttccaggcaagagaccaccagtgagcaggctgaggggaggtgcggggctggctggaccgacccctgcagcctcttccaggcaagagaccaccggtgagcaggccaggggggaggtggggggctggctggaccaacccctgcagcctcttccaggcaagagaccaccggtaagcaggccggggggggaggtgaggggactggctggactgacccctacagaggactggaggggcagagaaacgtgcggcgctgcggggtcgtcgccggcctcgaacttccagagtcttacaaagggtgcacgggggccctgggtgaccttgaactcccctttgcctgcagctcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtggcttctctctcccaggtacttgcacagccatcatgggcgcccacatgggtgagctccaggtcgtggggccctgtgtgggtgcgcagtcctgctgggcgccctgcatgggcgtgtggagggtcatcgtgagctcctgtgcaggggccgaagggtaactccggagctggcggccctccggggcccctctgtcccacctgcttaccctccagccggctggtgattatcccaccaagacccaacaaccacagccccacaacagtggcagccagaccacccaggtttcccggtgcgcacagccaagctacgtgctttacagatttcaactcatttaataattcccagaacaacccttggaggtgggtggaccaggggtgctggtgtttttgtatttcagagacagtgcagtgaatgaagaaccgactctgtgtgaggattctgaactaacaagttagagtctatttgaaacctttcttcattttatgactttcttaagtatcacatgagagggtcttgaatggagagtcaagttggccttttattaattgtgtgatggagaaaagcacttatgcacctggaaatgcggtccctgactctaggggtctcacaggttgttaggaagaaggatgggctgtttgatatgcgagtcaccgtgtgtgtctgttgcaccaggccctgtggcggcctgggcatcgtgtctgcagtcctagccgggagcctgcagggaggtgcgcgtcagtcctgttctaaaggaggcactggagccttgtccgaggaggcacaggggctgtgtgtggcaccggctgcccccgggcaccatgcgcccctgccgctttctggccttcactgcactggggtccaggccccaaaggtcagagcagagggtctgggaagcctccatgcgctgggtgttaacccttagttcctgggtggcgaggggacctggagcttcctggaacaggggctggcagcagcaggccctcacacttctccggcaagcacggcagacgggctcactgtcctaacacgcatccacacagcaaacacagcagacgagctcactgtcctaacgcacatccacacagcaaacacggcagacgagttcactgtcctaacgcacacatccacacaggaaacacggcagacgggctcactgtcctaacacgcatccacacagcaaacacagaagacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcaaacgggaatataaacccaggagctgctgagcggtggaatccaggtcctcgtctccatgagtctggacttccggccacacgcgtggggaggcaggtcccagacggctgccttctcccctctgctcaacccctgaggccttcggcgctcctgtctgcttccttgcttctgtgccccttccctgactgcgacctccacgggcagatgttcatccatttaattcttgtttctcaggacccacaatttgccaggttgcttcataaatatatgtagagtttgtgaatgaagtagaatctcaaaaataattctggaagtcctgccccttctgtctcctcaggagcaggatttggtttgaaccttctttgagtgagaacctcatccagcccagggagctgtgagaagagcagctgcctctgatccctggagcccgttcacagagcgggaaacgcccaattgtcacgcaccctgttgtctttcttctccatggagttctgggattatttagaggcgtgaattattaccaggcccagtcattgtagattagagacagtttaattccaagttactgagaatcctactgacctagaaataatgacatttggttgctgcggctgtggctgctgctgctcctccttgtcctcctcctcgtcctcctcctcctcttcttcttctccttcttcttctttttttttgagacagtctcactctgtcacccaggctggagtatagtggtgagaccttggctcactgcaaccaccacctcccaggttcaagcgattctcctgcctcagcctctcaagtagctgagaccacagacatgtgccaccactcccagctgatttttatatttttaatagacatggggttttgccatgttggctaggatggtcttgaactcctttcctcaagtgatccgcctgcctcaggctcccaaagtgctgggattacaggcctgagccactgcgcccagctgccttttcttattattaatgaaataataacaacagcaaccaataggaaaagtgttcttctctgtttcatatttaccttcctcaattcattttctgtgtgttctgctttttaaaaaactgtgaacattcttttcttcttggttttacatttcacttttgaatttccttttgtatttttttcagttaataggtcctctttggtgctttttgcaaaaacctttgatacattaaaataataagttgtgtttaacgtgtcgatagagccactgctgcgacttctagccgtatttgaaagatccacggtggcctgggcctggaagcctcatttttctctccctggttctaccgactcgtagtttggtaactttgtaatctgaatctctcttcttctgaaaaacattagataatgaaaagagatgccagggcaaccttatgaaagagaaatagcatccccccctctatcacccctcaaaccccctacacacacacacacacacacacacacacacacacacacacacacacacgagccagccagggccaggctaatgcacacatcagcaagagacaggaaaggtcatctcagagccgggagtcacagctttctcctccatctgtccacaccacctccctcctccttcatccgtccaaaccatgtttctcctgctgcatccgtccacaccacctccctcctcctgcatccgtccacaccaccttcctcctgctgcatccgtccacaccacgtccctgctgctgcgtctgtcctcaccatacccactctaatttgtcagggcccaaccacagccgcccccactctgaggatcttggctcctctaatttcttttgtcgaaagctgagagctatcccctccctcagccctgggccacaggacttctgctgtgggcatgtttgggagggatctgcagggccgccctctgtgctggttcctgggatccggcatctctcgggggactcgcacgtaggaagggctgataaagttgctcttgctggcttgagatcccacaggaccctggatccataagccctgcttcccaccaggaggaactgaagctcttgctcttcaatcccagaaaaccctagctgctttaggtgtgtcataagacaagaactcacaatcagttgctcactttggtgataacttttgtgttctacagacaagaaaagaatgagaaaggaaacccttcccagcacaggtgtgagggaggcagagaggaggtagccatcctcggggagtctgggtgtgccatccaggcagcatggagtttgggttccacagggtgaaaagataaagacatcccaaatatctggcgtggatgttttctatgccccggccatcagatagcagacctatttctggagcacagccttgatttccccagatatccagggacccacagaagctttgctttggatgtgtgtggaggtagaaccagaccccggagggactgcagatctccctggacatccccatcccgggcaggcagatccatgtctcggggcaggggctgcatccctgggccactcggctgctgacctttgctgtagctgagtactttttcagattggttgctcttccagagcaaaggagcagatggataaagtcatgcttccaaggctggaaagaaagagaaagggccgttcctgcagtgggtgctgttgctgccccacccaggcccctttatctgcagggccccatcccccagtggcctccaatgttggctgacaaagtctcctggtcgttcctctccaggggtagctgtggaggctgttccctgccctgcagggacagccaggcccctacctcaaggctggaccaagcccaggtgcgccatgctgcagggcttcctgcggaggagcacaagccaggcctggctgtgtcacgtccttggggagctgggtgcctgctcagcctcctccctggagcaccctcagcaagcatatgggagcctcttattggactaatagggcatgtttgagaaaatgctgagtgatgttctgcgtagagcagggtaggtgactttgaaagcagtcgagagtcagaaagttcagaggagcctgtgccaggggctacgcggctgtttcccaccgtcggtgacaaggatcgcatctccaggtctcttcgtcctggtctccccgtgtgctggggtcctggcttcccgtcaccttcacgcccatcattttcccaagtgtggacctttcagtcattcccactggtgagttgtgaaggcaaagaaatggagagtggccacaagtcagcacctggtggctttggcagaggctgtggggaaccaggaggctggggtgagagcagacgtggaggagcagcttgaagcagcctgggaagatgaggcctctacatggcaccgccagcagaggaagaagacatggcccacctgggaggtgagcaggaggggcacctgacagcgacgatgccccggtctcacagtatggcgtctgcccaggtccaatagttcagagtaaccatttcccccatgcgaccaggtaaagaaataccagaagcatttccagaagaattgccatgaaaattccagagagctgtttacaaggttcaagtgttttctttttctctttttgagaaagcatctcctctatcacctaggcggaagtgcggtggtacaatcatagctcactgcagcctcaacctcctgggctcaagcaatcctccacctcagccacccaagtagctgggactacaggtgtacaccaccacacctggctaatttttaattttttaaatttttttgtagaaacagagtctgactgtgttgcccaggctggtcttgatcttgggctcaagcaatcctcccactttggcctcccaaagtgctgggattacaggcgcaagccactgcgcctgactcaagattcaagttttaaggccccattggtcagaacaatgggtgcttctgcccaacctcgacggctcccaggggaggctgcagtatctgagccaatcacttaccagggatgtttcagatcagatgaggaggcagtggggaagaggagagacacactgttcagagctctggcaagatcagacactgaggaagtacagtgtctgtgaggctctgatgaagggcgcaggtttcctctctgttaacagctagccgggcacaggtggagctgctgaacctgaggctcaggcctcagttctctgcctgtgcttgctgcatcccctggctcacaagtcaaacttcaggcaggcaagaaggggaagaggtgtcttccttaaaatagcttgcacttgaatttgaaattgtctcagtccctgggctaaaaagagagaggccttttcctttctattgtagtgagaagaaaccaaagaatgttccagggaacagaaggtgctgcctgagttctgaatgtgggaagcacacggaccttctcacgcggttaggaggagccccttggacacctgtgtggttcagaaacgttgccacataaattgcacctgaggtggagaggctgtttgcacgatgaagtcgtgcaactgctctctgggatgctgacccatagcacagtgcttggcaccaatggatgaactagcacagggacggaaaccccactgggaaacatttggatgctgccttttcctccttgtctgtccaggtctccgaggtggagcgggacagcgagggcaggtgcaccttcagtgaaggcccaggccacacaagactcacggctctccctggtctccctgaagggccaaattacgtgcttaggaaatgcattctggcacatggaagaaacatattacaagtgtgtaaataatattggttatttttaaacaatccacttgccttcctaaactggtaagctaaaagagaagattcatattctagaattattcctattatgcttcatttggatgcagtttattgaccaaaatattccccttaaataccaaaacaacttgacactgatttttctgtctgaaagaaacactgttaaacctgaaagtagaatcttggtacataattctcctgggaccatgtatcaaatcgtaatttccaggccctgtgattgcaactgtaattttccatcgacagagctctctgccatacaacatgctttgatttaatcctcacaaaggctctgggaattaggtattattgttgctttgtagaaaaaggaactgctccccactgtcaatcatccagccaggagtctagctgcccagcctggcccggtggccattgttggctcgacagaggtgctgtctcttgccactgccagccccatcaccatcctgggaaggaggctctctagtcagccctataaacgcacctcctgaatatccatgaaaaaatcagcaagaaggcatttctgggaagttcagctgaggcccttattacaagacgagaagggtccagttccctggggctgtcaaggaagatgctcttccacactgccgctcgaggcgaccctcctctggtatcctgggcctcactgagatgcttttcctatctgcacagatcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtgagtgagtgcggtccctgcagctggtccccatgaactcttccttctttttttaatttttttaaattatattttaagttctagggtacatgtgcacaacgtgcaggtttgttacgtagggtatacatgtgccatgttggtttgctgtacccattaactcgtaatttacattaggtatttctcctaatgctatccctccccctgacccccaccccacgacagacgggatatgatgatccccgccctgtgtccatgtgttctcattgttcaattcccacctatgagtgagaacatgcggtgtttggttttctgtccttgcgatagtttgctcagaatgatggtttccagctgcatccatgtccctgaaaaggacatgaactcatcgtttttttatggctgcatagtattccttggtgtatatgtgccacattttcttaatccagtctagcactgatggacatttgggttggttccaagtctttgctattttaaatagtgctgcaataaacatacgtgtgcatgtgtctttatagcagcatgatttatagtcccttgggtatatgccaagtaattggatcgctgggtcaaatggtatttctagttctagatgcttgaggaatcgccacactgtcttccacaatggttgaactactttacagtcccaccaacagtgtaaaagcattccttttctccacatcctctccagcatctattgttttcctgactttttaatgatcgccattctaactggtgtgagatggtatctcattgtggttttgatttgcatttctctgatggccagtgatgatgaacattttttcatgtgtctgttggctgcataaatgtcttctttgggaagtgtctgttcatatccttcgcccactttttgatggggttgtttgttttttccttgtaaattggtttgcattttttgtagattctggatattagccctttgtcagatgggtagattgcaaaaattttctcccattttgtaggttgcttgttcactctgatagtggtttctattgctgtgcagaaactctttaattagatctcatttgtcaattttggcttttgttgccattgcttttggtgttttagtcatgaagtccttgcccatgcctatgtcctgaatggtattgcctaagttttcttctagggtttttacggttttaggtctaacatttaagtctttaatccatcttgaattaatttttgcataaggattttcgcatcgatgtttatcaggtctcacttctttcttatgactcatcgcagccgtgcagaccttccgtatgggcacacttgctgatcctacacaaggtttttaatatctgtggggaaaataaatgtgtttaaagcattttaaaaggctaaactgggctcaggcacggtggcttacacctgtaatcccagcactttgggaggctgaggcaggcggatcacttgaggtcgggagtttgagaccagcctggccaacatggtgaaaccccatctctactaaaaatacaaaataaacaaacaaaaaacattagccgtgtgtggtggcagatgcctgtagtcagctactcaggaggctgtggcaggagaatcgcttgaacctgggaggcagagggtgcaggtgagccgagatctcaccattgcattccagactgggcaacagagtgaaactccatttgaaaataaaataaaataaaataaaaataaaaggctaaactgttctatagttatgatcagcaccatcatctttagaatgttaatgatgggttacctttggaagttaattatttggaagaaaatgatcctattcccccaattagttttttggaagggttatttttaagcttccccattttttctttatattcctttcccagtagtctgtaagtccttctgggagcttctaacctgtctcaaaagttgaccggctccaggcgtagtggggagtggggagggcaggggtgctgcagtgcgtccggcgatacctgcttagatgagagctgagtcatgcacagtgcaccagaggggcaagggccagcctggccctcagcaggtgcccggcatttgaagacacccaggtcatcccacacaggacgatgcatgtcgtgatttctaagtcttccttttgggcatcctaaggccaaaccgatcctttaaagactctggtggcatgcagtggtgggttcacacgccactgagatagaccgaccctgacaggccgtggggcctgctttccatgcggggcctttggagatgacaggaacagtggtccccaggcaccctggccactccctcagctaagctgagtcttcctttcactgttctggatgttagaattcagcaaacgcttcttttttttgtaatctttctgttgctgagaaataaaacaaaaagctttaaaaactggtgggctccttctccaggcccctttctttctgagggtccatcccccatgagccacattgtcagtgccagcccagtggttcacctgccaacaagggcagtgtcctgaggacattcaggaaactctggaatcacacaagctgaattcatgaacttacacgaaggtttgctgaggataagattgagctattgggctgggcgcggtggctcacgcctgtaatcccagcactttgggaggccgaggcaggcagatcaccaggtcaggagattgagaccatcctggctaacacggtgaaaccccatctctactaaaaatgcaaaaagaaattagccaagcatggtagcgggcgcctgtagtcccaattactcgggaggctgaggcaggagcatggcgtgaacccgggaggcagagcttgcagtgagctgagatcgccactgcactccagcctgggcaacagaaagaatgagactccgtctcaaaaaaaaaaaaaattgagatattgttgtttctctagaactgagccaagagctgtccttgccttgtgcatggtattttccaggtggtttggacccactaatacgaggccttcttgcaagaccagccaaactgcaggtgcaggatcagctgatgaacgaggagctgacggaaaggctctttgtgctgtccaattccagcaccttggatctggcgtccatcaacctgcagaggggccgggaccacgggctgccaggtctgccagttccttcccttgcacacctcatgcagctgctgcgggatttgccgagctagcaacctgctgctagagagactgatttagaggaaaacaatcacaaatctgaggccttctaagcaacggctcttaaagggctccagttcattcagctaaagtggccacttccagcttttcttagagatagaaatggcacgaagagggtggttctgaacctcccaggaacgtatgagctgggaccttgagaaacagccgcttctagtagagggaggagggagtgcgcgggcagacaatggcaggtctgtatctggtatcccgggaagctcctgggatggctagagtgcccccctccccttctcctccccaccacaaggtcccagagcctgcaaagatcattccgtcacatcaggactgctgttaactaactggtccaagctggcccctggcaggagtggctgctcctctcaggccagcagccccctgtgctccccacaccccacccggctcctgcctttcccaggccccacccggcagcctcctccctgacctgcccagtttccaactccctgacctcaggcccacctcagccttccctcctctgggctcctaggtggttcggttgtctggtcaacctgcagcacctgtctaggcccgatcccctgacacctcctattctgtgtgcagctctgttctctccacgtaccctgggagcttgggaggtgccctcctgttgtgtgtgggtgacatgtgagatggacagtgctggcaagtcctgccctgccccgtccctgggccttcctctgtcccctggcccttcccccatccctgtcttcctcaccagtggcatctggaagggctgggatcagcagccacacaggctgtgaatatctggggactaaatgtgagttgggaggatgcagaaggggcccctatgtgtgtcaggataacgcacactgtccccctcactccctgcacccaaacacagctgctttcttgttgccagagctcagggagcacagcctacacatgccttcacatgcccggcacatacccagcacacacccgcacatgcccggcacatgcccagcacatacctgcacatgcctgcacacacctacacatgaccagcacatgcccacacatgaccagcacatgcccagcacatacccagcacacacctgcacacgcctgcacatacccatcacatgcccagcacatgcccagcacacgcctgcacatgcccagcacatgcctagcacatacccagcacacacccacacatgcccagcacacacccacacatgcccagcacacacccacacatgcccagcacacaccttgcctctggctgggaccccctttgctgctggccctgctcaggccccacagcttgatctcctcatgttcccactgctgacttccccaagctaactgtgccacagagtgggggaccccctcccggctctcacaacccccaccttcctctgcttcacttttcaccaactgaaatatggccaaaggcaaaaacccatgttcccactggcctgtgggtccccccatagatcgtaagcccaggaggaagggctgtgtttcagggctgtgatcactagcacccagaaccgtcgactggcacagaacaggcacttagggaaccctcactgaatgaatgaatgaatgaatgaatgaatgaatgtttgggcaaataaacgctgacaaggacagaagggcctagcgggaagggaacaggagtaagaccagcgcacagcccgacttgtgttcagaagacctgggattggacctgaggagttcaattttggatgaatctcttaattaacctgtggggttcccagttcctcccctgagcgcccaggacagtagagtcaacctcacgtttgagcgttggggacgcaaacacgagagtgcttggtgtgagcacacaggaggagtcacgacagagcagtgtaagagccgccacgtgggtcccacacagggggagtcacgacacagcagtgtaagagccgccacgagggtcccacacagggggagtcgcgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagccgccacgagggtcccacacagggggagtcacgacacagcagtgtaagagctgccacacatgggtccctgcggcctgcagttcgaagcccactgcatgtgttagcactctataccccagccaccgtagaaggccggactgcgatcactttctaaaagatggatcgagagactgaagcacagacagtttaggcaacttccccaggtctgaattccagcaactggaggcatcgatgcaccagaaaggccacaaacctggcagaggcttcattagatctgatcagttcgatctgaggataaatcagataaaagagaaacgctcatgtctcagcaagctgagctgtgatgatgatttccactacgccctgaaatcttttgttgtactttacggggaatataaaatgtacaaccttccccaaaacacttttttgctgctgggcacagtggctcacgcctgtaatccctgcactttgggaggccgaggcgggcagatcacgagttcaggagttcaagaccagcctggccagatggtgaaaccctgtctctactaaaaatataaaaaatcagctgggcgtggtggcagacacctgtaatcccagctacttgagaggctgaggcaggagaattgcttgaacccaggaggcagaagttgcagtgagctgagatcatgcctctgcactccagcctgggtgacagagcgagactcagtcaaaaaaaaaaccaaaaaaacacttttttttgcattcccgtttctgcagtgtctcccacaggcagggacatctaaagtgatgttctttcttcccagctctgcggcctctgaagctgtgatgagcttcagcctccatgtctttacctcctgcacaggccttgcatattttccctctagagttggaaaaagatgcaaatgtgtttcctcttagagcaataagaaaggaaattacccttctaacttcgttgttttttctttttgaaattaagatttccatctctcacaggtattagaaatgttttaattattttggactacttaaaacagtttgacaatggtctaaattgactatacagaaactttctctcctcatttgagaactttaatttgctcattattttggtttctcactagtctgaaaataactgcattcttttagtaaatatttaatgaaataactgctgtgtcccccaagccctgtggcaagcaatgggcgtctgttttctatataaaccaagtgtctacaggttacctattcctggagctgagaaatttgtggggtatgtttgggatggtctaggctacagtagattgggtgataaagatgaaattttgttggaggtgctgagatggagagacacagagcctcttgacggggcaaagcacttcccggtggctttgatgagagggctgggatggcccatctggagacagaaaacgagagtggtttctgcagatcacagggcggcagagcccactgtggacagcaggagtcaggctgaggcagcgcagcttctcacgggggctcgggggaacccttgccagatgtggaagcaccagggctacggggccagccaaggcaggtgactctaggagcacaagagtcagacacacacttgttcctcctgagggtgaaccagggagccacctgctaagaaatggactcaatggcacctgacagcagttttctaaaagctcaggattttttttgttttttgtttttttgagacgaagtctcactcttgtcacccaggctggagagcaatggggtgatctcggctcacggcaacctccgtctcccaggttcaagcaattctcctgccccagcctcccgagtagctgggataacaggcacccgccatcacgcccagctaatttttgtatttttagtagagatggagtttcaccatgttggccaggctggtcttaaactcctgacctcaggcaatccgcccgcctcggcctccaaaagtgctgggattacaggcatgagccaccgcacctggcctctagaagcgcagattttgaatctcactcatgccttcctctttcactttgtccattcttccaatccctcttcttccaagttgttcccacccctttgctccatgagtctgtttaccacatgggcatccccttcccagaccaactggaggatgcctggctatttctcccagttctgtttggtctaaacatgagacaccaagaggcccaaccttctgtcccatgaaagcctcactgtccctggggggaaccagcccagtgctcacatgttgctgtgcgtgtgcttgtccaggacttctgctgggagcctgtggtgggcagggcgctgagagtagaaccagacagtcttagctaaagcaccacacagggcgggtggatgagtagagacagtagcagaggccctgggcggcgctctgatcagaacccgtgggagtgagggtcgcccatccttgaggagggagcacttctggaggaggtgacagctgaaccaagaggagtggatgagggacgaaggcagatgtgaggagtggggcacagggaggggcacgagtgtcaggcaaaggcgcagccacagagtcagaccatggacgggggcctgggcagggagcagctgaggcgtgggtcagtgagcaggaggaggagtgagaagagaggccagggattcaccagggctcccaggaagaaaagatctccagtcttcaatatggagatgagtggccagacagataaagatatttgtgtgtgtgtgtgtgagtgggtgggggggggggtgctggcttctgtgtgtgctcctgatgtcattgtgggaggcaaactctgaagaggatgcagagctgtgtcagttgccctgtagaggcaagaactaagtgcaggctgggcaataacaggaatgcacttagatgtcacggactcagcattcttgctgtctccagctcctttatgaacaaacctgcaaaaagagctctggcgtccgagctggaacattctagcctggcaaactgccgggcagtgtcacagggtgggacaggactctgcccggcatctgagctggaatatcctagcctggcaaactgctgggcagtgtcacagggtgggacaggactctgcccggcatccgagctggaatatcctagcctggcaaactgccgggcagtgtcacagggtgggacaggactctgccgggcgtcggagctggaatatcctagcctggcaaactgccaggcagtgtcacagggtgggacaggactctgccctgctgcgcttccagtctcggggaccatggcatgagtgagatgggctgaacaaaagttcagttctgtgagagaaaccctgcagcctctcccctgtgcaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggtacgttcctatccagagcgtcttccttcacgttctgcacagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccatccctcacgtcccatgacaatgcccgggaaagcgcagaggtggacagtgactcaggcgcagacacaggccatgcccggtgctcatggatgcctctaggctggacaggacttcccggccccccagaccccacctacagatagcagatggttgccggtagcagaaagctgaggtcccgctttgcctgcctcatgcatgtctgctccctcctcaagttcaacctagaatttggaggtttgtactggagggagtcagaggcagatcctgttcccatctgactctgagtgcatgccccccgtagaagcaggtgcgcaggataccagtgttaggattttggaacaacacagacaaaagcaataggaaaatgttttcttttgcttttaaatacatccctacctatccaattctctctctatttttggtagtcactgtgccgaggtcagatttttgttgtaaaggatctgtgttcttcccagagagtgcacctgccacacgctggggctcctgtcctttccccagtgtgacttttatctctaatttctgagatgcagcctttcaaagagctacgaacacctgggtagaaatcaccaggagaacttgtctcccttatagctgtgtcttcagcaaacgtgcggtttggaattctctgggacatgggaagccactcgctcagaagggggaagatttcaccagcttgccccatacgtgtgtctcccatgcgtgttttatgccacctgtggctgaagcgccatctgaaatcagtgcagaggcagctggcaggttcctagggtggtgcccccaatttctcatcctatgtatttatgaccacatatctccccaatgcaaaaatgggatcaattaacttacgtatagtggggcctctttttcatgttctaagaggaattcatccctgtgatgggaagcagaagagttttacgtggcaggggagatgcacatgggagatgcatgctttacggcattcaggccaggagctattggggctttggcaactattttcatattttgagaggaaagtgggacttcatttcttcacattgcaatttttctgattaatcatggcctggaggaagaagctgaaggtagagagactgtgcagggcacgttgacttcagaataggagcaccctctaaaatagctggatttgctgtcatcattcttgtttttaacacagcaatacaccccagataacagcaatgcagcaaaatagatgctcatagtcaacaagcaaagtggctctgagcccctcttctgaggccgctcgttcagacagccaggtgcacgctgtgctgcccctccacatctccttcgggtcctcagtacctgcacctgagtggtcccgggtgctcaggggtctgggcagacgccacagggtctccttcaggtcctcagtgcctgcacctgagtggtcccgggtgctgggggtctgggcagacgccacagggtctccttcaggtcctcagcgcctgcacctgtgtggccccgggtgctgggggtctgggcagacgccgcaggagaggctggcagcacacagctgtgggcagctggtcttgagtgcctgccctgggggttctccatgcactgtgaccttactcactgtctccttctctggaggttttggtgggagaacagccacgtcttcacggatgcacagaggcgtgagctggagaagcactccctgtctcgggtcatctgtgacaacactggcctcaccagggtgcccatggatgccttccaagtcggcaaattccccgaagactttgagtcttgtgacagcatcactggcatgaacctggaggcctggagggaaacctttcctcaaggtgaagttcggtctcctctcacaccacgttacagcacgtgcatctcatcaaacaaagcttatcttccccaggagctgattttaacttttcactgtttagaaaatagtgtcaacgccctgccttacaccctcagggcagctcctggggcggggcggggcggggcggggcccttctctagtgagaaaggaactggaggcctagagaaagggagcccgcggggcccgatctgggaagaggccgtgtgtgctgcgtgggtgctcagtgagtgaccacagcagggctccccggccctggcaccagcccctccagggcacaagcgcacccgtgacagggacgttggtgtgtggttttcttttctcgtagtttgactacatgtcaacctgtccacatttcatagacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaaggtcagtcctttcttcaatgacaattacaaaacatctgaatgtttccgatataagttaacaatgcaatgtcattgaaaatttcttcgccaaaaggtgcttctgaaactgttatcttcccaggagcaatctggggatagaaagcaagggctctccccttggctggccatgttcccagctggcctttttctaggtagtgaggcctcaggacaggcacgtggaatcgtgaccaatggggtcaccggtgagggaagagagaggggagtccgtgagttccaggcaaagttgtggtgaactcgcaggggcgctttctcaaagggaacacagcagcaaacgtctccactccaggaacccatagagtaaggctcgcctccacctccacctcctacaggtggctgattcccaagcccatgcctggtcctcctccagccactgggttccactcccagcctcccgcatgtttaggtgtggacaagtgtggcttcctggcggtaatttgagagcaggatggggaggcacctttcaggccgcaaggcaagacagccgtgggccacttccacctgctcctcccatgtgctggcttgagcgggtgtcagcccagggcacctgggagcaggtgtgctggacaacagagcctcccggggggagagccgtgtactggggttcctctgcggggaacagcagaatgagagtccccatctgactgttctgaggcagagccctctgggtgcgactcctgaggctggggcttcctgtcagagcagcttgcgtcctccaactacttcagaactgccctgccacaaaacctggaccgctggttctggtctcatgggacagtggcgtcagggcaggcaggagcaggaatggctgctgttctgggaggaaggctgctcagatgacactcaccagcaatctttagaaggccaaccagctgccttcagggactgcattttaggagaggaaagttggcatcagactcacagtctcctgtgagctacgtgctatgagctgcacttacctagaccgcagaagaaagagatggtctcgtgcaagaatctggctggtttgcaagcagaaatacaagcaaagtccacagttttcagttttctcagagttttcagaagatgaaagagtcctggagccagtgctttgggagacccaggtgagagaatcctctgaggccaggagttcaagaccagcctgagaaaaatagtgaaaccccatctaccaaaaaaaaaaaaaaaaaaaaagtggctgggagggggatggtgtgataagttgcacaaggtcagtgtgctcaatgccagtgaactgtacatttaaaaatggcagaggtggtaaagtttacattatgtataattcagcacaataacaaaatttccatttcaattttgaaagtccaaaatgtttctccttgaagggttgcagtggtcaactgcttccagaccctcagtcataaagggagaggctgagaccctgtgtgcaccagagacccaccaggactcagtgctgtggcaggggtcaggtaggggtgcggctcccgccaagtctgtggtctcaggtgccctcccgggagccaccttcccattagaagaggagagaagggatgaggagaggaagaaacaaagctggcctggggaacggtgcctcggaaataactttcaaactcactaacggcacaaggagctgcctgggcatggatagggcagaggcctgctacataggtgagggggtgtcatcactggaaaccagcagcctgggctggaaaccctctgtttaaactgttaattgcacaatgccagatttgcagacgtgctcccctgctgcattttgggattggtcatgaatgacagtgtacaaggagatcacccagagattacagtgccccagagaacagcagaccaggatgtttctcccagagaactttccagaagcctcggtgatagaaacacaactactctgtcgggtgatgacatctgtgtaaactcgtggttgctgttaacactattgcatgactcctgaccataggctctgccactgacacttcagtgacaaaagggtcacgaatcgcaaggttttcctgttcccttggcttagagactgcacaaacttgaaacggccacttcactcacgattcctggttttccgtgttggcattacagttaaggaattgatggcaggtgcttcagggtatagcatgttgcgtgttctacgttaacaagccttcctatggtgcacttcactgtacacctgcgtctctccttgcccaaatacccagacgtttcacgtgtccattttagcttcattttaagtatgaatgaccccaaagtgctactcacaggcatcttcaaggtgcaaataaaagatgggtgagaccttagagtggatcaggaagggagactgctggagtcctacaacctgcctgtgtggagctgccccctgtgcgcgtgccctctgaccttccgcctgccctctgaccttccacctgccctctgaccttccgcctgggacgttgctcatctgtctcctaagtgaggaatgctccttcagcctcctgtagaccatcctatgccatcaaaatcactcttctgttcttgaaattttttcatttatcttccttgatttttagtccaacaattaacagctgtctgaagttaagatccattgtaagaaggactatttctgaaccagtctgggtgctccccagggtgcaggggcctgtctcggcatggtgcgtgcacagcagccagtgctcctggtgggctccctggctgcagcaacatcaccaaggagcttatcacacctgcggcgtctggggccaccacaatccctgagtcagggctgcagcaacaacatcaccaaggagcttattacacctgtggtgtctggggcaccacaatccctgcgtcagaatccacactcttcacaagaccccatgagactgtgtatatgaaggtctgagacacccatcggccaaccctaactcatcctgtcttctctctctagttcactaacttgggcccaacttcatgttctcctgccacagacatttccgtagccatttaatctgtctcccaaattgctgagcctctgtgtgcctccacggtttcaaatgtgaaatgaggacaggaataaggcattgatttaaattagttataaatgcacagtacaaagagcggggtgcaggcctgttgatattaacactgtgagtgctcaggagccgtgttctgaatgctgggacagccacacccagaacaattacactacacagttagcagggcgtctgttgacttggaagagtgttggtgacatgtcactcaataagcatgtaagctacacagcaatgtgtacattgggaatctgttcgggttttttttaaagcagtgggccacaggcacacacatcactttgatgagtgtcctcccgaatgtgaggggagcgctaggctctgctccagaacctgttaatactggagacctcggcagcctgagatggggacaggtaggagagattgctaaccttcatcaatacaactcttttttttgtttgttttatcatatctgtaattaaaatatatcttagagataaatgacaaaactccaaaatctggtacaaatgcgtgtgcacagatatttttactacagctgttccctgcactagaagtttcaaaatcgagaatcacaagggaaaaaactcaagtataacagacaggaaactttacgtttatggtaaattgataagaatataagcactcaaggagatcctcagtgaaacctcatcaacacatctgcggctacagaaaggaaggctacgggcttaactgaatatttgatacagaaaaacaaatagtattcgctgctctcttctctattcaaattctacttattcactcaaactcattcacataaaaacttgatattaaggccgggcgtggtggtttatgcctgtaatcccagcactttgggaggccgaggcaggtggatcatgaagtcaggagttcaacaccagcctggccaagatggtgaaaccccgtctctactaaaaatacaaagaagaaaaattagccgggcatggtggtaggcgcctgtaatcccagctacccaggaggctgaggcaagagaattgcttgaacccgggagatggaggtttcagtgagccgagattgcaccactgcactccagcctgggcaacagagtgagactccctctcaaaaaaaaaaaaaaaaactggcaaatgcattgcagtgagtctcctctgagtgcctggatgctgcaaatttcaaatagataaaaagctgtgagtcagtggctttttccatgagttattgtcaggaggttatgcagtaaacgaatatacataaatgctttgtgcatattatggaaaatacagttcgcaaccagtactaatttacttagagaaatggaaacatctgtgcactcactgcatgtggagactggacaccacagccatctgcgcactcactgcgcgtggagatgtgtggacaccacggccactcttcttgaaactcaaggcgaagcagtcggagagcagagcctcggcctccatgcaggtcaccctggtatctggggacactgcggctgaggctggtttcctcctctgtcgggagcgctgctcttcagacaaggccgatttgtccccctccttcctgtccatcctgggaaggagacctacacagcgctggcccctgactcggccttctgcttagaagaaactgaccgtgggtggagcgttgtgggccaaactgtgcccccaaaaagctatgctcaagttctagccccgtgtacctctgcatgtggcctgatgaagaagcaaggcctttgcaggtgccgtcgagttaaagtgaggctgtcgggtgcatcctgctccaatgtgcagtgccctcataggaagcagagacaagacacagacgggaccctgtgaagacccaggatggaaataaagcttctgccaggcatgggccccccaggacccaccaggagccagggcatgcaggaaggacgccccccgactcccgagagcctgctgaaggagcaccacccggccgacaccctgatttcagacctgtgacctctagaactcttggaggatgcatttctgttgcttggagccatccactttgtgatgatttttcccagcagccacagggaactcataaggatgagtctgaactgcagggatggggtgaggagagggggcagaagctgctccaagggaactccccgagagggatgcagggatgtgttggcagctgccattcccattctgaggaccccattgcacatcccaggggatggagagaaaatgggcttgtagcgttcatgggtgatgactttgatttttcacacgatcatgatggaaacactccctaccccagaggcggctgcagatgccttcacacagctctggtgctccacagctctgcataacgggatgcaggaggggctggttccaggggcagctttagccaagaaagaccttctaggtttaacagccttgacatggttacctgtacatgaaacactttaatagctgctgctagatagagacaattaacagccgatagtcaatagctccaatcccttgaaatttcttgacccttttcttatacttctttttatttttttgagacagagtctcactctgtcacccaggctggagtgcagtgccgcaatctctgctcactgcaacctccgcttcctgagctcaagtgattctcctgcctcagcctcctgagtagctgggattacaggcacccaccactgcacccagctcatttttgtatttttagtggagatgggatttcaccatgttggccaggctgggctcaaactcctgacctcaggtgatctacccacctcagcctcccaaagtgctgggattacaggcatgagccaccggacccgacttcttatactcttatagaatggttgtcattatcaataatggcattattaaagaccgtactgtttagaaagcctgagatatccctgacaccctgctagttgtcataagcatcgtctttgattccacgcccatttttcacagctgacataatgatacccattctgtaactgagaaaaccagcatgggccaagcctcccccggggttaggagtgggcagtcccatccaatgcagcccctcaccctggggagcaggtggccagccgaccaccccagctggccttcgaggcctcacgggtctccggcactgggtcgcctgagcactgcccaggttcgcacattctcatcgtcctggggtggccgagtcggggaccaagaccctgtggcctatgtggaccccggctcctccactcagcggtgagactggggagggtccctccacctctcccagtgcttttgctctgtctagggatgtcgtcagcaccagggccccaggagtgcagggaggttgctgcctccagcctggccctcggcggaggctgcacccaggccagctctgttccctccagacagagcagctcctggaagagctcgtgttccccacactgacagcacctgctccatttagagaatgcgcactgggcatgtagagaagacctgtgacacgctacagcttcttttctaaaactggccagaaaaggaacattatttgaacaaaatgtacagcaggttatctggaaacatacgcctaggggatgagatactaggttgtaggattcttgtgcagggggagcaggagcaggaggggaccccacatcctcactggcggtggcaggtggccccagtccttgctctcagaggacctgccggccagctgggagcatctgcctgggcgaagcagaccctgccccaccctcaccctggccccttcctgcccccgtgtcctgcacttggccaaattccacattcccaggcagaccctgatttcctccaggaagtctcctgtgactcgggcctgagtgagccccagtgtgtggactccctgcaggctcagagcccgtggccagcgcacatctgtctgctcctcatcaccttttcggatgtgccgggagcagggggcggccggttccccctagaccaggtgggatggcaggcaaagggctgacctccccagagagaagcacctcccagaacgggggtcgctcgcgggagatgggggtgcagccgcttcctctcacgtgtgtggccttgtgtgtctggcagatgtgaacgagtgtgcagacggtgcccaccccccctgccacgcctctgcgaggtgcagaaacaccaaaggcggcttccagtgtctctgcgcggacccctacgagttaggagacgatgggagaacctgcgtaggtgaggctgttcccctctctctctgtccgtccatttgcgagtttttgtaaaatgaagaaaagtgtgttcaagttaggcaactgtcaatcaccatcttgattgggaagggcggagatgaataagacaccaagcccacggtgcccgaggggcgtctgcgctgtgctgggggcagaggatgcacttcgtgtgcctgctgtctgcagagaccctcgaagcacactgaggctggggacggcagccagaatgcattgccagacaaggcccacaggtgtatacccagcctagatcacaccccagacaaaaaacctatgaaacaggcaggattcattacagacccatccatcacctctcctcctcctgggacccctccaaatgcacccgactgcaccctgaccagggccagcagcacagctgcctgcctgttctcccacctccacctccggatgtccccgcccggcatggggcctgggtgctcaacatctgcctcggatggccttgtccagtcccccagctctgcactcagctcagggacagcgtcttcctcaccgctgcctccaagccaggtgccagctacgcccaaacttttgacgaatttactcccctgaaaattgtggctcttaggtaagcactatctttaatcttcattttatagaagaggatactagtgataagagagggcgagagacgctcctggtcacacagccactccgtagctggccgggaatttgtgttaatagtctggcttccagctcttatagaaaaataattatttaccagactcaagttacagacagacttcctttgagctactgtcataggggagagaggtctccagaaagaaccaagtgcaaggctcaaatgcagcaaaggtagctgggacgtccagccagggcggagaggggtcagtgcaaaacgcttcatgactcaactgcattgaggagcttctgctaaactggaataataggattcttgctgaaactcagctcctcagcgaagggcacaagggccagggtcaaggccagttatcaagcaagtgagtctgaaaagagatggccaggacgcggctgcccggggccttcagaggctggggaggctctttctggggctctcaagctacatccgcttgactggcacgtcccccactcctgtgtcaggcatacacccccttcctgtgtcaggcgcaccccctcctgtgtcaggcgcaccccactatcctatatcaggcacatcccactctcctgagtcaggcacaccccaccagcttgtgtcaggcacacacccccacccccgtgtcaggcacaccccaccagcctgtgtcaggcacactgccccatcctgtgtcacgcacaccctcccacccccatgtcaggtgcacccctcttcctgtgtcaggcgcatcccccccaccccgtgtcaggcacacccccaccaccatcctgtgtcaagcacaacccccctcctgtgtcaggtacagcccccaacccccatgtcaggcacacccccactccttttgttgttgttgttgtttgtttttatttcttctaaaaaaaaagtgataaatgatgtgaagaacatgcaggtttgttacataggtatacgtgtgccatggtggtttgctgcacctattgacccatcctgtaagttcctcccctcatcctccacccctcaacaggccccagtgtgtgctgttctcctttctgtgtccatgcaaaggaaccatttgtttacttaggggttgcggagaaattcttgtggctttctttttggcagtttttttttttttagttttattattattatactttaagttttagggtacatgtgcacaacgtgcaggtttgttacatatgtatacatgtgccatgttggtgtgctgcacccattaactcgtcatttaacatttggtatatctcctaatttaacatttggtatatctcctaatgctatccttcccccctcccccaaccccacaacaggccctggtgtgtgatgttccccttcctgtgtccatgtgttctcattgttcaattctcacctatgagtgagaacatgcggtgtttggttttttgtccttgggatagtttgctgagaatgatggtttccagtttcatccatgtccctacaaaggacatgaactcatcatttatggctgcatagtattctatggtatatatgtgccacattttcttaatccagtctatcattgttggacatttgggttggttccaagtctttgctattgtgaatagtgctgcaataaacatatgtgtgcatgtgtctttatagcagcatgatttatagtcctttgggtgtatacccagtaatgggattgctgggtcaaatggtatttctagttctagatccctgaggaatcgccacactgccttccacaatggttgaactagtttacagtcccaccaacagtgtaaaagtgttcctatttcttcacatcctctccagcacctgttgtttcctgactttttaatgattgtcattccaactggtgtgagatggtatctcattgtggttttgatttgcatttctctgatggccagtgatggtgagcattttttcatgtgttttttggctgcataaatgtcttcttttgagaagtgtctgttcatatccttcacccgctttttgatggggttgtttgtttttttcttgtaaatttgtttgagttcattgtagattctggatattagccctttgtcaaatgagtaggttgcaaaaattttctcccattctgtaggttgcctgttcagtctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcatttccccattgttgtttttgtcaggtttgtcaaagatcagatagttgtagatatgtggcattattactgagggctctgttctgttccattggtctatatctctgttttggtaccagtaccatgctgttttggttactgtagccttgtagtatagtttgaagtcaggtagtgtggtgcctcccactttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggtcattttcaccatattgattcttcctacccatgagcatggaatgttcttccatttgtttgtatcctcttttatttcattgagcagtggtttgtagttctccttcaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccctttatttctttctcctgcctgattgccctggccagaacttccaacactatgttgaataggagtggtgagagaaggcatccctgttttgtgccagtnnnnnnnnnnnnnnnnnnnntttggttgtgtctctgcccggctttggtatcaggtatgatgctggcctcataaaatgagttagggaggattcccgctttttgtattgattggaatagtttcagaaggaatggtaccagctcctccttgtacctctggtagaattcggctgtgaatccatctggtcctggactttttttggttggtaagctattgattattgcctcaatttcagagcctgttattggtctattcagagattcaacttcttcctggtttagtcttgggaagaagtatgtgtcgaggaatttatccatttcttctagattttctagtttatttgcgtagaggtgtttatagtattctctgatggtagtttgtatttctttgggatcagtggtgatatcccctttatcattttttgttgcgtctatttgattcttctctcttttcttctttattagtcttgctagcggtctatcaattttgttgatcttttcaaaaaaccagctcctggattcattaattttttgaagggttttatgtatctctatttccttcagttctgctctgatcttcgttatttcttgccttctgctagcttttgaatgtgtttgctcttgcttttctagttcttttaattgtgatgttaggatgtcaattttagatctttcctgctttctcttgtgggcatttagtgctataaatttccctctacacactgctttgaatgtgtcccagagattgtggtatgttgtgtctttgttctcgttcgtttcaaagaacatctttatttctgccttcattttgttatgtatccagtagtcattcaggagcaggttgttcagtttccatgtagttgagcggttttgagtgagtttctgaatcctgagttctagtttgattgcactgtggtcggagagacggtttgttatttctgttcttttacatctgctgaggagaggcacacccccactcctgtgtcaggcacacccgccctcttctttcagggacaccacaccctcttgtatcgggcacaggataccctcttctttcagggacagcacagcctcttgtttcagggacaccacaccctcttgtttcagggacaccacatcctcctgtttcaggcacaggataccctcttgtttgagggacaccccaccctcttgtttctgggaaaccacaacctcttgtttcaggcacaggataccctcttgtttcagggacaccccaccctcttctttcggggataccccatcctcttgtttcaggcacaggataccctcctgtgtcaggcacaccccaccctcttctttcaggcacaccccaccctcttgtttagggcaaaccacactctctggtttcaggcacaccccccttcttctgtcaggcacagcccaccctcttgtttcagggacaccccacccccttctttcagggacaccctacccttttgtttcagggacaccgcacctcttatttcaggaacaggacaccctcttgtttcaggcacacacaccctcttgcttcaggcacaccccactctcttgtttctgggaaaccacaccctcttgtttcagggacaccccaccctgttgtttcaggcacaccccccctcttctttcaggcacaggataccctctcgtttcagggacaccacaccctcttgtttcaggtgtcctctctctgcacagcatttccccctcacactcattgttttatcagcctctggttttattcatgttttttctccatatgaaatagtatcctctcttcctttcaaaccagagcactctcaatcatggaaaattagaaacagcagctcttgcattcagatttttaaataaaatgtttaaatcaatggttcagatgtgaattgcaaaggtagccaggtagcgaagctgccacattcacagagaggagctcagctgctttccgcattattattacaaacctaagaaagcggattcagaaccctgctcaggtgaaggcagtggggcatttacgtcaagactgcagttttgctggactacagcccagaagcacttgctgtatttttgataatatctaaccctgtcagatggctccatggggccccaggaaacacttctactgctgtactccagctgaagccaccaccctccatccctcccaatgttttcttctggactcacccacagaaagaaggagaaaggagtcccagtggaggtcaggaacagccctgggagagcacccagagatgaattcgtgcctaagagggctcacccactacgtctcttcctcctcccggagagcacccaaagatgtgttggtgcctaagagaacttgcccactacctctcttcctcctgggccccctttgaatgcctgcaccgtgaccggggccaggagcacatgagcctaagaccattctgtgcaccagggcccatgtctgagagattaatacacaggtgcccagggcttctcctgtctccgtggtgatttacagacttagatttagatacagatattgattatggatagagacagtttagatataggcacagatgcagatatatagatatagatataaatttacatataggtataaaagaatagatttagatttcggtacaactctccctatataagtttagacgtagatacacatatagattcaggcatcgatataaaagaatagatttagatttcggtacagctctccctacataagtttagatgtagatacacatatagattcaggcgctgatataattatagagggagctctgcttttgcagtgttttgttcctaacgttgcggttaaaggaactgtattcatttcctgggggtgccacagcacagccctgcagactgggggtgccacagcacagccctgcagactgggggtgccacagcaaagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggggtgccacagcgcagccctgcagactgggcacttgaacaagagatttctctctcagcaagtcctggaggctggagtccaagatcaaggggagggcacggttggctccccctgaggactcaccccttggctgcagataccaccttctccccatgtcctcccagggcagtccctctgtgtgtccatggcctcatctcctcatctcataaggacatagctgccttgggccacggcccacagtgacatccccatgccactgcaattacctcctcaaatgctccatccccaaatcagccacattctgaggcccagggtgttggggattcagcatgagaatctgggagacccggttcagcccacgacagccaattggtccatagtgccatcttttaatcttcagaataaaactttagaagaagtgtatacaacaggagcatgagttgcataaactaatttccaatattttgtttcaaacgtcttgttttagtttttgtcctgagaacaattacaacatacatttatctatttcctgcatcttttttttttttgagacggagtctcgctctgtcgcctagactggagtgcagtggcgcgatctcagcccactgcaagctccacctcccgggttcacgccattctcctgcctcagcctcccgagtagctgggactacaggcgcccgccaccacgcccggctaatttttgtttttgtatttttagtagagacggggtttcaccatgttagccaggatgtatttcctacatcttaaggactcttttctataaacgctgaagccaaatgtgtctctagagttgagacgttccctcccagtgctacctctttgctaaggaatcctcctgcctggacactgtccatctgcctctccagatcctgcccccgccaagggcgtccgagagagcccctgagcccggcccggaccagcgcccgtgctcagggcagctgtgcgctccgcgctgccttctggttctgtgtgatggatgtgatgcttgcatggtgctgtccctgccccgctccgcccctgctgggctcctggctgccgaacctgaagtcagggtccgccgcagaacacgtcttcccgctgagccctgcagcccctcaagcagctggctgcctccgaggagcttcctctccgacagctgccgtgtacctccctgacctccctggctgtgactcaggccctccggaggcactgggccaggccgccggtggagcctgatggtggacgatggtggacagtgaccttctccttctaaggaagggactgagggagggaaagtgcccccagagcatctcaggagctgggaggtgaacagctggggatgctggcttcagtgcttcccccaccaccagcacccttatgattatactgctgcccctgcaaaaatgaccatggaaaattaggatgctgggcatgacctttctgcatccctgacgcacaagcctaactgttgttgcacggaggccacacacgtccctgatgaaagagccctgctcccgtgcaagcagccgtcagtgccctctccgtacagatggcgcagccatcagtgccctctctgtacagacggagcaggccagcaggacccagcactgtccctggatgcaccagctctgtcactgctggctggaacacccaaaagggtgatggacatggctgtccctcagttttcagaatgacagcgtgaaacccaagcctgcctgcatgaggaagggtggacacagacagcagcagaggcctcggctgagtggacatgcgctcaggtgctgagggctgagagtgacccaggagcaacagctgagccatatttacagcccctcctacgagccctggctggaggccagaggttccagggaaggtgggcaccagggcccatgtctgagagattcataaacaggtgccacggcttctccttccgtcctcacagtgactcacagacaaggatgccaaggcctggaagatgaggcatggctgtgagaggagctcacactcccctggcctgcgagagctctggccccggccagcccgtgtgctgatcgtattagacggagtctccagagaaacaggagcaatcagagatgcagatgtatgtatagaaatagttatagattagagacatccatagagacacagtttgtagatgtagttacgtagatttagatatagatatcgatttaaatatggatatatgtagatatactatatatagatttacatagattgaacatagatatagataacaaatatgtagacatagatatagttatactgatttagatatagatactgattgtgggtatatatagttttaggtacagatgcagatataaaaatatagatataaatttacacataggtatagaatagatttaggtgtagctatacctatgtaagtttagatatagacacaatatagattttggtatagatgtaaatatagaggtagttacccatacatagacatagttttacatgtgcttctagctctatgtaccgatatgtgaaagcatctctattctgcagaattggtcatgaaattagagaggctgaggagtcccaggatctgctgtctgcaaactggagccccaggggagctggcggggcagttccagtctgagggcaggtgaagctgcaatgagatgtcccagctcaagcagagagtcaggaaaagagaagtgaagccctttttcctccacttcctgctctactggggccctggaaggatgggacagggcccacccatgttggggagagccgtctgcttttctcagaccacagattccaatgctgatcccttccaggacccaactcaaaaacacagtgggaataatgtctaatctgggcgcctgtgctccagtcaagcggacacataaaattaaccatcccagtcatgttattctgacctgaattctccaaaatcccagtgccctctgtctgcccagggcctgcccaaacccgatgccgtttctttccaaaggccctcgttggccttcacccagcctcagggactcccccttgcccagccccaccagaggggcacccacgcccacagcagagaactccagggctccccggggtggcactgaagaggtcggaaagccactccggcagcagccgtgacctttgtgatgcccccgtaggacatgcaggggcttcaggacctgtctcagctgggtatctcccagaagcacacagccttcaatctggttccaagcggatttactggctcttgaaattgaaaatgccaagaaacaaaaatttggagcaaagaataaaggaaagtttctgctgtgcggcatctggccttccccctgcccaggctcgtttcacacttttgggtaaacatggagctgcttacgtccctgctgtgggtctgccgtttgctggtgtgaggtgggcttcaatcagatgctcgccacggcccaggacgtggctcctcctctcactcaaggctctgatgtcagatgcctggctttgctggtttttgaagttccacaggtggcccctccagcccaagtttctcagaaccaaatccagccggaaatgtcaaacaccaattccagaatgaatttccacggctgccctgtcctgactgccctgacctggcctgtgcttacctggaattcccacccaggcctcgatcagctcagccttccccgcacccccagccccaggcacacaggcggagcccccacctctagcagccatgggggtgagagcgagtagcagcagatggaaacaagaacccagcctctttctggatgcaggaggagcggcatcccagggccagcaagcagctctgctccccatgggcttttagcaagaggctggtgtgctcaggttgccctgcagactcccctgcgtctgtgaaaggtggcaggaaggagatcctggaggcgggaggatggttagaggagcccaggaggaaaagtcatgaggtgcaaaggctaagaggacaggatcgttttggagaaacagtcaggatgcgcatttagggtttattcattcattcttgtatccaacaaatgcttgctgagtgtccaagacccatgcgaggaagacagccacggacaccacctgtgtctgggctgggaaagacccatgataggaagacagccatggacacgacctgtgtccgggctgcaaatgagacacacctgcaaatcatgcccaggtgctaagtggcacagggaaccgcagtcacccacagacgcattcatcaccgactttaaaaaatccagtgtgagaaatagaaccaaaccaagcacccattcccccagccgctgcctctgtctggtacctgaatgtgctctcttagccccagagcctatcttcaaccacacgtgatgatgtttatccagggcgacccatgtttgtttaaaaaaaaaacgctgattggtagtatttaaattcttatttaaaagtcagttttcgtttcatcttggatttctcctcggccacctcgaatgggtatccaaacagaaaagtcggtaataaaactgtggtcaaaggagctctgagttcagagccgcagtggccccaggctggcagctccttgcagaaagcacagaagccaagggctggagcccaggagccgttactcagtccccggctttttcagatgaagacacaggtccaggtgggaggcacttcctcaggcccctcaccagatgctctggggccggctcctgggctgcctctctcctctgtcccatcaggcctgcacttctctgtctgattcccaccaaccttgttcggtttctttctggaattggctgatgagacccaggatgagctccaaaatctgctgccatcccgtgcccccgtccccccagggctccagctctgcaaggtgctgtccaccttccttcaaccacggtttcacctccaggaggcttctgggaaagataaaatgcagccaagggcaaaacctcacagcgttataccgcgtcccttacagcccaccttgcgaacctttcccgccccggtccgaggcctccagggctccctgggtcctgtggtccactccgagggcactgagagccctccctggtttgggcagcaaggtgtgctttctgtcctgcaggacgcgtccatgccgaacccacagtgaggttccatagagagagctaacttctctgccctgtgtcccctgctggctctccccacacacgtcacattcggatctggacttagtggtctaaatggcttttctgggcagataaatgtccctccctccctgcgtcatgctgtggggtgaaggccactggcccaggacagggtatggcccagactcaggcaggacaacctggcttgcccaggccctggaaggttcttctaaccaggcctctttctgtgccccagactccgggaggctccctcgggtgacttggatctccatgtcgctggctgctctgctgatcggaggcttcgcaggtctcacctcgacggtgatttgcaggtggtaagtccttcactttttgactgttacttagacacaaagcaatctcctttcctctggacatggctgcaatgaagctgctttattttcccgaagctaacacaggttactggtatctcaaaggcattgatctcagagctattttgtacaacgtaatagactctccggatctttcattatgctttaaataatgaaagtggagtgatcatttgtacaccttaggtggtgtcaggtatctgtggacgaacattcagcaatatggaacacttttctaacactaaatgattgcattgaagtagtctcttgttaggagtaaagattcttacaaaggtttctcagagaaaaaaggtcatccatgaataaaaagttttattcttcagttttattccctcccttgagggcagaaattggaagttgaactttcatgttaaaaatggcgctgctgttgaaagactcagacccgcacctgagaggccctgccctgtgagagtgctctctgcagaaagagcccctcgaggcttcctcaggtgcggcagctggtccatgtccctagccctgaggaaccggctctgttccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctgcctctcaccttgctgctcttgagcaccaaactccttgagcatcccttccatttttaatgcacaattgttcattttatatagacagtattaaaaataacagcaaacactataagaagtcattgcaggcccaggctgggcccccagggccatgcccaggatacctgcagatagaggccacagtttctcggcttctgctctccctgagtgccaggctcccccccccaatatgccctgtgcacactcctgctgcagccagccctgccctctgccaggatgacccctgcagtcaccttcgccctccaccccggccttcagagctcctcactggcggagcccccagcaccaccccataccacacatgtatggattatccaagcctcccagcctcacccgataccacatatctatggattatccaggactttcccactctaaggccatcttccagggtgtttctcatcttcccaataatagaaactcaacattctagcaaacttcatttttctagcaacttctcagtacactgaggaacatctgccccttgaacaggaaatctttttcttacagtctttgcacctcctacaggaactggtttttaaaaacttgaaagcttagcaaccagatgttacccatgatctttatcgtttccaaagggccttgtcaagaatccacagttaatggactcttttctgttgtttttatttttgtgatcacttgtaagggaagactctgtacctgccatctgctctgcatcctgtctctctggggctgnnnnnnnnnnnnnnnnnnnnnnnnnntatccggcatatgatatttcagtgacgtatttctgagtagcttcatagcttctaacaaaactaacatacaccataattcagacaactgtgagaaattccttccagtagagaggtgatagtaatggctaaagccatgtgtcagatgtaatgctaagtcatccttagccactgtctcctctgattttctgatcaatcatctgactcaggtgcttgccatggcttgaactgtgcattgcccagaacatatgtttatatcctgacctttaggacctcagaacgtaaccttatttggaactaaggtctctgcaggtgtaattagttaaaatgagactgtcctggagtagaggggcccctaattcagtatagctggtgttcctctagaaagaagagtttggacagagtcatgctgagcaggcgaaggccatcttgacgggaaggcagagatcagggtggggtttctctaagctggggcctgggaagatcgccagcagccacaggaactgggagggaggccgggggagccgcctgcaggcaccttgatgtggactcctgcctccagagctctaggtcataaactgctgtttaagcagccaagtctgtggtcctctgtgactgcagccccagaaaacttaatgaagtgctatgattgtgtccattttcagtgtagcatgtggaggtggagcgagagcctgttacttgctcaaagctggtaggcccagagcagatccttgaacccaagacctgtctggtgctggaggtcgtgccacagctgccctgcttctcctcgcgagaagattatattccacatgccagggctgttgtttcaaataatcattaccagtgaagattgaataatcacctactctctctacaagacactatactgatctgttttggaaagagagtactttaacctttaaatggtgtctctagttttagatggggtggtggcaggaaatattccctatgttttatgaatcatttggtctttaaaccttaaaaactttaataactaataattaaaaccctcagctaaccatgaaatagactaagcaataaaaattgaataggctgtaagcaaataacttcaaattagctggttctgtaattagaactatgaaatgtataattgtaacaaaaactgatacgactataatttcctattcataaacaattttgtatttgcaaacatccctataaacatctatcacattatcattataataaatattagtgtctgtagcccacactcacaagaaaaatagcaattttctttaagattgacagccatagatgaaatgaatacctttccaagggaacttgggagagaaatatttggctatagttgattttagactctggagttctaaaaatacgctaccaagcaccaatttagtttgcaaaatgccacttagctgaaagatatgaaaaagtggatgttaatgtgccatcacacgcttgagaacacaggcagttacagagtcagagaccataacagggaagaccctggggctccagggcagaaacatcctggaccaaaaccacagcacccccagacctgtgattaggtgagctcagaaggtcaagtcactcattaggaaatgtcttcccaccacctaccctgagacccctattctgctcccagcaaatgggctcaacacaatcccagcctcgcctccctgtgtcttattcttcagcttttaaaaacatgatcttatttccaccttagggcattattgtgcggtgaggagtagggaggagaacagagagggataggaagaaagagagacagagacagcagagagagacacgggaggggagagaacccagcacggtgtggcacacagcaggtgctcagcaaacacgtttcctctcctagtgagacaaaggtgtttgcttctctactctcctcgttttctacccaccctgctgtctggggtctcacactgtatgttttggtgtgattgttattaatgtgacaaattgttgatatattttcactgcaaatctacgattcggagttaactccatgaaaccaactcctccatcaactttcttgacactgcatttaaaatacctccacggtattatgcttgttttattgcattgaaattgttttcaccaagttgaattctttctgtgcaaacttttacactaaaaattcattcctcaaatcagttctttggtccatgtcagttttgccaattagacctttcgccatggaggtgttttcctttgtgttatgatttcttcagatccggctttcttagctcagcattttaaacttaaatttcatgaagactttgtctgtctgttgattcttactgtccagggaagatgctaaatgtgcagttccagtcctttctccattcgctcttgtttttattatttttaccaattctacttttccaccatcacttagttctgcaatttctgaaatacaatttttcaggttttccttgtcgttgataaacggtgccctatacctttttgctgttttcagttgtattttgtattgatattcctacctatggtatgcattataaattcaagaaagtttgaatcatttgcattaatttccagcaaatccatgggaaagccgcgaggtccttccctaggatgcagccaggtttgtcctccgtccaggacgtctaaccctttgttccctcctgcaccttcccacgctgtgagctgacgggtgctgtttctctaggcacgtcacggggggttcctgccatctctcctctctttatcattagattcataagcgtgctggagggaggccagctgggactaggccgaggcagccatggggcagtgggccacgggatccctgtaagccatgggtgaccgggtgccctcttcccccaggaccctcctccccagggaccctcctcccccagggccctctttccccagactcttggggtagagacggcctgagtctcttgagatggagtctgaagcttctggtcatctgaactgcatgttgatgacaggaattgtcttcaggacgtcattagggaagtccgagagaactggccctttgctgggggacagacgtagagtggccagcctgggctacacagcatgggggatccgaacctgttgtagtggaatccttcagagtcagtacggcgtctgtgaggcactcaggccccagaggacctggggaaggacctgcgctccttagagacccacgtctgccctggaaatgagcagggggagctgttcccagcctggtcacacatgaaccacagcaaggacagcctcccaccccagtccccccgtgggttcagctaaacgcattgtccagtttccagcccagaacccaagcctggctgccaggctcatctgctttctctgggcagctcccagcccctccctctgtggccccactttcttcacccacttctgagcaagtataggtgggaaatgtgccttcctccctctcctgaccccaggctgtctactccacaccggccctgccaccgtgccctggcagtctctctacccgacaccggccctgccaccgtgcccttacagtctctaccccacactggccctgctaccatgccctggcagtctctctaccccacaccggcccgccaccgtgccctcacagtctctctaccccacacctgcccgccaccgtgccctcacagtctctctaccccacaccggccctgccaccttgccctcacagtctctctaccccacacctgcctgccaccgtgccctcacagactctctaccccacaccggcccgccaccgtgccctcacagtctctctaccccacacctgcctgccaccgtgccctcgcagtctctcttccccacacctgcctgccaccgtgccctcacagactctctaccccacaccggcccgccaccgtgccctcacagtctctctgatctgtctccctctcctgcccccagaccatctacctcacacaggccctgccaccgtgtgatgcccagccattcccacttcttggcttttattcaagcctcaatctctccatagaatactccctccttatcatctcaacctggcttcgaatgttcaagtctgacacatcgcaaaggctacacccaaacaccacccactgtctgcaacctccccaaacccccactgtatgcaaggtcctcaaatccccccactgtgtgcaacctcctcaaatcccaccactgtgtgcaaccccccaaatctcccccactgtgagcaaaaccccaaatccccccactgggtgcaacctcctcaaatcccaccactgtgtgaaacctcctcaaatccccccactgtgtgcaacttcctcaaatcccctccactctgtgtaacctccccaaattccccccactgtgtgcaacctcctcagatccctcccacgctgtgcaaactccccagatccccccaactctgtgcaacctccccaaatctccccaactgtgtgcaacctcaccaaatcccgacactgtgtgcaacctccccaaatcctgcgcactctgtgcaacctccccaaatccgccccaccctgtgcatcctcccaaaatcccccacactgtgtgcaacctcctcaaatccccccaactgtttgcaacctcccaaatccccccactttgagcaacctccccaaatccccccactgtgtaaaacctccccaaatccccccactgtgagcaacctccccaaatccccccactgtgagcaacctccccaaatccccccactgtgtgcaacttccctaaatccccccactgtgttcaacctccccaaatacctcccattgtgtgcaaacaccccaaatccctcccactctgtgcaacctccccaaattacccccactgtgtgcaacctcctcagttccctcccactctatgcaaactccccaaatccccccgactctatgcaacctccccaaatcccccccactctgagcaacctccccaaatccccaccactctgtgcaacctccccaaatcccccacactgtgtgcaaactcctcaaatccccctactgtgagcaacctcctcaaatcaccccccactgtgttcaacctcctcgaatcaccccactgtgtgcagcctccccaaatcccccccactgtgtgcaacctcctcaggtcccccactgtgtgcaacccccccaaataccgccactgtgtgcaacctcttctaatcccctcactgtgtgcaacctccccaaatccccccactgtgagcaaactcctcaaatccccccaactgtgtgtgagctccccaaatccccccagtgtgtacaacttgcttaaatccccccaactgtaatcaacctccccaaatcccccctactgtgtgcaaccttcccaaatccccccactctgtgcaacttccccaaatcccccctactctctgcaaactcaccaaatcccccccactctgtgcaaccttcccaaatcccccccattgtgggcaacaacaccaaatcctgccactgtgtgcaacctcaccaaattccccccactccgtgcaacctccccaaatacccccaactctgtgcaacctcccaaaatcccccaaactgtgtgcaacctcctcaaatccccatcctgtgtgcaacctcctcaaatccaccccactgtgtgcaacctcctcaaatccccccactgtgtgcaacctcctcaaatctcctcacagtgagcaacctcctcaaatccccacactgtgtgcaaccaccccaaatccccctactgtaagcaacctccccaaatccctccactctgttcaacctccccaaatcccccccactctgtgcaacctccaactttccctcccattgtgtgcaacccccccaaatccccccactgtgtgcaaccccccaaatcccacccactgtgtgcaacctcctcaaatcctcccactgtgtgcagcctccccaaatcccacccactgtgtgcaacctcaggtcccccactgtgtgcaacccccccaatccccctactgtgtgtaacctcctcaaatccgctcactgtgtgcaacctcctcaaatccccctactgcctgcaacctcctcaaatccccccactgtgggcaacctccccaaatccccccactgtgtgcaaactccccacattccccccagtgtgtgcaacctttacaactctactcactgtgagcaacctccccaaatcgccccactatgagcagcctcctcaaatcccccaactgtgtgccacttccccaaatccccacattctgagcaacctccccaaatccccccactgtgatgtaacctcctcaaattgcccgcactgtacaacctcctcaaatctcccccgctgtgtgcaacctcctcaaatcccgactctgtgcaacctccccaaatccccccagtgtgtgcaacctccccaaatccacccaactctgagcaacctcgccaaatcccccaactctgtgcaacctccccctatccctcccactgtgtgcaacccccccaaatccccctactgtgtgcaacctgctcaaatccccaaactgtgtgcaacctccccaaatcaccctcactgtgtgcaacctcctcaagtcccccactgtgtgcaatccgcccaagtccccccactgtgcaacctgctcaaatcccctcactgtgtgcaacctccccaaatccctcacactgggtgcaacctcctcaaatcccctactctgtggaacctcctcaaatcccccccactgtgtgcctcctcaaatcccctcactatgtgcaccccccccaaatctcccccactgtgagcaaaaccacaaatccccccaatgtgtgcaacttcctcaaatccccccactgtgtgcaacctccccaaaaccccccactgtttgcaacacccccaaatttcccccactgtgagcaaacccccaaaacccccactgggtacaacctcctcaaatccccccactgtgtgtaacctcccaaaatccccccactgtgtgcaaaccccccaaatctccctatgaccaaaaccacaaatccccccactgtgtgcaacctcctcaaatccccccaatgtgtgcaagccccaaaatcccccccactgtgggcaacccccccaaatcccccactgtgtgcaaccccccaaaactcccccactgtgagcaaaaccacaaatctccccagtgtgtgcagcctcctcaaatccccccactgtgcgcatccctccaatcccctccactctgtgcaacctccccaaattcccccaactgtgtgcaacctcctcaaatccctcccactctgtgcaaactccccaaatccaccccacactgtgcaacctcctcaaatcctcccccactgtgtgcaacctccccaaatcgccccactgtatgcagcctccccaaatcccccctactctgagcaacctccccaaatccccccactctgtgcaacctcgccaaatcccccacactgtgtgcaacctattcaaatccccccagtgtgcaacctcctcaaatgcccccactgtgaaaacctccacaaatccccctactgtgtgcaacctcctcaaatccccccactgtgtgcaacctccccaaatcccctccactgtgtgcaactgcccccaaatcctcccagtgtgtgcaacctccccaaatccccccactgtgtgcaacctcctcaaatcccccgccactgtgagcaacctcctaaaatccccacactgtgagaaacctcctcaaatccccccaactgtgtgcaacctccccaaatctccccagtgtgtgcaacttccctaaatcccctaaactgtattcaacctctccaaatccccaccactgtgtgcaacctcccgaaatcccatcaactgtgtgcaacatcctcaaatccccctcactctgtgcaacctccccaaatctcccccactctgtgcaacccccccaaatcccccccattgtgggcaacgtcacaaaatcccacgatgtgtgcaacctccccaaatcccccacactctgtgcaacctccccaactccccgactctctgcaacctccccaaatcccccacactgtgtgcaaccttctcaaatccccctactgtgtgcaacctcctcaaatcccccccactgtgtgcaacctcctcaaatcccccccactgtgtgcaacctcctcaaatccccccatggggggcaacgtcctcaaatcccccgactgtgttcaacctcctgaaatcccttcactgcgtgcaacctccccaaatacccccactgtgtgcaacctccgcaaatccccccactgtgtgcaacctccccaaatcccccccactctgtgcgacctccccaaatccccccactatgtgcgacctcctcaaatccccccagtatgtgcaacctcctcaaatccctccactctgtgcaacctcaccctatctttcccactgtgtgcaaccccccccaaatacccccactatgtgcaacctcctcaaatccccccactgtgtgcaacctccccaaatccccccactgtgtgcaacctccccaaaaccccccactgtgtgcaacctccccaaatcccccccactgtgagcaacctccccaaatccccacactgtctgcaaccaccccaaatcgcccccactgtgtgcaaccgcctcatattccccccactgtgtggacccttctcaaatcccccctaatgtcagcaacttccctaaatcccccaactgtgttcaacctccccaaatccctcccactgtgtgcagcctccccaaatcctcccgactctgtgcaacctcccaaaattgcccccactgtgttcaacctccccaaatccctcccactgtgagcaacctccccaaatccctcccactgtgtgcagcctccccaaatcctcccgactctgtgcaacctcccaaaattgcccccactgtgtgcaacctcctcaaatccctcccactctgtgcaaactccccaaacccccacactctgtgcaaccgccccatatcccccccactctgtgcaacctccccaaaacacccctcaatgtgtgcaacctcgcccaatcacgacactgtgtgcaatctccccaaatcccgcccactctttgcaacctcgccaaatcccccccactctctgcaacctccccaaatcacccccactctctgtaacctccccaaatcacccccactctctgcaacctccccaaatcacccccactctctgcaacctccccaaatcacccccactctctgcaacctccccaaatccctcacactgtgtgcaacctcctcaaatcaccctactgtgtgcaacctcctcaaatcacccccactgtgtgcaacctcctcaaatccccccactgcgagcaacctcctcaaatctccccactgtgtgcaacctcccaaaatctcccctattgtgtgcaacgtcctcaaatcccctcactgtgtgcaacctccccaaataccccccactgtgtgcaccttcctcaagtcccccactgtgtgcaacccccacaaatccccccactgtgcgcaacctcctctaatcccctcactgtgtgcaacctacacaaatgccccccacagtgcgcaacctcctcaaatcccccaccactgtgagcaacctcctcaaatccccccactgcctgcaacctcctcaaatccccccactgtgtgcaacctcctcaagtcccccactgtgtgcaacccccacaaaactcccactgtgcgcaacctcctctaatcccctgtgtgcaacctccacaaataccccccacagtgcgcaacctcctcaaatcccccaccactgtgagcaacctccccaaatccccccactgtgagtaacctcctgcaattgccccgcactgtgcaacctcctcaaatcccccccacagtgcaaaacctcctcaaaacccccgccactctgagcaacctcctcaaataccccactgtcagcaacctcctcaaatccccccaactgtgtgcgacctccccaaatcccccccacagtgtgcaatctccacaaatccccccccactctgtacaacctccccaaacccccccaactgtgtacaacttcctcacataccacccactctgtgcaacctccccaaatccccccgactctctgcaaactccccaaatcacccccactctgcaaactccccaaatctcaccccactgtgggcaaccacactaaatcccgccactgtgtgcaacctcaccaaatttccccgtgtgcaacctacccaaatgccccccactctgtgcaacctcccaaaatcccccacaatgtgtgcaaactcctcaaatcccaatactgtgtgcaacctcctcaaatccccccactgtgcgcaacctcctcatatcccccgactgtttacaaccttcccaaatctccccactgtgagcaacctccccaaatcccccactgtgtgcaacctccccaaatccgcccactgtgtgcaacctccccaaatccccccactgtgcgcaacctccccaaatcctcccactgtgcgcaacctccccaaatccccccgactctgtgcaacctcccccatccctccatgtgcaaacctccaaatccccccactgtgtgcaacctcctcaaatccccccactgtgtgcaacctcctcaaatccccccgatgtgtgcaacacccccaagtcccccccactgtgagcaaccaccccagtccccccacagtgtgcaaacaccccacatctcccccactgtgagcaaaaccacaaatccccccagtgtgtgcaacctcaattccccccactgtgtgcaaccccccaaatgccccccaatgtgagcaacccccccaaatcaacatgctgtgtgaaacctcaaatcccccaactgtgtgcaacctccccaaatcccctccactgtgtgcaacctcaagtccgccactgtgtgcaacccccgcaaatcctcccagtgttcgcaacctcctcaaatcctctcactgtgtgcaaccttctcaaatcccacgccactgtgagcaacctccacaaatccccccaactctgtgcaacctccccaaatctccccagtgtgtgcaacttccctaaatcccccaaactgtgttcatcctccccaaatcccccccccactgtatgcaacctccccaaatcccacctaatgtgtgcaacatcctcaaatccccaccactctgtgcaacctccccaaatcccccccaatctatgcaacctccccaaatcccccccaatctatgcaacctccccaaatcctccccactctgtgcaacctccccaaatcccctgctttgtgggcaatgtcacaaaatcccccggtgtgtgcaacctccccaaatcccctccactctgtgcaacctccacaaatcccccacactctgtgcaacctactcaaatccccacactgtgtgcaacctcctcaaatcccccccactgtgtgcaacctcctcaaatccccccactgtgagcaacctcctcaaatcccctcactgtgtgccacctccccaaatccccccactttctgcaacctccgcaaatacccccactgtgtgcaacctcctcaaatccccccactctgtgcaacctcccctatccctcccactgtgtgcaaccgccccaaatcccccaactatatgcaacctactcaaatccccccactgtgtgcaacctccccaaaacccccactgtgagcaacctccccaaatcccctcactgtgtaacctccccaaatcccctcactgtgtaacctcccaaaataccccccgtgagcaacctccccaaatccccgcactgtgtgcaaccaccccaaatcccccccactgtgtgcaacctcctcaaatcctccgccactgtgagcaacctcctcaaataccccactgtgtgcaacctcctcaaatccccccatctgtgtgcgacctccccaaatcctcccagtgtgtgcaacttccctaaatccctccaactgtgttcagcttccccaaataccaactgtgtgcaacctcctcacatccccaccactctgtgcaacctctccaagtcacccctactctctgcagactccccaaatccccccccaatctgtgcaacctccccaaatcccacccaattgtgggcaaccacacaaaatcccgccactgtgtgcaacctcaccaaatttctcccactctgggcaacctccccaaatcccccccactctgtgcaacctcccaaaatcccacacactgtatgcaacctcctcaaatccccatactgtgtgcaacctcctcaaatcccccccactgtgttcaacctcctcaaatccccccactgcgtgcaacctcctcaaatccccccaatgtgagcaacctcctcaaatccccccactgcgtgcaacctcctcaaataccccactgcgtgcaacctcctcaaatccccccaatgtgaggaacctcctcaaatcctcccactatgtgcaacctcctcaaatctccccactgtgtgcaacccccccagatctcccccactgtgagcaaaagcacaaatcccccactgtgtgcaacattcctcaaatccccgcactgtgtgcaacccaaccaaatctcacccactgtgagcaaacccccacatccccccactgtgtgcaacctcctccaatccccccactgtgtgaaacctccccaaatccccccaatgtaggcaaccccccaaatctcccccacagtgagcaaaaacacaaattcccccactgtgtgcaacctccacaaatcctcccaagtctgcaaccccccaagtccccccattgtgagcaaccaccccaaatcccgccactgtgtgcaacctcctcaaatcacccggtgtgcaacctgctcaaatccccccactgtgtgcaacctcctcaaatctctcaactgtgtgcaacctcctcaaatccccccttctgtgcaatttccccaaattccaactgtgtacaacctcctcaaatccctcccactctttgcaaactccccaaatcgccccactctgtgcaaccgccccaaatctaccccagtctgtgaaacctccccaaatcccccccactgtgtgcaacctcaccacatccaccactgtgtgcaacctccccaaatcccccctaccttgtgcaacctccccaaatcccacccactctgtgcaacctccccaaatcccccacactgtgtgcagcctcctcaaatccccccactgtgtgcaacctcctccaatccccccactgtgagcaacctccccaaatcctcctactgtgtgcaacctcctcaaatcccccactgtgtgcaacctccccaaatcctctccactgtgtgcaacctcctcacgtcccccactgtgtgcaacccccacaaatcctcccagtgtgcgcatcctcctaaaatccccccactgtgagtaacctcctaaaatccccccactgtgagtaacctcctcaaatcccaactctgtgcaacctccccaaatctccccagtgtgtgcaacttccctaaatccccccaactgtgtttaacctctccaaatccccccactgtgtgcaacctccccgaatccccccactgtgtgcaacctccctgaatccccccactgtgtgcagcctctccaaatcccccccactctgtgcaacctcctcaaatcccccccactgtgtgcaaccgtgctaaatccccccactctgtgcaacctcctcaaatccccccactgtgtgcaacctccccaaatccccccactgtgtgcaacgtccccaaattcccccactgtgtgcaacctccccaaatccccccactatgtgcaacgtccccaaatccccccactgtctgcaacatccccaaatgcccccactgtgagcaaccttcccaaatccccccactgtgtgcaatctccccatatccccccactgtgagcaacctccccaaatcccacttgttgcaacctccccaaatccccccactgtgagcaatctccccaaatgccccaccgtgtgcaacctcctcaaatcccccaccactcagagcaaccttctcaaatccccccaatgtgagcaacctcctcaaatccccgtactgtgtgcaacctcctatcacccccactgtgtgcaacctcctcaaatccccccactgcgtgcaacctcctcaaatccccccactgtgagcaatctcctcaaatccccccactgtgtgcaacctcctctaatccccccactgtgagcaacctccccaaatccctcccattgtgtgcagcctccccaaatccccccgacgctgtgcaacctcccaaaattgcccccactgtgtgcaacctcctcaaatccctcccactctgtgcaaactccccaaaccccccccttgcagcctccccatatccccccaactctgtgcaacctcccgaaaacacccctcactgtgtgcaacctcgcccaatcacgacactgtgtgcaacctccccaaatcacccccactctctgcaacctccccaagtctcccacactctgtgcaacctcctcaaatccccccactgtttgcaacctcccnnnnnnnnnnnnnnnnnnnnaacctccccaaatgcccactgtgtgcaacgtcccgaaatcccccccactctgtgcaacctccccaaatccccgccactctgtgaaacctcccccatcccttccagtttgtgcacccccccaaatccccccactatgtgacacctcctcaaatccccccactgtgagcaacctcctgaaatccctctcactgcgtgcaacttcctcaaattcctcccccactctgagtagcctcctcaaatcccccccagtgtgtgcaacgtccccaaatcgccccactgtgtgcattctcctcaaatgcccctagctttgtgaaacctccccaaatccccccccccactgtgtgcaacctccccagatctcctttctgtgcaacctccataaatccaaccaaatgtatgcaacctcctcaaatccccaccactctgtgcaacctccccaaatccccatcactctgtgtaatctccccaaatcccccgcaatctgtgcaacctccccaaatcccccccactgtgtgcaacctccccaaatcccgccactgtgttcaacctccccgaatacccaccactctgtgcaacctccccaaatcccaactgtttgcaacctcccaaatcccccccaatgtgagcaacctctcaaatccccctgtgtgcaaccccccaatctcccccactgtgtgcaacctcaaatccccccactgtgtgcaacgtcctcaaatacccccactgtgtgcaacctccccaaatccctgccactgtgtgcaacctcaccaaatccgtccactgtgtgcaacctccctagatcccccctatgtgcaacctccgcaaatacccccactctgtgcaagtgccccctatttccccaactgtgtagcaacctccccaaatccccccactgtgtgccacctccccaaatcccccaactgtttcgaaccacctcaaatccccccactgtgtgcaacctccccaaatcccccccaccctctgcaacgtccccaaacctactctgtccaacctccccaaatcctccactctgttcgacctccgcctatcgccctactgtgtgcaactccctcaaatccccccactgtgagcaacctccccaaaccctcccattgtgtgcaaactcccaaatctccccactgtgtgcaacctcctcaaattcttccactctgtgcagcctccccaaatccccccaactctgtgcaacctccgcctatcccccccagtgtgcaacctcctgaaatcccccaactgtgttcaacacccccaaatccccccattgtgtgcaaactcctcaaatcaccccgctgtgtgcaacatccccagatcccccccaatgtgtgcaacctccgcaaatccccctactctgtggaacctcctcaaatcccaactgtgagcgacctccccaaatcccccaactgtctgcaaactccccacatctccctcactgagtacaacctccccaaatccccccattgtgagcaatgtccccaaatccccccactgtgagcaacctcctcaaatccccccactgtgtgcaatctcaaatcccccccactgtgtgcaacctcctcaaatccccaccactctgtgcaacctgcccaatttcccccactctgcaacctcccgaaatcccccgtagtgtgtgcaaccttctcaaatccccccactctgtgcaacccccccaaatccctctactgtgtgccacctcaagtccccccactgtgtgcaacctcctcaaatcccccacactgtgtgcagcctcctcaaatcctccccactgtgtgcaacctcctcaaatccccgcactgtgttcaaccttctcaaataccccatactgtgtacaacctcctcaaatcccccctgcagggagtggcttctccctgtgaatctctcctcccttctttgcccagaagcatgtctcaattagtaagagtgcagttaatatttctcatcttaaggtggtgctccgacctgatacaaaggaaagcgggttgaattcagaggcacgggcataccctgtccttgtttctaaagtgttcatgaagaagatcgaattcaaatggtgaaatatccatatatgcaattgtatagaaaagtcaggattatttgacaaggattgtttttgatgcttttatgcaattcagaacctcaatgaatatagaaaataatttaaaaagacataagagctctctagattgaaataagcatggtgcttataaaacaatggtgaacagtgaatgccaattattttaatttaaatttctattatgcagcaaattcataaaatggggaaagtcttttttcaacatttccaagacatgctctgttaagacatggttgcttcaggtggcttttacttgggatattgagaggtaaggcagagtggtgatggttcaggctgaggagggcgagggctgccataacaaagaaccacacgtttggtggcttaaagcaacagacgttgatgttctcacagttctggagaccagaagagcaagtcacggtgttggcagggctttgctccccccgaaggttggaaggacgaatgcgccttgcacatccagcctttggtgccctgctggtgttcactggcattgcttggcctacagactcctcacgccaacctctccctctgtctttacccggccttctcccctgcgtgtctgtattcaaatgcccctattcctataagggcaccagtcctgctggattccaggttccaccctaccccagtatagactcaccctaactaattacatctgaaaaaaaccttacttccaggcaaggtaacattcccaagttctgggtggatgtgactttgaaatgattatcaagtagatccagttccgtttacagtaatgagcagacagtgaatgagaaattaatgtgctttcacatcgcacgaacacctgaccttcactgaattttaatagaagctggcattggtgctaactccttacagactttatgtcagtgtattctcactgaaggaagttgctattttatcccactttacgaatgagaaaactgagatgcggagaggtcaccaagtcaaactcaagcgacaccccagcccccctcggtgatcaggctgaagcgatgactaaatgccatttgctcctaatgacaccgtcacaagcactgaagccaccaaggaccgttgggcctgtacagaggagaggcagactcaggccctccccactgacaggagggctgtcttccatgtacacctaggtcggagtccgcaagggtggggcggtgacggtgcactggactttgctggcggtgctggaatggctatgcggagggcgctgtggtgcggggactgcgctccccaggaggacctcgggagttgtttgtttgtaggtattacagtattgtctaacgttgccgcgttgacacagggtcacgggaagccacctccagggcctgtggtcctcttcaggcaggcggggcggggaatgctcaggaccggtgatgatggtgccatgcagagttcagggatgaatgaccaccaaggcaagggaaggagtccagcagctcagtatttggggaatgggggcgggggcaggtaaaaacgcagaatcaagggaaacaaacagctggaaaatatagtagctgttaagttctgatggaaaagctgttttgtacttacagttaaatcccacagtatttgtgatgtatttccgggtaacttgctcttccctcctcaaaaggtcccagcctcaccagagcttcccttcctgcaccggccccagctctccacgcctcccagagaccagggggcctccacccttgctcctctgggacggcgcttcctccccctcatctccaggtcggggctggggtcttcaggctcaggttgaagatgctgttgggccctttgcctgtacagggatggcgcccgacccaggaaaagcctaacgttgtctgtcatttggatgcgtctcttggcagtgactggggggaaatcctcactgcagcccgcgtcccttgcatgattgttgtaagaaagccccagctcagctgcgtggagacagggtcctcttggctgcaaattctaaaatcatttttcctatgaagagagcagtgctaattttttccaaaatatatcagattatgatcgacttgactgaagtgtgaaatgaaagtgggttggagtgttcctgccaaagacaagcacggctgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccaggccgtagggacctcaccgcagcgggccgcagctcaggactcggagcaggtgggccacaccatgccgcatgtttccagctgccaccgcagtggttggacaggatctgggtgtcggagcagctctgctggggctccctgcatatttctgtttactccgtgtttcctagtccgttctgcaccttcctccgggaggttttatttacaagctaatgacagtgagccagaatgtgagcctgcttagtgagaggaatgaagatgccttccatttgtacaaaccggttccaaaactaagggctcactttcaggcgtttgcttccacttaatctgaggatcggctggaagcacaggagaggaaggagaagctgaagcaaaaccctgacttttaaattctgatttttaagtggaatagttataatcagtgtggaaaaatgtgtatgtttatgttttacccccttaccttgtatgcagaaccccaagggaggccatatcaaaaactcacttgtgtaagtctgacttttgaactgagagaagcagagagcagaacagtggcctccagaggggagtgggggaggtgctggtcacaggcacaaagtctcaggcaggaggagggcgcctcaggtctgctgcacggcatggggcgcacgcttcctcataatgatcgcatatttcaaaattgctaaaacaataggtttttttttttttgagatagagtcttgctctgtcgcccagactggagtgcagtggcacaaacatagctcactgcagcttcgaccctcctgctcaagcaatcctcttgcctcagcctcttgcgtggctgggtctacaggcgctcaccaccatgcctggctaatttttaaattttttacagagatgcagcctcgctatgctgcccaggctggtgttgagcccttaggcccaagagatcctccagtctgaaactcccaaagtgctgggaccacagccacccactaaaataatagattttaaatgttctaactgccaaaaaaagatgtgaggtgatatgttaattaatttgatataatctctccacaatgtaaaggtatcaaaaccatgtttaaaacataaatatatgcagttagtatttgtcaactaaaaatacaaattttaatttaaacaaagtcacttacttgcatacaggaggggggcattgccaacatgatcggtctcccttctgaaattcagtgtgagattagatcctgtcctcggagataagcagagcccagggtcgttctgctgagagcacattcgtctttgcacctggctcccacgcatggaaccaaaaggacctggcctggaagtgaggctctttgtgaatttaaatagcttttccagccacagcaagggcagtgccagcaagtcccctgggcccctaattagtctgactgacaccaggggcaaggccaggcgttctgttcatctgtggtcgcagggacctgtgtgctcagcacggcttcttcctgaaggaccctgcctgcggattgcagatcccactctgtgagtaggaacctttgccacgtggatcctctgtggcctcctgcaaacaagcatttgtccggaagccagaaacttccctccagcatgacaagcaagaaggatggctcatctcgccagcggtcctttgtgaaaagagctcctgtccaggcccttctgtcttgtatcaagtgtgtgctgttactggagcagtcagaattcagacgttattaatgtttgttctgcatttttgcaggagagtgctgggatggaaggccgggatactcacaggctgccgagagccctctgagggcaaagtggcaggacactgcagaacagcttcatgttcccaaaatcaccgtacgactcttttccaaacacaggcaaatcggaaatcagcaggacgactgttttcccaacacgggtaaatctagtaccatgtcgtagttactctcaggcatggatgaataaatgttatagctgcatttgtctggccttttcttgtaaacattgcctgatttgttccttctggggctttgccattaaaatgtatttacagattacacatctttattttgtgaaccctggaaacaccactcttgcaatcctcctgtctccaccttctggcatctctgatgccgtgctcgtctgcactctgccccggcggtccctccagcactggtttttccacaccccctgcccatcaccaggtgtccacagggcctacatctggcttccctcttctcctgggaagagcactcctggcttcctgcagggccggtgggaggaggaaagtgattctgagggagaggctggagccttaaggaccaacaaggcaaagtgacttgtctcatcctccagagattcaccaacacatgagcctcagaccccaggcttctgcctccagcagccgccctgccgcacactgctcttactcctccttataccctcactcacggggaacacagcccagtgatcccggaggaaactcactccctccctgactcaacaaggcagtctcgggggcaccgttagccacgcgaccctgtaaagctgccgtcctcatttcacatgtgaagcagctgaattccagagtgctgggtcccagcccaggcagccctcagcctcacgcaaggcaatagttaggagtccttcggcattgaaagcaaactcagacacatctgacctggagttctacctgcactaagagaagagagtggtaactaattcatggataaaacagaccatcgaggcagcactgaatgatctcacccacgaatgacaacagtggcacaggagggctatgaacattttgcttcaggatgttttatttcgctctactgttatgtagagaaagcatggtttgctttttataacttttgtgacccaaaaataccagactgttgttttccctaggtgccaggccatcctgttctgtgtgttcccaaactcttagttttgttcatgtaaaactcatgatttcataattaaaacaatattaaaataaaactcatgaatgatttcataattaaaacaatattaaaaatatcctggcaaatttcacaaattgcccttatcacaccggtaagcagcccgttctcacactgccataaagaaccactgagactgggtcatttagaaagaaaagagttttaactggctctgggttgcgcaggtggtgcaggacgcatggtgctgccatctgctcggcttctggggaggcctctggaaacacagtcatggtggaaggggcagggtaggaggcccatcacaggctgggagccaggagccgggaggcagaggggcagccacacatggagaccaccagatggcaggggactcactgcacaggaccaagaggggtggtgctggacccttcctgagaacccaccctgtgatcccaccgcctcccaacaggcccctcctccaacactgggagtgacaattccacatgagactgggtgggacacagaccaaaccatatcaacacccagggaagggacaggacccagcttctgcagaggagctgctgagagttcccatcagcaggtgaggagagacgcagggaatcgcagcaacgcacaacacatcagcacccgctctgggcagtgaagggaggtggccgcccaacctcaggatcatttccacgaagggaacacaggcctcctacttccagctgctgccctgccatgcactggaacacactgactggggagcggtcttcccttccacctcggagcctcttgctgacaccaaaacaaggaaccctggcttgatgcggtgcctgcatgacctctgccctctgggatt

SEQ ID NO: 11825 - DNA, 20804 bp, Human
ccatattttcttaatccattcatctattgatgaacacttaggttgcttccaaattttagctttgtaaacagtgctgcaataaacataggagtgcagatatctcttcaatatattgatttcctttcttttgggtatatatctagcagtgggattgctggatcatatatgtggctcaatttttagttttttgaggaaactccaaactttgctccatagtggttgtactaatttacattactaccaacgctgtatgagggtttccttttctccacatccttgtcaacatttcttattgcctgaattttggacataagccattttaattggggtaagagggtatctcacaatagttttgatttgtacttctctaatgatcaataatgttgagtatcttttcataagtctgtttgccatttgtatgtcttcttttgataaatgtctgctcaaatattttgcccatttttttattggattattaatttttttctatagaattttttgagcttctcatatattctggatattaatcccttgtcaaatgggtagtttacaaatatcttatcccattctgtgggttgtctcttcacttcattgattgtactctttgctgtgcagaagatttttaactagatgtgatcccatttgttcatttttgctttggctacctgtgcttgtgtggtattgctcaagaaatctttgtcaagaccaatgtcctcaagattttcctcaatgtttcttcattgtagtttcatagtttgaggtctcagatttaaatatttaatcaaatcattttttatttgattgttgtatatggaacgagatagggacctagtttcattcttttgcatatgggtatgtagtttgccagcaccatttattaaaaagactgtcttttccccagtgtatgttcttggtatcttggtgaaaaatgtctttactgtaggtgtgtgattttgtttttgggttctcctgttccattgctctatgtgtctgtttttaggccagtaccatgctgtttttgctactatcactccgtagtataatttgaagtaaagtaatatgattcctccagttttgttatttttgcttaggataactttgcctcttcaaggtttggtgttccatataaattttaggattttctttctgtttctgtgaagaatgtctttggtattttgataggaattgcattgaatctgtagattgctttaggtaatacggactttttaacaatcttgattctcccaatccatgaacatataatatttttccattatttggtgtcttcttcaatttctttcatcaatgttttgtagttatcattatagagacctttcattcattggttaattcctaggtatttaattttatgtgtggctattgtaaatgggattacttttttatttctttttcacatttttcactgttggtatatggaaactttgctgattttggtatgctgattttgtatcctgcaactttactgaatttgtttgtcagctctaatagttttttagaggagtctttaggttttattcaaatataagatcttatcatcagcaaacaaggataatttgacttcttcatttccaatttggatgctctttataccttctcttgcctggttgctctagcaaggtaatatgttgaataacagttgaataacagaataaaaaaaaatctctgcaaagtaaacaaatctcactagtttatctgacttgtattccaaattagtgcttctggccttttcttaaaactttaagcatcacaaggaaatcagttggaagggaatcatgtgctgatcaagtccttaaagggcagaaatattcactgaagtgaaaaggattagtaaagggtggaaaaaaagaccagccccccgcctagtttgggtgagcagatttgggattaattatcaggcagcaatccacatgcacttaacagttctgacgtgagaggacaagaaacacaagcaaatataaaacattcaattctaagagaagttcatcagagacatccttcaggattgtgaggtactggaaagaagtcctatggggagtgggtggacacgtgccaaaactccattagtgtaagggactttaaatcacagaaattaacttgctggaaatctgttcccaattcttccttcagctccaaggttaaattaaatgtaattaatgatggtgacctgctaattcatgcttttgataactgatatctagtatgtatatatatataaacaaaatgacgaggacagggaatttaattatttgggtatcacacatgcaggtgttatatatgccaaattttaaaggtaaattactacttttattatttgtgtgaaatgtcattttacatatgggttccattttgaaagtggtttgggaagggggcataccattttaagtaccaagaaaaacttgcataatctcattttactttctctttttcagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcataggtaagtggagatatgaatgagttcataagtcctgcatgagactcaaggctcttaataaaatcttaaatcatttgagctggaggaatacctggaaatcatatagctcaaccctctcttttcatagttgaggaaactgaggcttagaaaggttaagaaacttgtttaatgtaaagggttggagttgaagctcagaacttctgatcaatattttattctgaaacatttattgagcaaccactatatcctaggaactgtgttaggtattatgactagtcaattcagtaactccttcaggtaaacatgttaattgtcatagatgaggttcagaaagttcaaatccacacaggtgatatttagtaaacctggaattcatgctgagatctacctagcccttatattttagttctgcaactacccctgctgacccttaaagaagtttcccaccatgatgatcaaattcagcatttgagatgaagagtttggcctgcagactaaatagcattaaataacaaagcactaaacagtaacagccaacaatatttgattgtgttctatgtgcgagatagtagactaagggtttaaatgaacatgtattgagtccttactatgagttaggccttgggctaattgctttttatgtgtgtggtctttgaactttcaattctgtaaagcaagtattatttttatccacattttaatgattaaaaaaaaactaagacttggaaaaatgtgcccaaagtcatagaataattctctggtcttaactactatgttatatcacctaattttcaaagatttataatgttaaaaagacagaaaattccaacaaaaatgccaacagtgggcagaaatcaacatgacaaggtcacagaaacataaaatccataggtaagattaaagaaaggtaatataaatcatgcagtaaattggagagagaaaagggaagaaagagagagaaagcaggcttgaagaaagggttttagttaaggatatttttaaaagtgtaaaataatttaaaacacatttgaacagatggataaatgggtcgtggtgtgttacaagatgattatgctctttctctacccatccccgcaaggcagatgttttcatgcttgaattttgtatccctaaagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggtatgtaagaagcatttcagtttgcagactctttacagacaagatgccttgtttgtaagtgattttaattcactagttttcagaatcatcagaacatttgatgaaaaagcaattttatgttactaacctgtctttggcatttcgttttctccttattttggttacttgttaattaatctttatcttggtgaagtgaaaataaagcaaaatcaataatgagcaaaatgagacatttgcaggaatgaattaaaagtttaaaaatattttgcagtttcattgaaaacatgactttcataaagcttgaaacagaagaatctcatttgcatgtcttccttctctactaaatataagcagattcctcctcctggtcaagtgatgtgggttagagacttctcaatctttccagtcctaaatgtatatctcatcattccagcgatgattccctccaacatggtatagggtttaaatcatgaaaaataattcctttcaatttagactctcatattttcattgaactatatttttccacgttccctaccctttgagtcttacagaagaaacctattaaaatatcacatcactatataagaggacagatattttaatttgcttggctatagtaatcactttactatgtatacttatatcaaagcaccatgttttacacctaaaatatgtaaaatttgaaaaaaagttgaaaaatatcaaaataattatatcagtcaggcaatatttttagtgaaaagacattggctttttatttggcacaaagtgaacctcaactcaagcagttatttcatgcttattttctaagcagataagcttcaaacatattaaagtatctagttacgtagattctttactcttatttcttttaccaactgctctgttccttgagaaaaatatggaaattttaaaataaaagtttaagttgttagatctcaactaggaaatccacaaagtaaacctgttttctatgtgaaataacagcaatgaatctcccccttcaagttaagatataaaaattaagctaaaaatatctgaagaagggaaaggcgtttagattcatttattaatttgcagaatgctgtgccagcattattccgagaaaaaataaatggttagaagagagagaattaatgcactaacatacaggataaaatattcttttgaaagtacactatccatttgcagtttgagagtgattaaatgaattcatctgatactctgaacgtcatattttatagctctgattgcaagtaagacatttagtagattatagataaatctgtcatttgtaattgactgcagatcttcatgccttcaagtcattttctcatgggcacaccaaaatgaaagggcaggtggaaagtatctaaaagcttcaattttgcctgtgtaaacttcaacctctatgacttacattttaaagacccaacagcacaagggatgcaacaaattagaatttaaatgtaattcgtggttgaaatgccacatgaatatgctctggctcccaaatgtcagttgctgaaccacaaaccgattcttaatgatcccttggaagctgtcactaatttttgtgaaccacaatgatggcttctaaaggaggactacaaacccctggagaccaataactggggataacttggaaagcttttggctctctaaaacacccaaggataagaaaatgcttcctaggaagggatttaaagtgaaaaagtagaaatatactgagtgcttgagagataagataaaacaattgcaatccctacatttaaatcccataccataaatagaacttctcaaggcaccaaagaaatgagaaataacaaggaaatgtatgttttaaagaaccgaatgaaataagcatgtgatcttgaggccagcatttttaaaaatgtgagatcagctttgaatggaaactaggtctctgatctaaaaaacaatgggcagaaagatttactctgcttctgtttagcatttttatcagtataaatttaggcagaagcctgagtcttaaaagtttagattctaaggcagggttccctaaataaaacaccttccgtgctcagtgtgaaagagtccattggcctgttgccaaaccagaatctaaatgcctagtcattcaaattaaatttaaaaacagaagcaaaacaaaaattagcactccacaaaacatattttaaggctggatctggctccagactaagagttaatgatgcttgaattaaagataggaaaatggaagaaggtggaaatgccaagaagtggatgttgttattgataacttttttgtataaccaatataaatgtaattatctgcctaaaaaagaaaaagaagaccctttatccctttaaatcattttcagaaatgtctgcataatgagttgagtttcattccctctaatgcctaaatgacaccttgtaataaattaccagctttgttaaataaggttttaactcctctgggcccctcagacaccgttgatatactaaccagtaccttattgtctgaagagagctaatagaaatagactgtcagagagtagaccaaacagaaatgaataattgtaaacagaagcagagagtattaatgtggtttctgtgatctaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagtaagttccaaatgatagcttggagtcagaatttctttttagataaagagattaaatatgttgcctgaaaggcccttcattctactagagaattcagactaaaatctacttttattatagagtaacagtgtaccaggcattcattaaacacctagaatgttcaaggtactctagaagttgctccaggggaaacagaaagtgcctacacatttttacactgcctttcttgagtagtttggtcaatatcttgctaactttcttattttggaaatgtctagttgtataaactaatcctcttagttttcttagcactacttagaagtcatgtgtcttgtgttggaatttcacagaaaatgtttcctaagaaaatgtgaaaaataggcaaaaagttggaaatgccctgggaagaaaaaaaagaaaagaagcaaaccaaatgtatgcttgcagttataaagttagaaaacaaaagctgatatgggggatagttttcagaaaaggagtatattgtactgatgtctgccccctagctgctttccagctcttccaaagtgaacacagtaagagtacgcctaatcagttgtcccagcatcctttctccagtgatctgaatgccaccactgtcacaggtcaagtttctgccacatgtagatctcttcctgagctttctgttctcctccttggatcatattattatttgtgcctgtggtagtaacacaaggtttaattattagacaccccctacctcatcttatttttcttcttcaggcatgtatggctcttttgattgttcttccatataaaaataagagttatgtgaatttgttttcttattataatcaccacatacttattctacatgtattattttatgcatcaagtattaaattattttatgaacttaaataagaaatactctaaataaatcagcaggaattagatacatattttcaccattagattatttagcaatgtataggaataagagaagtgataatatatgaaaatttcctctgtagaagtttaaaacttagaataaatttgtatttgtttggtatgctgaatgcatgatcccaccttgtggcagagaactgaaattgaggatcaggatgtctgcagatgccaaaacgtttatactctttgtgaccaggccattgtattttggcctgagagttttctagacatttcccaatcaccctgatgattggataccaaaataaaacacagtttaaatgagtgaatgcaatcatagcacaggagggggaagaaagaggaagagattttcttttcatcataatttttcttgtcaattaatataacaagtctcctaactcagacacatagtctcatgacaaattgaagaatatttattttaggttaaaatatttttaagattatcccttgtctcactgcaagagataaatggcagacattttatttataaggcaaaggaaagggaaaaactatcattttattgaacatatattatgtatctgatatagtatgaaatgcattgatatagtatcctatttagtcttcataacaattctctcttctattactgttcttctttaatgatcttgtccatttctgtagttccattcgtcatcttttactggagacccacacgtttccacctttagataaaaccttctttctttaaatattccatacccatgtcttcacatgcttgttgcatagtatttctccaatattcaaaattaatgcgccaaacttggtggattgaaaatagttaatattttattgcagctaacgttcttccagccaccaaaataccatctttgaatcaacatagaaaaacactgttctttattcacagtacttctcaaatatattttcttcttcagacatgggcaactttccatttatttttatgtggaaattccacaggactttggtccataggatgttaggtgcaatggcagagtttgtccatatgcaaacaaatttaagaatcactggaataaaaaacaaactggtttattttttatataaactagtttctttactgtcagcattttctacaatggaactctgtgagggcaaattagaatgtaatgttttgaaactcaagtaattaatatttgtttcttgggatttattgatagcttcctgagcagtaatccccaaaacatcagcttgaattgatagtctagctagtgatggtgaaagttttgggtgataatgtacactcaataaatagtttccaatcccacctgaggcatatgttttagttacatattatttaaatttcattatgctaacttaacaggttctgattattacgttaattataaagcatagaacatgggaggctttctgaatgaaggaaaaggaatatgagttgaagttgtaaaattatctctcaccagcttagtggattgttttgcttgtccctttacggtacatatattcctttctggagaccactgggacagaatgatgcaaaattttcctaaccaatcacctctcctcccacccatctaaggttttgacttctctccacttcctaataaatcacacataactttcttatcttgatacttgatttttttttcacaatatagctctggtctagcttcttttctttcctacagtccactactatcctggcacatactccaggcaaactatttcccaaacaggccctccccctttttttgtttattttacagctaacatgatcttttccatataatgacaggcaccaaacaactcttcagcacctattcaatgccaggtactgtgccaagtctgtgggatacaaagtttttttttgttacagatagggggtgttatagacagaagaaagtgtatcatctcttgccatttcctctgcctaaaatgtttgtcttgtaaaatttatttcacctaagaaaatttttcttaatcctatggggctttgtgtaaatctctcttctttataaagcctttctggagatctgactgggcaggatctctctctctctttccctgctccctcccaccatctctcttctttaaggctcctatcatattatctatccctagtatcacagttctttgtttgttactgcccttcacaaagtttcattatttctcacattaattgctgaaaaagttgaaaaatgtgtgttggttgacatatgtatcactttccaaagaaatgtaagggttttttttttccttatttctctgaaggtttaaatagacagcatttgcatacaaaatatcacatatatgtgacatatagattttagtgtagaactagatttatgagattattttggcaaaattcaattttccatggaattttcattttaatacattcttgtggaagaagcatatattgatttaacaaatatcaacacctgtatctgttagtgtgattcttttttttccttcagatacttttatgtatctcatatctacttgattcaaagaaatgggacatggtaacttagattttctcattttaatgctaccaagtatgcatttttaaattttcttttctaccaaggaaaacctatatttcatattcatgctatgtataaagttttaaagagcgacaataagaactccaaacattgtgtaaatgtttccacatcccatttttttctgcaggcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggcaagtaaatgaaatcagtatttttaaaagatctagttatcagagaaaactgaattattcaaaagcaagtttctttgagaaggctttgaatagtatattaatcctgtgtgtttatgtgaatgagattttctattatgatacacctgcttgaaaaaggaactttcttaaaaagaagagtcaaccatgaagctcttttcattataggtgaagcccttggaaatcatgctctaatttcttaaacacccaaaaactttttaaattcaaatttctggtagctagctggccaatatgtaactatatcaaggtctctagcattggcaaacaatattcaagactttgacagtgtattaaattagtttagttttttttttaaatagagtaataaaaaaaattccaaacaattagttgacactgagtaaagccttgcttgcgcatatgttttatttaggtccgtattaacctgtaacttttttcaaaggtctgtacaaattcaaattagcatctactgatgcttaacttggttttccttatttcacacaaagtattttaaagctgaggaaagtgaggtataaacaggtaaaattactatcacaagatattcagctagttactaacagagcgtaggttcaaattcaagttttcaaaatccagtgtctttgtataataaattttgatacctccaaatgatgcttgatatatatatatatttaaagtcttcaaaagaatataattacttttatcttataaacttgttattgttaaatttttaccttcaatatagcattgtccatgtctaatgcatcccatctccccaaaaaatgcaaatacatttctctgccctatgatcagagatacttggtatacaaatctaataattatttttaattctctcaccttttagtctcaaaattatatgccattttaacctatttttgatcattttaataactacctgaatgcactgatttgaatatgattcaataaaaaaaatcactatattttggctaatctgtaaactaaggccatcagcactgatgttttaaaagatgtacagattgtgtcttcttaatgcccaatcagaagacaattatacttatttcctgacaaaatgtataaaaagacgagtgtcaagccacgttccatatatatcacagacaatctttaaatgtttttgagtcaaataacaatggaatagatgcttgaaaaaatgcataggtggctaaataagtggctacaactatacaattcatcttagatgaagagagaactggttaacatattttaaattctgatttcattttataatgcacaacaattccctgatctcaaccctctggtccttcaacccaattagacagcctacattatagaccctccatttttatttatgacctgtcttataccaatccttgttttctcccttatatatggaatatatatatatatgtgtgtgtgtgtgtgtgtgtgtgtgtgtgtgtgtatatatgtgtgtgtatatgtatatatggaattgagatatttatcaaaagctgtataaatgttttgacagtaggttttcccgatgtttaaaactagcacaaagatggaaagaaagccctgaggaattgtagcttccccacaaaaaatagttttccaaaaataaacgtgctaacagtcattcaaaaataaggtaggaggctgaagtaacatctggcaacttaagttccaagacaaccagagcattcttctcccaattgtgtcagcagtttttagcagaaactggagattttcactatctttattcccatgtagaacaatgtctgccttgtcaaatagagtgtctatatattttgactggtatcctttgcaggtcattatttttaacctggaggctacatttagaatgtcatgccactagcataaaaccagcctagctctgggtatagcaaacaaatgtcatcaaccataggtacagagaagcagtgctgttatattaaggcaaaaattggcctgacgagccttgaaaaaattgtttcccaatataatcattgctattacctggaaaagtgaaatatttgcaatagttttactattctcctccttaccatgtgtctaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctggtaagacattttcatatgctttttgcatgctcagctgggcggattgtttagatggcatagttatcagttcaagctgagcactcagcgcataaaaacactttcaaaataaggatagcatagctgtaatatcaagtcacttccagacattcaattctactttgaaaatgcaggcaagaagtctctccaaatagttattataggatgatatttttaaccatttgctgggactaaccaaatcatctctcctaatttttgctacgaaaaaatggctactatgtttcacaaattgttcttaccctcatcttccaacataaattctcattacttttaaatataaatgaggaaaaccttatagagctcttctttgatatcccaaaagactaaaaattgtatacccataatccacagttcttatttttattacttaatggcccctcacaaatagaaattgtgttccacttgaaaagttaatgttggcttttatatcacactataggaaatctcttttaagttcatttcaatgcattctttaaaatactatttaaaaggcctctttctctgccttcctatgcagctgagaggctagcattatttttcaaacaataaaagtgcttccactggttaaaacatcgcaaattttcataggttgaaagcattctaaattttggcttttgtgcctttagctcataacgcacataaacctgatattgtagcttaactacctattgatttatgtatccattaggcatgctttcatttctatgtgtgtatgtgtgcaataacgtcctctaatccaacctaattaggaccattaattgatgaaattgatgaaaatagtttgttccatcaaaaattatttaagaaacaacttacacataagcctgtaatcgcagcactttgggaagccgagatgtggggatcacttgagcccaagagtttgagaccagcctggtcaacatggtgaaaccccgtctctactaaaaatacaaaaattagccaggcatggtcatgggcacctgtaatcccacctactggggaggctgaggcaggagaatcacttgaccctaggaggtagaggttgcagttagccaagatcacaccactgcactctagcctggctgacagagacagagttagttttcaatcagttatgaattcagttattgcagtttcatctcattttcatgtgtatttatatacataatgacaaccataaatctataatttacactgtcagcttttttaaaagtgaaacaataaatgagtgacttttgaaatacaatatgagggcaaatattttagccatacacctttaacaaatctttccaaaatgttcaatttacatactataaaaacaacatccttctctttgttttacagtcatgatgaccactttatgtttgtttaactagattacttttattacagtaatgagtaaactcaaattaataggtttaggaattaacaaaaccagcttttgttaaacatgcacttctgggaactacatggcaatgttcaagttgtatttatccagttattcacaatgccgtgggtgttagtaaactttttagaggaaatggagactattcagtaacctggcaagtctcttaagtggagttttctttcacctatgaaagaaaggaaagatattccttcaccttgtgtatcttggctgaaaatataattatttcacattgatagcaagttgttaaaggttctccagattttaacttaaaggtcattgatgaaccagaaaaataccttttgaacatttttttctgacattttctttgtttgcaatatgtgtagcataaggtttctcagtaacttgaattgtagtgggaagagaaataccgtaaataaaaaataggaaactaccctgcagcacatttctgataaaatgtggccataaaattataggataggtcaatgtaaacacttgcaaactgcatgaaagctaagctgaaacaattagcctccttcttaaatattccttgtacctgcaaatacgttttagaaatcagtgtcataaaacaactgtgaagaagagaaagaaaaattagaaagattaaaaaaatttataaaactgtctgtaaagcaagagtcttgtttaaaataagtctaggagtggagggatggaattctttttcaaaatgattgaaaggtttttacaaatatagaaagctctttacaaattgcagaataatagaattattaggcttggaaaggaacaaaaattacactttacagataaagaaaagtggagtcattcaaatattaatgtccattacaggttcctttcattagacatgaaatagtacaattgagagcatccaaactctagttactaccatgttaatttctatttactaacatttctgatctatatacacattcaattcaattccttctcttttatttcaactgagaattatatgaattaagttttaaatatagcagcccagaagttcagtgtattttcagaagaagcagtttatacgtttccaagagtgatcactactttactttttgagctgtgagagaaatgaagtaatcacacgtacacttaagtcttttcatatatattattttcaaatctactatttcctggtcagtattcaaggtaccagaaatacgatgctatacaaaattcaccaacaaattttcttcctgaaacttttcttcctgttgataaaattgacaataaccatatgtaaatacatatacagcatgttagatggtggaagtctctatagacaaataaaatcaggaaataggataggcagtactgtgtagatatatggaagaagaatgtcctaagacaaaggaacagggagccaactgtggctggagtagagtggggtctggggagagagtggtgagagatagtaaggtcaaagggataacaggaggcagagctgtatgccacagcaaattacaggtttatgttttctttggctttgaaaaatacatttaatgaattttattcaaattgctttatgtaatttttaaaaattattcaagatcaccataggtgatgaaatactaaaactcccctgcttttaaactctcttttttattaagtggtatattggtactgtattcaaagcattttctgttttatgtaatttctcatcctgctgtagtgaaacttcatatctttattcagtgtaaaataagaataaaattttttcaggttctccttgaatattggatgcctttagaactcaataatgataggaatattaattttattatgtttattaatacgttgtctttggaataatttagatatatccacatttccattggaaaatgcccctattggacataatagacaatacaacatggtgccattctggcccccagtcaccaacacagaaatgtttgttactgctccagacaacctgggatacacttatgaaattcaatggccaagtgagtgttgaaagtgtatttttactgtgataatttccaaaagcaaatgtgttatctttcaagtagagtaatcacggtattctgaagctatgttttccatttggacttggaaactttcatttgtacttttatttgaggataagggaaggaatttgatatttgttgagagtccacactaagctgatattgatcttattgtacagcaccctatctcatttaatcctcacaatgctttggggtgagtatgaaaatcttcatttcacaaataaggaagctgaggcttaaataggttaactgttacagattcacatttctaatgagggaagagaatgagtttgagcttaggcccatggaatatgccccaatttttctactataccatattgcctgcatttatctatcttaaaggaaaagggagtgagatactcttaggtatttttctgagattttgaagttcaaaagttttttgtttaaatcttttccccaacaaaggcagtagggcatagtggaaaagtacaagacttatattctaaaatatccgggctccaaagccaactttattgcttaccaaccaagtgacctgggtaagtgactcagactcattgagtcatcattctctcactttcacaaaatgaaatggaaataacaatgactatcccaatagggtccactcattaaaagaaatcaggaagtggcttcaaggccatgtggccaatgtaaattaaatatgaggatttctgttaaaatagacatttctaaatttcatgtgtccactttttggtgataactattttaatatttgtctttttatttttaatcttcctttccaaataggtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagaattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaactcatttccattcatggatatttgtcaacagatttaaagaaaaccacagttattaattaaagaaaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattctcttatcatttatcagccttttatgtattttccaagtaaaatattaacatattacttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataataacagtaataatcatgcactatagaaaatggctaaactgagattctaaattctacaaacagaaacaagtttaagttatgtatccctgattggttactgggttttcctatattcaaaaatattaaggctatatatacacaagataaacaaataaaatatatcaaagagcatgcatataacaataggatgttttacactagcattattcaatttattctcttggaatacattgcgatttgttaaaatacagtatactcacagcttttcaaagaaattactgtgtaatgtaagatgcctttttatatagaacatcaatgaaactaaatacttcactttatatttttgtagacttactaattactcatttcagaaacatttattaagcacatactagatatcaagtatttcaaggcactatagatttagagagaagaaaataagaattgtaaaattgagaaggtcatgtttgacttgtacttcaaggactgccaatggatttaccaaatatagaagcagagaagggaattttattcaaaagtgacagcatggacaagggcacagaagtttaaaagagcatggaactttttaaaatataaaataggtcagtgtgattacagtatagtttttatggaggggagtaaaaagataaattggaaataaaaccagagtgtcctatatgcaattcttaatacttggaattaattccatgggaaataggaaacagggagagtcataatcaagctgtatatttataaatatagtagtgatggtgctgttcacaaataacgttgatgagaaataatttggaatggttaaaagcaaagaaactcattaatatggaatagattgtgggagagaggagaaagccttgtttcaaagcattaattctaaataatcataattataagataaagttgtacacatctataaataaataaatacagcttatattataaatactatataatattgaaattataagtataatataaatatagctttaagtaaatcattacaaaaatgtcagttaacaatggaagactgtgagagagaggattaaaacaagagcaaaacagaaaactattaacaaaatggcagttagtaagtcctcagcaatcagtaattattttaatgtaaatggcttaatatcccaaataagaatgcttaaagtagctgagtgaatcaaaaaacatgatccagtgacttgctgtctataagagactcactttagatttaaaaatacatataggctggaagtaaagagatggaaaaggatattatgaaaatggtaaaaagaaaaaaaaaagaaagcaggggaggctatcctatcagacaaaatagacaaagtcaaaaacttcctctagaggtgaagttcattatataataataaaagggtcaatttaacaagatataacaattgtaaatatatacatattcaatatcagagcacttaaatatacaaagcaaatgttgatagatctgaaaggagaaattgatatcaatacaatactagtagtagaatctaatattccactttcaataatgtataaaacatccaggtaggagatctataaagaaagagagtacttgaacaacactgtacaccagttggactttagggacatatacattacataccactcaacagcagcagaatattcttatacttcagcaacatgttcttctcaaacacaggtggaacatactccaggataaattacatcagacctcaaaacaagtccccccaacattaaaaagataaaagtcatttcaaagatcttttaagatcacaattgagtaaaattagaaatcaatagtgcaagaaagtgggaaattcacaatgacgaaaaaacaatacactcttaaataaccattgggtcaattaggaaatcataaaggaatttaaattatatctcaaggcaagtgaaaacaaaaacacaacatatcaaaacttacaagatccagcaaaagtactaaaaaggaattttgtagca

SEQ ID NO: 11826 - DNA, 16273 bp, Human
  misc_feature (1)...(16273): n = A,T,C or G
ctgggactacaggtgcacgccactatgcctggctaattctttcattttttatagagacaggacctcgctatgttgcccaggctggttccaactcctgaactcaagtgatccacctgccttgggctcccaaaatctcgggattacaggcgtatagtgctaggccttcacattcttatatacccttctgtttccttagctgtgaaatggagataatgacatagccttaattcacgtgggatgcttagcacagtgtctggcacttgatagatttttttctttctacttgaaatttatttttgagctgggcacggtggctcacacctgtaatcccagcacttgggaaaaccaaggcaggcagattacctgaggtgaggagttcaagaccagcctggcaaacatggtgaaaccccgtctctactaaaagtacaaaaattacctgggtgtggtggcacacacctgtaatcccagctactccagaggctgaggcacgataatcacttgaactcggcagatggaggttgcagtgagctgagactgagccactgcactccagcctgggtgataaagcgagactgtctaaaaaaaaattatttttaactaatataaaactctctgaacccttctttttctgagctgcttctccacttgagtccatcccacatcattgaacatttaattacacagaattgtgtaccatcttccttgacccccagatctttagccttctatagtaccctgtctctttttgtcgtactagtcacagttgcactttttttttttttttttttgagacagagtctcattctgtcacccaggctgcagtgcagtagcacaatctcagctcactgcaacctccgcctcccgggttcaagcaattctcctgcctcagcctcctaagtagctgggattacatgcgcgcaccaccacgccaggctaatttttgtatttttagtagagacgaggtttcaccatgttgtcaggctggtctagaactcctgaccttgtgatcagcccacttcagcctcccaaagtactgggattacaggcatgagccactgcacccggccatagttgctattttatttgtgtgattgattaccgtatgacgcttttattgaagtgcagtgaaggcaggaaacatgaccggtttttacaatattttcaacacttatcaccataggtggtacatagtagggccttaataaatatttgtaaaatgaacaaagttaatgagtgtttatgtttgtagttttaattgctctgaagtaaatatctgattttccaatttccaccagagtgctctgcacatagtaggtctaattatttttccctctttactaatcacccatgccttgtaagaattcagttagttgactttttgtactttataagcgtgatgattgggtgttcccgtgtgagatgcgccaccctcgaaccttgttacgacgtcggcacattgcgcgtctgacatgaagaaaaaaaaaattcagttagtccaccaggcacagtggctaaggcctgtaatccctgcactttgagaggccaaggcaggaggatcacttgaacccaggagttcgagaccagcctaggcaacatagcgagactccgtttcaaacaacaaataaaaataattagtcgggcatggtggtgcgcgcctacagtaccaactactcgggaggctgaggcgagacgatcgcttgagccagggaggtcaaggctgcagtgagccaagctcgcgccactgcactccagcccgggcgacagagtgagaccctgtctcaaaaaaaaaaaaaaaacaccaaaccttagaggggcgaaaaaaaattttatagtggaaatacagtaacgagttggcctagcctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtacgggcccggcgcttaggcccgacccagcagggacgatagcacggtctgaagcccctctaccgccccggggtccattttgcagacggggaactgaggccccttgaggcaggacacatccagggtgacgctgctcgtaagcgtcagagcattcttttttttttttttttttttctgagacggagtctcgctctgtcgcccaggctggagtgcagtggcgcgatctcgactcactgcagcctccgcctcccgggttcaagcgattctcctgcctcagcctcctgagtagctgggattacaggcgtgcgccaccgcgcccggctgatttttatatttttagtagagacggggtttcaccatgttggtcaggctggtctcgaactactgacctcgtgatccgcccgcctcggcctcccaaagtgctgggcttatgggcatgagcctccgcgcccggcccagagcattctttataaggccgaatagtttgcatttgaaggtggctccccccagtcccccaccccacgtgtattttcccctcaaagaaaagctgcatccttaacaccccatctgttcagtcctcatgactccagtgggccagttctgcgtagtccctgccctcgtggagaacacattcctcctggggagactgacagatgcaaagacaggaacaagccagggtcatgttggcgccggaagagccgaccgtgtgtggcgtgggaaattgacttacctgcctgctgggagatggaggggttgcggttgtgtggtttcagttaaggagcacttcccggagaaggaagagagcaggatggagtaggaactagccaaccctaggtaagaggttctagacatgcgtgcgttgagacctggagtcttgggagaggatgcttaaaaggtgattttacccctaggaatatgggggcactgaaatttttttttttttttgagacgggagtcttgctctgcaagctggagtgcagtggcccacgctagaatgcagtggcgcgattgcggctcattgcaacatctgccacctggggtcaagtggttctcttgcctcagcctcccgaggagcggggattacaggcgtgcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagccctttgaaagtttttcagtatttatgtatatatatttttgagttggagtctggatctgtcgccagactggagtgctgttgcacaatcttggctcactgcaatctccgactccctggttcaagcgattctcctgcctcagcctcccaagtaactgggattacaggcacgcactaccattcccagctaattttttgtattcttagtagagacagggtttcaccatgttggccaggatggtctccgtctcctgcgctcgtgatctgcctgcttcggcctcccaaagtgctgggattacaggcgtgctgggatttcggccacaacgtccgaccgaaagtttttaagcagggacatgacattgtcagatttatatactgaaaagctcacccaggttgccaagtggtttggaggggaaagactgctgtcgaggaagcagttaggtagttgtgaaaacccaggtgaggaataactaggccttacctaaggtgcaggcagtaatcttgccatggcctttaagcagagaagtagtcctagtgtcacttaatctttacaaaggatttttgcaaggatcccgatctttcttccttgagggtggtgtacttaatacacttttacaccagacttctaatgttagatgaagaacacagtatttccagggatcaacatttctgtaggctcctattttatataggaaattgtatgaattttgtattttactccaaaatttttctgtgcccgatttaatataaaaatttactgagcctgggtgcagtggctcatgcctgtgatctcagcactttgggaggctgaggcaggaggatttcttgagcccaggagctggagaccagcctgtgcaacatagtgagaccctgtctgtatttaaaaaaaaaaaaaaattcttgaaaaattagcagggcacattcctgcctttagtcccagctacttgggaagctgaggcaggaagatcacccgaacccaggagttggaggctacagtgaactatgatggtgcctctgaatagttgctgtactctagtctggtaacacagcaagaccctgtctctctatcttgtctttttttttttttttttttgagacaggatgtcctgctgttgcctgggctggagtgtggaggctggagtttggtggcatgatcacggctcattgcacccttaacctgggctcaagcagtcctcccagagcttcagcttcccaaagtagctgggactataggcatgctccactatgtctggctaatttctttttttatttttatttttagtagagatgaggtcttgctatgttgcccaggctgagacctcatctcttttttatttttttaaaattttttattatactttaagttctagggtacatgtgcacaacgtgcaggtttgttacatatgtatacatgtgccatgttggtgtgctgcacccatagagacctcgtcttaaaaaaagaaaataacattacttttgaaggtacttaatgcactgaattgtacatttaaaaatggttaaaatggtaaatgtttgaggcaggtagatccacctgaggtcaggagttcaagaccagcctgaccaatatggtggaaccctgtctctgctaaaaatacaaaagttagctgcatgtggtggcatgcgcctgtttagtcccagctactcgggaggctgaggcaggagaattgcttgaacctgggaggcggaggtggcagtgagccaagatcacaccactacactccagcctgggcaacagagcaagactccatctctaaataataaataaaatggtaacttttatgtatattttaccaaaatttaaaaaattacaagtttacatttcttaaaatttcccatcaaatctgtaagtaaatttatgccccgaggaacaagtgctatatttattctaagacaacctcctccttccttaaacagaatcttagggctggaggattgcttcctgccctcttttgtttgtgatgtatgcattttgaaaattctgggccgggcgcagtggctcactcctgtaatcccagcactttgggaggccgaggcgggcggatcacaagatcaggagattgagaccatcctggctaatacggtgaaaccctgtctctactgaaaataacaaaaaattagccgggcgtggtggcgggcacctgtggtcccagctatttgggaggctgtggcaggagaatggcataaacctgggaggcggagcttgcagtgagccgagatcgtgccactgcactccagcctgggcgacagagcaagactgcatctcaaaaaaaaaaaaaagaaaaagaaaagaaaattctggtataatttacatacagtaaaatgcacagatcttagggtttgatgagttttctctcgacatgtttttgcacttccttgtttttgagaagcactgatttgagaagtcagtggctttttctctttagtttgcagggtttgctgtgatttgtaatcacgtacttgacctaggcttcccttttccaccatggtagcagaaagggcatgggatttagagctttaagtacgcgctctttgcttactgtcttataccttgagcatgtcacttctcctctcagacttgttttctcatctgtaaatggatctgttgtgaggactgactgagataatgttactagaagggctttgtataatatttaagcagagtgagaggtaagctttttgtgtaggtcaggggaaatggagaaaataggtgccctgactcagaccagtctggctctttttttttttttttttggagacggagtcttgctctgtcacccaggctggagtgcagtggcgcgatctcggctcacggcaagctccacctcctgggttcacaccattctcctgcctcagcctcccgagtagctgggactacaggcgctcgccacacacctggctaatttttttgtatttttagtagagacgaggtttcaccacgttagccaggacggtcttgatctcctgacctcatgatccgcctgcctcggcctcccaaagtgctgggattacaggtgtgggccaccgtgcccagccaccggtgtggctctttaacaacctttgcttgtcccgataggtcacctttggctcttcagagatgcagggacacacgatgggcttctggttaaccaaactgaattatttgtgccatctctcaatgttgacggacagcctatttttgccaatatcacactgccaggtactgacgttttactttttaaaaagataaggttgttgtggtaagtacaggatagaccacttgaaaaattaagcccagttctcaatttttgcctgatgtcaggcacggtatccaatctttttgtatcctattctctaccataaataaaatggaagtgatgtatttgtacgttatgtgttaaaggtgttatggtgtctcaaaagcactttgggctcttaagagacaagcgaaattaaagtatcatatcataggttagttttgtagaattgtagaattacgaatgccttttgtttccctggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttttttttttttttttgagacggagtctcgctctgtcgcccaggctgggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctagattttctaagtacacattgttttggttatgtgttttgtgactaccaccccaaaactaataaccaccttttttttttttttgagacagagtctcactgtgtcacccaggctggagtgcagtggcgtgtgatcttggctcactgcaacctctgcctctcgggttcaagtgattctcctgcttcagcagctgggactacaggtgtgcaccaccaagcctggctaattttttgcattttagtggagacgggggtttcaccatgttgaccaggctgatcttgaactcttgagctcaggcagtctgcctgcctcagcctcctaaagtgctaggattacaggcgtgagccactgcgcccagcccaccgttttatttgttcataattctgtagtccaggctgggctcagctaggcagttactctgctggtggtagtcgttggtgtggctgccttttgctggcagctgggggctgggcctgtccctcttttttttttttctcttttcttttttcttttttttcaagatagggtctcactctgtcacccaggttggagtgcagtggcatgatcttagctcactgcaacctctgcctccagggctcaagtgatcctcccacctcagcctccccagtcgctgggaccacaggcatgtgccaccatgcctggctaattttttgtgtattttgtagagacggggtttcgccatgttgccaggctggtctcgaactcctgagctcaggcgatctactgacgttggcctcccaaagtgttgggatcacaggcatgaaccaccatgcctggccagggcctgttcctctttatgtggtctctctagcagggtagctcagggctttcaaaagtataaaagcagaagtcagcaggcctttttaaggcttcggcctagaattgccagtgtcgcttcatcgacattcagttagttaaagcaatcacaagcccagcccatttcaaggtgaaattactacagaggcatgaacaccatgaggtgtccatagggggccatcagcataacacactgccacatacatgcactcactttttttctttaacctaaagtgagatccatcagtagtacaggtagttgttggcaaagcctcttgttcgttccttgtactgagaccctagtctgccactgaggatttggtttttgcccttccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttatataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggcgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttgggaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggcggcagtgagccatgagtatgccactgcactccagcctgggggacagagcaagaccctgcctcaaaaaaaaaaaaaaaaaaaaatcaggccgggcatggtggctcacgcctgtaatcccagcactttgggaggtcgaggtgggcagatcacctgaggtcaggagttcgagaccagcctggccaacatggtaaaaccccatttctactaaaaaatacaagaattagctgggtgtggtggcgcatgcctgtaatcctagctactcaggaggctgaggcaggagaatcacttgaacccaggaggcgaagattgcagtgagctgatatcgcaccattgtactccagcctgtgtgacagagcaatactcttgtctcaaaaaaaaaaaaaaattcaaatcagagtgaagtgaatgagacactccagttttccttctactccgaatttcaactgattttagctcctcctttcaacattcaacaaatagtctttttttttttttttttttttttgagatggagtctcactctgttgcccaggctggagtgcagtggtgcgatctctgctcactacaagctctgcctcccgagttcaagtgattctcctggctcaccctcctgagtagctgggattacaggcgcctgccaccatgcctggctaattttgtgtttttagtggagacggggtttcaccatgttgtccaggatggtcttgatctcctgaccttgtgatccacccacctcagcctcccaaagccctgggattacaggtgtgagccaccgcgtccagccagctttattattttctttaagctgtctttgtgtcaaaatgatagttcatgctcctcttgttaaaacctgcaggccgagcacagtggctcatgcctgtaatcccagcattttgggagaccaaggcggatggatcacctgaggtcaggagctcaagaccagcctggctaacatggtgaaacctcatctccacttaaaatacaaaaattgccggccgcggcggctcatgcctgtaatcccagcactttgggaggcctaggcgggtggatcacgaggtcaggaaatcgagaccatcctggctaacacgggtgaaaccccgtctctattaaaaaatagaaaaaattaggcgggcgtggtggtgagcgcctgtagtcccagctactcgagagcctgaggcaggagaatggcatgaacctggaaggcggagcttgcagtgagctgagatggtgccactgcactctaacctgggcgacagagtgagacaccgtctcaaaaaaaaaaacaaaaaacaaaaattatccaggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagtttttttttttttttttttttttaaagctgttttttaatacattaaatggtgctgagtaaaggaaataggcagggtgtgttgtgtggtgttttaactaggcgcttctctctcagagagttttgaaacctgtttacataaaggcccaggatgggaaggagatccaaacataagccaccagcctcattccaagtctcttctatttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagcctggccaacatggtgaaaccctatctctactaaaaattaaaaaattagctgggtgtggtggcatgtacctgtaatcccagctattcaggaggctgaggcaggagaattgcttgaacctgggaggcggaggttgcagtgagctgagattgcaccattgcactctagcctgggcaacgagtgaaactccgtctcaaaagaaaaaaaaaaaaaaaatatatatatatatatagagagagagagagaataccacagtgagggcatgggctagaaatcagtgcactaaggatatgaaatagatgtcaatgtgaacttttcggatactttgaccctgggtctttgtatcctcttcttagcacctcagtcccacgctctgctagtcattggcttcctgataccccttcaatacagactgagtatccctaatccaaaaattccaaatccaaagcactccaaaatccaagagtcccaacgtgacgccacaagtggaaagttccacatgtgagtacttaacacaaacttgtttcacgtgcaaaactgtggaaaatattgcttacaattaccttcagcctttgtctataaggtgtttatgaaactggtgttatgatgtatatgttttctttttttgttcctggctcataactcccatagcccttgttacggatgtgagccaccttgcctggctaatttttaagttttttgtagagatggggtctcgctgtgttgcccaggctggttttaactcctgggctcaagcgatcctcccaccttggcctcccaaagccctgggattacaggtgagattacaaccctcatttcagagaaggtcctaccccataccctgggggaaggaatggtgacatcataaagcctcgttaaaacccatgaggacagtggagagtgtcaggatagctgaactacgtgtagaggttcctggagggtggtgcgcccagggaggggacagaagctctgcgccccttatcccataccttggtgtacgcatctcttcatctgtatccttcgtaatatcctttatgataaaccaggtaggccgggcgtggtggctcacacatataatcccagcactttgggaggctgaggtaggaggattgcttcagcctgggagttcaagataacatcatagtgagatcctgtctctactagaaaaaaaaagaacaaccaggagtggtggcgcatgcttgcagtcccagctgttcagtttgcactccagcctgggagacagagcaagacctgctgtctcaaaaaaaaaagactggtaaacatttttcactgagttctgttagccactccagcaaattaaacccaaagcgaaggtggtgggaaccccaacttgaagctggttggtcagaagttctggagccctaaacttgctactggtgtgtgggtgggggcagtcttggggactgaggcctcaacctgcaggatctgatattatttccagaaagatggtgttggaagtgaattagaggatacctaattggtgttcactgcagaattgattgcttgctcgctctcgggaagaaatctacacatttggacacgaaagtgttctgggttggtattgtgttagtgtggaatctagaggaaaaacagtttttctgaaacagaaaggtaaatgaatttcgcctttagacttgggtcccatcctcaagatacctcatatatatgcacatattccaaaatacaaaaaaatctgaaattggaaacacctctggtcccaagcatttccaatgagggacattcaacttgttcccctttctttcggcacacctaaactgcctgccccaacaaaacattttcttgtccccaccccttaccacacatacccagtagtccattggcaggtcacagaaaattgaggtacacgtattatggtcatgagaaggattgggcagtagcactcaatgtatgagagggagaaaaacccacaaaacttatttcaaaattcaaaacatgaaaccgcaggaaaatataagtctgtttgacatacaaactaatggcagtaatctctctccctgtctgt

SEQ ID NO: 11827 - DNA, 8879 bp, Human
acctttgcctccacacccggctaattttttgtatttttggtagagatgcctgcaatcccagcactttgagaggccaaggtgggtggatcacttgaggtcaggagctcgagaccagactggccaacatggtgaaactccgtctctactaaaaatacaaaaaatagataggcatggtggtgtgcacctgtagtcccagctactcgagaggctgaggcaggagaatcgtttgaacccaggaggtggagattacagtgagccaagatcgcaccactgcactccagcctaggtgacagagtgagactctgtctcaaaaaaaaaaaaaaaaaaaaaaaaaagaaggaagcctatctgactattgcttctcccccgccatccttcttacagcgtgaaaagtgttgttgtagagaaatgtacagaaggggtaactggctctgtctggggacgaggaaaggcttcccgaaggaggtaaattttcagctaaacttctcaggatgtagagtgcttcctccagttgtgggagagagagaggaggatatttcaggtgaagcgaacagctttccccgctgaccctgtgttaagttgcccaggggctctacggcgaaggttccccagaggaagggatcttccatacttcaatgaggcactttaagaaacccttgagttcagctggaattcagaccttccagagctaccagaaaaacatcatgtgggaaattgtgcccggcgcggtggctcacgcctgtaatcccagcactttgggaggccgaggcgggcggatcacgaggtcaggagatcgagaccatcctggctaacatggtgaaaccccatctctactacaaacgtaaaaaatcagccaggtgtggtggcaggggcctgtagtcccagctactggggaggctgaggcaggggaatggcgtgaacctgggaggcagagattgcagtgagctgagatcatgccactgcactcgacagagcgagactccgtctcaaaaaaaaaaaaaaaaaaagcgtcatgtgggaaatggcttttccagcctcctgtaggggccgctgctgccccagactcagccagtcttgtctaagaaaactcagaggacgtctctgctggggtggtggtggggtacaccctggacctgccgccatccaaggagtgaacttaagggcgacagtgcccccaagcctgaagaatatgcactcagtcaatggcatttgggggtagggagggggtgtagtgggcactgatatttttcagtctctgggtcaccacaagtttattaaaataaaagaaaatgtgggtaaatgctgccatctgtgctgtccctactcccaatacacacacacaggcacacacacacacaggcacacacacacacaggcacacataaacacacacacacacacacacacacacacacacacacacgcataacaaatcaggtcccagactagatgcaggagttgaaactgctttaaaaacactctaagaacttaactacaaacccacactccccatgcttctggggcttaagatctttgagctcattcttcagcatctctcctcgggaaagtggggtgggctgctccatgaggtggaggtgaagacccctgagtctgccccgtggagggggaggccccctaagcctagagtcccgctgcagggctctgtgccaggagcccccgtgagccatggcctcgaaagggcagcggtgatttttttcacataaatatatcgcacttaaatgagtttagacagcatgacatcagagagtaattaaattggtttgggttggaattccgtttccaattcctgagttcaggtttgtaaaagatttttctgagcacctgcaggcctgtgagtgtgtgtgtgtgtgtgtgtgtgtgtgtgtgtgaagtattttcactggaaaggattcaaaactagggggaaaaaaaaactggagcacacaggcagcattacgccattcttccttcttggaaaaatccctcagccttatacaagcctccttcaagccctcagtcagttgtgcaggagaaagggggcggtcggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcaccttcgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaaggtgagggggcggggtggcaggggcacggctcagagggaggggcatctgcatgaatggaggggctttcaaagccctggcactgccctggtgggagacactgtgtgcatctggcccggggtgggtgtctggggacactgacacatatctcacacatagcagatcctaggctgcccacacatcagggctggagggcacctaggaagcaccaggtccaacgcctgcaaggtgcagagtgggcactaaagcctagagaagagacaagacctgccagttcgtggcagagttggagaccagattccgagacttgattgctcagttgtgcatctgtacctgctgggctggccgaactttccaagctccacaggtttgtaggcggtctcagacggcagagaaagaaatgaatcttgaggtccccatgcttctgcaactttgccctcaggcaaggggatagaggaggcaagagaggtgcacacagtaaatggggcatcttggagtcatggaatgatgttcagatacatggggagggagcagacccagggcctaactcgcagtatgaccttgggaaagctccttctcacttggggtctccgttttcccatctgtacacctatatggggttggacagggtggtttctgagagcccttccaacatgaaaactttagatgctgtcctgaacatgcctcattctcctcattaactccagagactacctgctcccctctgtctctctcggcccacctaatgttactgttgcagcttttcctctccacttgctgtgtgatctaagcaagtccctccccctctcagggcctcagtttcttcctagtgtgaagagggaggtgggctgttggtcgctcaagttgcctgcagctcatttgctctggtcctaggctggcagggtgggggaggggtcagagggtgggagaggctcctcattagagctggcctggagggggctgccagggggcgggggaggcacagaggcagcaggtctggctgaggtgggggaggtggtctggctgcctgcccagccagggaaagctgtgaccccttgggggctcataaaataagtccgtgtgccccccagcactaagggagcttggagagggggagatggggagtttaaaggcctaattagtcaccttctagagcaatatatgaaagctccccaatggcaaattgcaatttaggaaggagggcatgctgattcggagatactactgagcttctcacatacacatacatagccttatgtttatacacacatgctgaatcacacatgtacatgcatgctgactcacacacacacgtgctgaatcacacacgtacacacatgccgaatcacacacatatgcatgtgcacacacaccttcttacatacacacacaagatcaatcatgcatatacagacatatatgtgctcttcaaatagtcacacaagcccaatcatttatacatataatgcgtcattaacgtatacactctttcatattcacatatgaacccaatcacacacatgcatacaactgtaacacacacacatgctcaggagagtaagacacataggcaacaaaatccttgcactggaaagccaggaaaattgggctgtaggtcagtgtggaccagctttgtcattaacttgctgtgtgaccttagtcaagtcactccccatctctgtgcctcatctgcataacaagagcaccaaggtctcctttaagggatggtggaagcagctgagaatttgagcaagtcatctaacttctctgaaccttgggattctcctctggaaaagcgtgtattttttttttttttttttttttttttttttagccagggtctttctctgttgcccaggccggagtgcaatagcgaattcacggctcactgaagccttgacctccctggggtcaatcaatcctcccacctcagcctcctgagtagctgggactacatgtgcacgccaccatgcctggttaatttttgtattttttgtagagacagagtgtcaccatgttgtgcaggctggtttcgaactccggagctcaagcaatccacccacctcagcctcccaaagtgctgggattgcaggtgtgagccactgtgcccagtcaacaggagtaattttaatgctcactccacctatctcacaaatgagacatcacgttagctcatggctgggagagagataggtagaaggcagttacaaagctgataaatctctgataacacgtatatcatgacacaaacaccagaatcacgcaaatcatccccagccacatcttcaggtgaacacccctacttggtcggctatgtaggaaatgctctcattttcaaaaaggctctcagtggtttggctcttggcttctgtcagaatggggcagaggtgaaagaaagctctctggacggggagagagctggggccttcccccgcagcctcgaagtgactggctcccttggtgaggttgcagggaatgacttctgggtgttctctctagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggccgccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaactgtggcaaatttcttgtttactccaggggacccagtgaccccttgaagaattactgacccagggcagggaggtgggttgcttcatgtataaactcagttttcagagccctatccccacccccactcctggaaactgaagcacaatgggacagagagtgcagctaagcagggccagtgctcacctctaaccgcattcctgttccttccaaaggcccctgggtcccgagctctatttgctccattggggcctggcagcagaattatattttcttcttgagattccttagtcaagtttgttgtctccaaaatagatccctaaaagggagggaaattggggatttcatttcttctaaaatcattcctacatcatcgaccaatatctgcctgccctgctacccccatactcacagaattacctgggcaccattgaaagagtcctttatctctcccctggggaatctgggctgccaaggctctccttctccctgttggggcatctcctctcgccactgaccactgttcctcacatgaccatgtctgtggccctgttgccctccagcttgacaccctcactacacctcactgctcacccatcagcccccagctccagaaacagaatcggagtcccctgcctttatattacacattatataaatacataattatacatcagataaataaactccccactaacctcagacagacaaatgccaggcacaccctgacaatgtttcctgcttggggcttggcccagagtaaatgctcacttccttttctcagctggaatctttggggaggcacagggcacagacttttgggaggggaacatagccctctggtggggagacaggcatatgggtgccttgggctgaggactccagttctacctggcagaatagacacagggagaaccaggagcagtctaagcctccacttcccacccagggggcttcaacatttcccctacctccctccagctgggtctttgattcctggggctcctcaccaaagctgcttcaacagtagggattcctacccagctatgggcagaccttgtgccctttccctctaggcctgaagcttgggcacagtgcgggggcagcctacctttgagctgcctccttggtctggaggctattacctctctctgaggggacagactgagcctggagcctcccctcactggctgggcttcgttgtgtttggctagtggtgggcctggcagctctggaagtaaacaaaggagctgccgtggcagacagagctgtggtgtgtgtgaggggagaatgggcctggaagggaggtgctggggaagccaaggagtgggctggggatccagggagagcagtgtagaaactggggggccagaaacccaagggcagatagataagatgaatgggtcacaggtggggctgactcccacaggtattatttcctgggctgcgtgtccctggtttcttggaaagttctgaccgaactggagcttctctctgccttagcccagtcagagaggttcatgtcatctgagccacaatgcccctcctactgaaggcctgggctcccaatggactgtttggattgacacgctaggagtttcctctaccaccacaacctgccctagggctctctttcagactgtggaccctcctgcattttcccacccagactctggggatgtgatcaggtcacccatcctaaccacaggatctgttcagctgcctccttggaaaacactctcccccagccacccacctccaaccgcaaccataacaagctgcaaactggtactgttcattcttgccccaaagggtacaaggcatctatcatacttgagagttcacaaacactctccacccatggtcactcagctctgaaggctgcacactttcaaaatttcagttctgtcacttagagttagaggccttgggcaagtaacttaattccatgaaccttggtttcctcatttgtaaaaaaaaaaaaaaaaaaagagggtta

SEQ ID NO: 11828 - DNA, 5588 bp, Human
tcagaataaaataccaactctactactctcatctgtaagatgcaaatagtaagcctgagcccttctgtctaactttgaattctattttttcttcaacgtactttaggcttgtaatgtgtttatatacagtgaaatgtcaagttctttctttatatttctttctttcttttttttcctcagcctcagagttttccacatgcccttcctactttcaggaacttctttctccaaacgtcttctgcctggctccatcaaatcataaaggacccacttcaaatgccatcactcactaccatttcacaattcgcactttctttctttgtcctttttttttttagtaaaacaagtttataaaaaattgaaggaataaatgaatggctacttcataggcagagtagacacaagggctactggttgccgatttttattgttatttttcaatagtatgctaaacaaggggtagattatttatgctgcccatttttagaccataaaagataacttcctgatgttgccatggcattttttttccttttaattttatttcatttcattttaatttcgaaggtacatgtgcaggatgtgcaggcttgttacatgggtaaatgtgtgtctttctggccttttagccatctgtatcaatgagcagatataagctttacacaggatcatgaaggatgaaagaatttcaccaatattataataatttcaatcaacctgatagcttaggggataaactaatttgaagatacagcttgcctccgataagccagaattccagagcttctggcattataatctagcaaggttagagatcatggatcactttcagagaaaaacaaaaacaaactaaccaaaagcaaaacagaaccaaaaaaccaccataaatacttcctaccctgttaatggtccaatatgtcagaaacagcactgtgttagaaataaagctgtctaaagtacactaatattcgagttataatagtgtgtggactattagtcaataaaaacaacccttgcctctttagagttgttttccatgtacacgcacatcttatgtcttagagtaagattccctgagaagtgaacctagcatttatacaagataattaattctaatccacagtacctgccaaagaacattctaccatcatctttactgagcatagaagagctacgccaaaaccctgggtcatcagccagcacacacacttatccagtggtaaatacacatcatctggtgtatacatacatacctgaatatggaatcaaatatttttctaagatgaaacagtcatgatttatttcaaataggtacggataagtagatattgaggtaagcattaggtcttatattatgtaacactaatctattactgcgctgaaactgtggctttatagaaattgttttcactacactattgagaaattaagagataatggcaaaagtcacaaagagtatattcaaaaagaagtatagcactttttccttagaaaccactgctaactgaaagagactaagatttgtcccgtcaaaaatcctggacctatgcctaaaacacatttcacaatccctgaacttttcaaaaattggtacatgctttagctttaaactacaggcctcactggagctacagacaagaaggtaaaaaacggctgacaaaagaagtcctggtatcctctatgatgggagaaggaaactagctaaagggaagaataaattagagaaaaactggaatgactgaatcggaacaaggcaaaggctataaaaaaaattaagcagcagtatcctcttgggggccccttccccacactatctcaatgcaaatatctgtctgaaacggtccctggctaaactccacccatgggttggccagccttgccttgaccaatagccttgacaaggcaaacttgaccaatagtcttagagtatccagtgaggccaggggccggcggctggctagggatgaagaataaaaggaagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggtaggctctggtgaccaggacaagggagggaaggaaggaccctgtgcctggcaaaagtccaggtcgcttctcaggatttgtggcaccttctgactgtcaaactgttcttgtcaatctcacaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaaggtgagtccaggagatgtttcagcactgttgcctttagtctcgaggcaacttagacaactgagtattgatctgagcacagcagggtgtgagctgtttgaagatactggggttgggagtgaagaaactgcagaggactaactgggctgagacccagtggtaatgttttagggcctaaggagtgcctctgaaaatctagatggacaactttgactttgagaaaagagaggtggaaatgaggaaaatgacttttctttattagattccagtagaaagaactttcatctttccctcatttttgttgttttaaaacatctatctggaggcaggacaagtatggtcgttaaaaagatgcaggcagaaggcatatattggctcagtcaaagtggggaactttggtggccaaacatacattgctaaggctattcctatatcagctggacacatataaaatgctgctaatgcttcattacaaacttatatcctttaattccagatgggggcaaagtatgtccaggggtgaggaacaattgaaacatttgggctggagtagattttgaaagtcagctctgtgtgtgtgtgtgtgtgtgtgcgcgcgtgtgtttgtgtgtgtgtgagagcgtgtgtttcttttaacgttttcagcctacagcatacagggttcatggtggcaagaagataacaagatttaaattatggccagtgactagtgctgcaagaagaacaactacctgcatttaatgggaaagcaaaatctcaggctttgagggaagttaacataggcttgattctgggtggaagcttggtgtgtagttatctggaggccaggctggagctctcagctcactatgggttcatctttattgtctcctttcatctcaacagctcctgggaaatgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatacaaataataaatctattctgctgagagatcacacatgattttcttcagctcttttttttacatctttttaaatatatgagccacaaagggtttatattgagggaagtgtgtatgtgtatttctgcatgcctgtttgtgtttgtggtgtgtgcatgctcctcatttatttttatatgagatgtgcattttgatgagcaaataaaagcagtaaagacacttgtacacgggagttctgcaagtgggagtaaatggtgtaggagaaatccggtgggaagaaagacctctataggacaggacttctcagaaacagatgttttggaagagatgggaaaaggttcagtgaagacctgggggctggattgattgcagctgagtagcaaggatggttcttaatgaagggaaagtgttccaagctttaggaattcaaggtttagtcaggtgtagcaattctattttattaggaggaatactatttctaatggcacttagcttttcacagcccttgtggatgcctaagaaagtgaaattaatcccatgccctcaagtgtgcagattggtcacagcatttcaagggagagacctcattgtaagactctgggggaggtggggacttaggtgtaagaaatgaatcagcagaggctcacaagtcagcatgagcatgttatgtctgagaaacagaccagcactgtgagatcaaaatgtagtgggaagaatttgtacaacattaattggaaggtttacttaatggaatttttgtatagttggatgttagtgcatctctataagtaagagtttaatatgatggtgttacggacctaatgtttgtgtctcctcaaaattcacatgctgaatccccaactcccaactgaccttatctgtgggggaggcttttgaaaagtaattaggtttagctgagctcataagagcagatccccatcataaaattattttccttatcagaagcagagagacaagccatttctctttcctcccggtgaggacacagtgagaagtccgccatctgcaatccaggaagagaaccctgaccacgagtcagccttcagaaatgtgagaaaaaactctgttgttgaagccacccagtcttttgtattttgttatagcaccttgcactgagtaaggcagatgaagaaggagaaaaaaataagcttgggttttgagtggactacagaccatgtttatctcaggtttgcaaagctcccctcgtcccctatgtttcagtataaaatacctactctactactctcatctataagacccaaataataagcctgcgcccttctctctaactttgatttctcctatttttacttcaacatgctttactctagccttgtaatgtctttacatacagtgaaatgtaaagttctttattctttttttctttctttcttttttctcctcagcctcagaatttggcacatgcccttccttctttcaggaacttctccaacatctctgcctggctccatcatatcataaaggtcccacttcaaatgcagtcactaccgtttcagaatatgcactttctttcttttttgttttttgttttttttaagtcaaagcaaatttcttgagagagtaaagaaataaacgaatgactactgcataggcagagcagccccgagggccgctggttgttccttttatggttatttcttgatgatatgttaaacaagttttggattatttatgccttctctttttaggccatatagggtaactttctgacattgccatggcatttttcttttaatttaatttactgttaccttaaattcaggggtacacgtacaggatatgcaggtttgttttataggtaaaagtgtgccatggttttaatgggttttttttttcttgtaaagttgtttaagtttcttgtttactctggatattaggcctttgtcagaagaatagattggaaaatctttttcccattctgtagattgtctttcgctctgatggtagtttcttttgctgagcaggagctctttagtttaattagattccattg

SEQ ID NO: 11829 - DNA, 44248 bp, Human
acatagagacagtgtttctgtatgagcatgtgtttgctttgtttgtttgtttgtttttattggcgtagttaattaaagatcatatacccaggaaggtggtatggaaggagcagccagatctaattttctttatacccttcaccgtgcctagcatagtgcataggtgcattcaatgaatatttgagtaaatgaatgtaagaaatatacagaccattggctgagtgtggtggctcacacctgtaatcccagaactttaagaggccaaggcgggtgcatcacttgaggtcaggaatttgagacaagcctggccaacatggtgaaaccctgtctctaccaaaaatacaaaaaattagccaggcgtggtggcgggtgcctgtaatcccaactactcgggaggctgaggcaggagaatcgcttgaacctgggaggcagaggttgcagtgagcagagattgcgccactgcactccagcctgggcgacagagtgagacttcatctcaaaaaatatacatatatatatacagagagaggccattaaagcaggcttttaagccagaaattactgtcttcccaatgattaataagtatttttaaggcttcattagtgacaaatatgttacatgtataaacagatgggcaggacttaaaagagtaggccagatagttgatactatatctaaacttttctgggtgcctcttagcaaataaatggatctctctctgttccttgttttacttcccctttccccgaggaaaatcacatttttcaggtctgacaacaattttcaacctgataacaattgctccggtttcattttggcaactgctaaaatggtcaccttgggaaccccaggcacacacgctgactgtacttgcacagcttctacactgagccttttggaaattgcctccaggaagcctgtctctcatctcacaaacagaaccactgatccaacctgggccaccatctttctgcatctgctctgtctgagactctcccagtcagctcctaaggagacagggaatcctgcatcactcatcgcttaggctagactgaaggtctccttccaaaggcaactacttactactctctgccttgggtcatacaataagcactactcttatctattcacacgctaagctacttttttaaagccagctttgctagctagccacctcgaaattccccagaaggaatcaaacagaaatggaacaaaggacaggaaaagccaaggaggtttgctgaaattgaagcattctgaagacagctgggtggtaaaatggatgtgacgtgaggaaggtggtcttgggtgcacccacagaccaacactgccattgttacaatttgtgtaggatgatctcaggtgacagacagcagcaatttatcacacccagaaacgcatcccccacacatatttacttgagggtaccagacctgctcacaaagcagagaagagctaaggcggttctctaagggcagagaattgctgctattgcctagtgagtggggagagggtactcctcaggccttacttcctatcaaatcatgtgtcagtgttgcctaggagacagaggcacagtaactactgtagccaaacaaggcacataaacaaaacagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgctctgccgctgcttctcatcgcatggccaccgcatttctcagtaagtgggaatcaaatgcttcactcaccacagagtaagcaaataaatatcttttttctatgacatgggctgtaacaataccctgtgctccacctcctaataatttcactacacccagggtggggaggagggttaggaaaagcaagaaacaatgacttctaaatatatgacaaacttgtaaacaacaaaaaggggaaacaaaactccttataattctattattattagcagggacagaactaataatggtcccattaaacttgcatcattaggcaggtcatgttgattctgggtataaccttctattcttgtgttttggctcagtaagtgagatgtgcaaatccgtggcaaggtgagtcatatgaaaacaacacctatggttttgttagtgcttacatcaatataagacatctgttttccaccgctccagataattatgcaattaaaatgagaacatatattctgccaagatttcttagaaaataaatgagcttccaaaatagggtatagggtttaataaaatatctcaggaagtttcagagttaagcaagaaatctacaaataaagaaacaacaacaaaaagtagagagaggcactttatctaactgaaggaggcgttctgctttttctttctggtaggggttcttggatttccaagattgtttcattgtatataaaatgtacccaaatttgctgaaatatgtcacttggttttgtgttcactaatgtatttacctaaagcaaggtaagcatatttccatgtagacagaaaaaaggatgaaatggaaccaaaaaaaagggggaaaaaggagagacagagcgagaatattttaatacccttgagcctaaaattaataaacacatgaaaagtgatggtgcttttatagccatgtgaataatgtacttagtacttgctttaatgaattaccatactgaacattttattacctggcatgatttctattttaagtgaatatgtcctctttcatggttatcgaaaaaggaatttatgtagctatttgttagaagtttgcatttcaaagcaaaataaagttttagaagttaaatcacctcatttgtttatattatttgaaacactgcatgggaaacttttaggcaaaataccaaaagtgggccaggcttgttacacactccccagcctgctgctctcctgacctaactcattcctctgttaggtttcaccgcacattgcacattagggctgtgcactaatttgcttctattccacacagggccaggcacattgagcattggtcctgtgcctgacgctatgctagatgctggggttgcagccacgagcatagacacgacagacacggtcctcgccatcttctgttgagtactggtcggaacaagaggatcgtctgtagacaggtacgcccaggagcatggatgtgagatgacaaattgcaccatgtgcaattggcaggaaatattttgctactgggatatttgtagcaaactctttcttctatttttccaaatactcaaggtggcaacaccatttccacttggactgacagagagttttatgtttacagccacaacctgaactcatgagttctattttaggactatttcagaaatttaatcaaaagtacagtagtagtaaaaaaaaattgcatgcatgataagtggtccttattattcatttatatatttaggaatgtgcagtttttcattggggggtaatgcaatatacctaggtaaacatgtcttttgcagtttataccttggtttattcttcatcccccaagagataacttttattgctgattatactgtacaggataaaagagaaagtaaactcttcatatttaaaagcctaccagagcatgaatcctctcagttgctttacaatttctgccactaaggttgagtctggaattaggtgttaccacagttgactcaaaaaggttttaaaaacaggggtgccagtataactttggttataaaacgaacgccccaggcagaaaaataagttgggaaaaaaaagaggggaaaatatttgtaagtctgaacttcagtagaatttgaccagttctcaagaacgctggggaaatccactgctaattgtcaaaattttaccaaacttcctagaaacacctatagggaaggagactgtggttgttttctccaaaatttcaaaaaatgtaacacctatcagaaactagatttttagagagcacttgaggaattttagattgactcaatgaaatgttatatgagcaagtagatcatgagatcatgatttctcttaaagattgagcatgtcttcctggtgatagataaacaacctatagttgcttcattctgcttagtttgcatcttattttaacaatttaatggttttctgctagattttaattggtagccatgagaagaatgagtcgaacatattgtcgatatatatgtttaagctaatgaagtcgctctattcttttatagtgaaatatgacccagttgacatctacataacagtgtatctttggattaaagaaatggcctgaagagatttgttgttgttgttgttgttgttgttgttttaagcagggacaagaagtattaaggggccacagagagtgagcagaattgtagaaaacatggtatcaaatcctgaagctctagtactattcaaccttatgtaaaatttatctgactcacaaaaaaaaaaaaaatgtcattctttttaatatttagacccctactgagtaccttgtgctgcctataggacaactgattttgttcaaaagcacctctttttaaatatgacaatgagacatgaaaaagctgtctatttatttatggccaaaaactaataatcaaaaattttttgaatgattaaatttgaaaaacaattctatttttagcagctataaaatcagaatacatgacaaattctaggggagagtgcttgctcatataaaatattcaattatctctccactgagatattcaacagttttatcatttacttcaacaatttaattgcaaaggataaatacatgtttattgcttttacaagtacatttataacatagttttactttgccagtcagtgaaagtcacaaagaaatattaattttgcagttttttctgacctagaattcctattattgaaaattagtgcaaaatcagagcatatttaatattgtttcaggaaatgctgacattttaagaaatcaccttcataacttaaagaggaagctatctttgttgctgttcttaaggaatttttatctttgcttctcaggcttagtagattactagtgttttcccttaattcattaaaattctcacttgttgaaaattttaaaaaaattatagagtacctgcttttgttgtcatcgtcatcgtttcattttttttttaatttctacatggtgtgaaatcctcagagaaaaataaacaggattttaaaatcaaaactggcatacttctgattaacagtacttaagcttatttgacaaggaattgagtgatttatatgccgatcctttcctgctgttttggcattttaccaatttcattagtaagttcagcagtaattgtagcaacttaagtaataatttaagaagtaataatgaagttaagagtgttctgtgctatttcctggaggtattcatttagcccaggtctctcctgtggttctactggaattatatttggaaaataccaagccacttaaataaatgttttaaatgaaattataaatcattgtaattagtaccataaagttgacagagcataggttttgccattggaagatcagagattgggtctaggctccattacttaacagctgtttgatctttggcagattatttcagctttcagactcctttccttcatgggtaggaataacgtccatggaagggatttccatcatgtataacagccacatgtgtctggtaccaaatctctggggggagcacgtggtaagagagtaggaagaactcctttgtaaaagtgaggacaacacagggggaagccatgcgtgttatttgcccttgaaagttaagttcttatgaaatatgcctttcaaaatgtgcagaagaaaaactcaagacttctcatctacagttcccagaaagagatcaccgactctcctctttgacatgtagaacaggatgccgagacttttgtgtgtgttcacactgggttatcacatttccagctctagattccttctcattgcccaattgtttcaaggacatagaaatactgtctttattttccccaggtctatcactgtgtttttcaattcttttgtgatccgctccctttgcggggtgggggggggaacaaaacaaatcaacaaacaaacaaaaaaaacactcttcaaagtaccacaagttgattctggattggtgatacaaagtttctcttaggctacagattgttttagattgaagtttcctgtcatgttcactcatctttaaatcctcatagtgaaaaaggtaatgttgtttatttcttttgctgactatgctagaaattctgctattcaaagatctgctctggtttcttgtcgaaaagcaatcccttcctatttgtttccttctcttccagctttgcacataccttgggttccaccaggcatgtctcttccctgttgtgtgcgtcaaggactctagttcaccctttagatggcaaatcagaagtctctgctcctattgtaccccatacacacctttactgaggcagtttttcaactggtttacatttatcaatttatatttcattctgtccttcaaactatgaatctacattggaagggcaaagtccaacatttggtcatgtttgtactttttgcgcataacaaatatgccataaatgtctgttaaatggccaaacgactgcattttatgttagaaagcagctatcagtttttcttaaaaatagcaacaagatgattttggtatctcccttgttttctgtaggatatgatcatcgtggcgcatgtattactcatccttttgggggccactgagatactgcaagctgacttacttcctgatgaaaagagtaaggaccttctattcaattcaataatgtttatttttaaaaatatgttagtaaaaggataacattatttcctcttaaactgtcgattagaacattatatatggatttttatgagacaatatttatccccatcagaagacagatgctttaaacatgccatattttaagaaagcaatgttggctgaaatgcaaatgttatgctacagtgggaaatcaaagtcaaagtgtgggtgtccgggcaccatggaataaagctggcgccagtggtcgcatttggaatgtcttctcacacaagggagtagttagaaggccccatgaccaaacgttaagaaacttccactgcattttgtcctgaaatctgctgatgttatgtatttgatgtgatgacagagtttaaggaaaatcatcacatggtcccagtctagcattgtcaacagaactatctatggtaatgacaatgttgtatctctctaatgtccaatgcagtagccactagccatatgtgactattgcgcccttgaaatatggatagtgcaactaaggtaatgaatttaaattaatttaggccgtatgcagtggctcacacctgtaatcccagcactttgggaggccggggcaggtggatcacttgaagtcagaagtttgagacccacctggctaacatggtgaaaccccaactctactaaaaattcaaaaatagccaggtgtggtggcacatgcctgtaatctcagctacttgggaagttgaagcaggagaatagcttgagctgagaggcagaggttgcaataagctgagatcgcacaacactgccctccagcctgggcaacagagtgagactctgtctcaaaaattaattgattaattaaataaaatttcaatagccacaagttgccagtggctaccgtaatggacaatgcaatatagacagagctctaaaagtcctcatgtggtaaacatggatgtagaggtgtggaagtccgttaaggtcaatggataaatcctgataacttagtaaatgaataaaagaaggttttgtagttgtgtgtacaataccgtcctaattgtggtaaaaaaaattaaaaattgcataaatatacgcccagaaaaaacataacgaatatatcatatgttaattccattcttagtggtacaattattttaaaaaatttattttcttctttttgcttatctgtgttttccaaaatttcttcaataaacagatattgattttgtaattaaacaaaagctttaattttgaaagcaaagtcagagaatggctcatgcagggggaagaaaccttttctttctgtaaagccctatttaagtaagtttgcttgcaaatatttttgtctgtgactcataataagaggtaaatacatttttacattatgtaccagcacacatacaaatatataactacctttatgtagtggaaacgagattcatgaaacagctcttattatgtttgatgcacactgatattttctattctatttttcttccacattactaaaacaaaaattctggtcacaaaccaatacattgttattattgcctgttaatggataatgactctcagtttgaaaattatggttatagtgaatagtgatatagtaacatgttcatatttcaataaaaatataggtattataggtaaacacctggacatgggcaacgtaaaaaagatattaaaaacagttttgaagaaacctcttctaggacaggcgtggtggctcatgcctgtaatcctagcactttgggaggctgaggcggacagatcatttgaagttaggagttcaagaccagcctagccaacatggtgaaaccctgtctctattaaaaataccaaaaaacccacattagcccagcatggtggcatgcgcctgtagtcccagctactcgggtagaaatagccactttctctttgccccggtgttacaggcacgcaggagcaactgtgtctgtggtgctggcaggtccaggacagcatctgcagggcaataaatattcgaaaagttttaaaagtgctgcctatgtccagttgaacattgtgttgtttctttatcctttgaatcaacagtttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgacgtaagtgtttattctaatggatatccttattgagaataaatatgcattttgactgcattttctttatcaaataaaattttggattaaaaaaataaaattactgacaggctctttgttatgttaccagtagaatagtgtctctctaagaatgcctgtgagctagcgccgggtgtattgttcagcgttaaacagcatcacagaatattttaacttttggatgattctttcccttaaggaagaatgtttagtaactttttaggcaccatggattgggtactggttttctgtttcccataaaattaccaacagaacaggagacagtagcctagtaaaacaagaagtgagcaggcagagtggagagtcagggaaactaagttcaaaacccagttcttccacttcctgcctttgcaacctgggacaagtcatttagcttctcagagcctcagttttacctcggggctacattcaggcacctgctacatattaggtgtgcaataaagtcaaacaaagggagaagtgattcatattcactatttttcagtcaatatggaattctagagaattttctgtccgacattgacctctggggagatggtgctcaaagggaacttgagtttaactgtaatatttcgcttgtatttacaagaataatgcgttcatgtgtcattgagaaattactatgttgttattacaatggttttgttttgactttttttctagcaaaactatttcattgcatcttactaatcatttaaaaagtagaagaaaatgcatatttgattaaaatagctctcttaagtctagttctcttttatgtatcatgacttgtgggttttatttttagtatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccaggtaaagcaggcctccaaaagtccagtttgtatgttttggactttgcaaatatggaaaagtagaaaaattaacactaacccacttttctttagtcagtcacccgttcttgtcaagtactctcccatatcaacaacatcctaaccaaggctgctgccacttcttatcataaccaactgaattccatctggcacattcttgcagaaatatccacagtctctgcattggcctccagtggaaagttggtgtttctgatacttagagtcagtaatacttctgatcaaacacttaagtgcacacacaacaggggagagaaaagaggagaagcaggctaccaagtcctgggacatgtgggtgcacccaataaccattgtcttggtcagttgagctcacgggtaattttcaaacgactattttgtcatatcaccagctgaagagaccatacctcctgaattgtgtcagtgacttaaaacagaagcataaagatcttctcatttactttttttttttttgagatagaatctccttctgttgcccaggctgaagtgcagtggtgtgttcttgactcactgcaacctctgcctcctgggttcaagcggttctcatgtcacagcctcccgagtagctgggattataggcatgcgcctccatgctggactaatttttgtattattattattattattattattattattattattattattgagatggggttttgccatgttggccaggctggtctcgatctcctggcctccagccatccacccgcctcggcctcccaaagtgctggggttacagacatgagccaccgtgtccggccccatttacttgttataacttgtctagaccacataccagccaatttgcatgggcttgatcccaagtacagagactaatccaaggtagatacaggaacacagagatgggttattgtatgtggcttacgtcaaaccaccattcctcctttctataatgaacaactggattttacctatgaggcactttgcagcttacatttctacaattctaattatcctctgaacactctgatacaggatgacactaataaaaattatttctgttttgaaccaagtggaattcacttaaatgattctttggatgagaactataagacaaagagttgtcaggatctctaaagtgtacttgggtgtggactttctggtcatttaatgcatggacaaatatatattaggttggtgcaaaagtaatgaccaaaatcacaattacttttacatcaacctaatatatgcatatatacatgaactgaataagtcaatttgctttgaggtagttcttctttttgtctgtgcaaaagcacagatatgaagaagaaatccatctttaacttctctacaggtaataagaggctctctctcatcatcttctccctctgcttcttgaaagacactggctgacagtgataaaaatgatctacagctcacttaagctacgatcaaaagacccccttctatctctcaaggctcccacttgaatgcggtccttcctggcccaggtgcaagagcttgtttccttctctgagcaaccaccaacaaggccagtgtttcccacagtgtattttaaagaccaacagttaatacagcaacgagaggttgaaatgaaaacaagcctttctagtcacataatttgagaaatccttaatgaagcaaacataaaaaggttgcatttaaaatcttggccgggtgcggtcgctcacgcctgtaatcccagcactttgggaggccgaggcgggtagatcacttgaggttaagtgttcgagaccagcctggccaacatggtgaaaccccgtctctactaaatatacaaaaattagctgagtgtggtggcacgtgcctgtaatcccagttactcgggaggctgaggcaggagaactgcttgaacccgggagggtgaggttgcagtgagctgagatcatgccactgcactctagcctgggtgacagaatgactctgtttccaaataataataataataataataataataataataaataaaataaaatctgaaggttttgttttttgagacagggtctcactctgttgcccaggctggagtgtagtggtatgatcttggttcattgcagcctcgacctccccagctcaagtgatcctcccacctcaacctcccgagtagctggaactataggcacatgccgccacacctggctaatttttgtattttttgtagagttggggttttgccatgttgcccagtcttgtttcaaactcctgagctcaaacaatctgcccgcctcagcctcccaaagtgctgggactacaggtgcatgccaccacacctaatttttatattttttgcaaagacgaggtttcaccatgttgcctgggctggtctcaaactcctgggctcaagagatatccacccgccttggcctcccagagcactgggattacaggcatgagcaccgtgcctggccaattcaaggttttcttcaagtcctagtatattaaagaggactttaacatgctaatgtgcatcaagtctgcaaagtctgcaatcttgcagtgttgtcaaaactcatttcttctgagcagcaacctatgtaattcatgaagaatttggatacaacctaatgaatcacacaattctaggatggaaagggatacgcaagaccttcctgtaccaacccgctcctttacagttgaaaacacagagcccagaagagtgggggtcaatgtctcacagctagttattaacaaatgtggcattagagcaccaaagttgccggacatcaacctcaaaatgacaatatattgtacttctcttgaacttccacacatgtattgcacaaacaccacccccaggccccaaacaaaatagctgggaagctctcgaatatcagaaatggggactttataattctaattccatatctccagtaagttggccttttgtagttagtaggtttctagaaatatgtgatcatggccgggcatggtggctcatgcctgtaattccagcactttaggaggctgtgggtggatcacttgaggtcaggagttcaagaccagcctggccatcatggtgaaacgccagctctactgaaaatacaaaaattagccaggtgtggtggtacacacctgtcatctcagctacttgggaggctgaggcacgagaatcgctccaagccaggaggcagaggttgcagtgagccaagatcgcaacactgcactgcagcctgggtgacagagtgaggctctgtctcaagggaaaaaaaaatgtgaagatgattattttttggtgatgaatacgacgttcacatcactatagttccaaaagaagcatgaaattcagagtttgccatggcaatgttttgtcctttttacttttgactacctagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggttagtactgtacctatttttacttaggcaaatggttgtttcctgcaacctcataacactcgtaaatgttccaatttaggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattggtaagaccgacttaacccaaagctgaaataactgaatctcggaatctcagcactggaaggaagggttataaagatcacctagttttactgcttctctgatgccaagtaagcatcagacccatgtttgaaaaccactggggcaaggttctccattccaacaccaccagtgatttttgctggacaactctgtgttatggagggctgtgctgggcactgtaggatatttagcggcatctctggcctctacacactagatgccagtagtatgcccctctgtccttgagctgtgacttttaaaaaagtctcagactttgccaaatgcccctcaaggggtaaaatttcccccagttgagaatcactgcaccagaaaaagtgaatttagctgcttaaaagagaccatttaatccttcatgagttctgacaggttttgtgaaatttctgcccctgggtcctgtgatggactagtgccaccccaggtgatttgagtcccttccctgtagaatagcctctcttagctgttcacaggcagcacgtttcccatccagaagcccttcttctcccaggctaacatctctctctctctgaatttctcactgttctggcccatctcctggatgttctgcagctcgaatatctctcagtgtgcaattctcagctctaaaaattctattcgtggttttgtctgctcagttctcaatagagaagacactctccctcatcccagatagttctattagtgaaactcatcaggcgctctcacatggcattcttagttatggagattccagatttcaatggtgggtggttattatgggctgtggggccagactgcctggatttggatcctggctccaccactggctgagtgaccttggacaagctgatcattcctttgtgcctaatcttcttatctgaaacaatggagaggaatcaatacttcctgtgcagtcttcgtgagaattgtgttactaatgataaagcacttagaacagtgcctggcataaaggtttaataaatacactacaatattatttagaaggtatgatttggctgtgacatatctatatccaatggaatataactttgtgtaaagaatcatagcccttactaaagaggttatgcaattctctccagtagtatatttcttaggtgaactaaaaatgtcactttcatgaaaataggcaataaaagatgccgaggaagacctaggaaacaatgatattaatatgaaaatggatatgatctagtacagaccacaggaattcatttttcttttatgattttcattttattgaggctgattcctaggattactaaaataaataagtactttcttggttaagaattttcttcatagggtataggaggctctgaagccagtggatcccactcctagcttttccctattaattgtgagatctaagtcatattacctaagacaaggacactcattaagaattcatttcccctcacctcaccggaccataagacaatcaagtgagatctcaagggaaaggacattagagtcctaagtaaagacaaatttagcccaatccactcttcttcttcttcttcttcttctttttttttttttgagacagatttcttgctctgtcacccaggttggagtgcagtggcgcgatctcggctcactgcaagctccgcctgctgggttcacgccattctcctgcctcagcctcctgagtagctgggactacaggcgcccaccaccacgctcagctaattttttgtatttttagtagagagggggtttcaccacgttagccaggatggtttcgatctcctgacctcgtgatccacccgcctcggcctcccaaagtgctgggattacaggcgtgagcccccacgccctgccccaatccattctttttgatgcaaaagaaaactgaagcttcctgctccagcccccaaacaaacaaaaaccaaaagacgcagtaaacaaaatgaaattaaaattaaaaactgaatctcagaaaggggaagtgatttgttcagggccacatacctactgggaagaggcaaggcttggtggaaggtccagggaaatgttctctcagtggtcaggtttattctgggcctggtacaacttgagtagtaaagggggatggtgggtgagtcttgcaatgagctgagggggggaagtaattcaagcattcaactctatttggagtagtaatccttgtagtttccagaaagggtctcttcttcttcagcactataagacaagagtattatgggaggccaccggcttcctgtggcttggagatcagttgattaagacctgatggtaaatatttgaaaaaagcgtatcttagaaatgccttgagaagtgtgggtggattggaattatcagctttgatcactgattctaaaaaaaaaaatcactgatctttcgttccctaacttagatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcaggtaattactcagattattccaatatttgataacagacatttgttttagaaacatttaaaaaattatcttcagtgactgcaaccaagttacagcttggtactaacaaggtcaaagttaacttaatctacccaggtattatagatataaccaaatagatataaaccaaatcttactggccttttgttttgaaagaacatacttttggttgaaactaatacaaaggattagatacagactcattggtactagtgctggttaaaatctaaaatgatagacgggtgcggtgactcacgcctgtaatcctagcactttgggaggccaatgtgggtggatcacctgagaccaggagttcaagaccagcctggccaacatggtgaaaccccatctctactaaaaatacaaaaatcagccaacgtgatggcgcgtgactataatcccagctactcgggggcaggggctgaggcaggagaatcacttcaaccagggaggcggaggttgcagtaagctgagatggcgccactgcactccagcctgggtgacagagcaacatttcatctaaaaaaacaaaaacaaaaaaacaaaaaactaaaataatgcagctactataaaaacgatatgatgaattctcaaaaaattagaaatagaattcccatacgatccaacaattccactgctgattacatatacaaaagaatcgaaagcaaggattcaaagagatgtttgtacacccatgtccatagcagcattattcacaatagccaaaagctggaagcaacccaagtgcccattaaatgaatggataagcaaaatgcagcatatacatataataggatattatccagcattaaaaggaaggagattctgacacatgctaccacatggaggagccttgaggacattatgctaagcaaaataagtcagtcacgaaaggacaaatactgtctgattctacttttatgaggttaaatagtcaaactcatagaaacagggtaggatggtggttaccaggaattggtaggagggtggaaggagaggtattgtttaatgggtacagagttccagttttgcaagattaaaagagtgttgaacattggtgacacaacaatgtgaaactatttaatatcacaaagctgtacacttaaaaaggattaagatggtaaatttcattatatgtattttacaattaaaaaaactcattagcactaatagacaaaaatttcaaggggaaaggaactgagaagaaagccaatcaacatttcttgagcatcaattatgtgtcaagctttattatgtgtttattccatcctcacataattctatgatgtaattaccattcccattttataggaaagtgaggcaaaagagatgaagtaactctcccacagtcacaaagctaggaaaaaaaataggattccaacttatgtcttacagagagtagacaaagccaattcaattagattcaacaaatatttacaaattggcttctttgtgagaaataagactgtttctgccatggagtgacccaatcttgtgacatacttgcccagccttggggttgccctcccacaggaaaagccagtacagctagagatgggggtgtgggcacagagcctgctctgcagagaggaattgaacggaatctgtaaggatgaagagaaactagtctggtgagaaaacatgagaaggactttcttagccagagcttcccaaaatacttacactgaaggactgtgtgtgcacgtgtgtgtgcgtgtgtttttataatgtctaatctaccatagattggtgcttttgtcaaatacaataaaaatgatctgctagaaaaaattaaatatagccaaagacatgtaaagtgtcagttcactgatcatgtgtttggatatcatggcaatgtcaaattgctatcaaaacttccaaattgcagtcataattttatctgtatttagcccatcacaagccagtaataaatagttcctgacttgcaccagcctaggaaaaggagtaactttatgcttgagagagtatggttctttcagtcaagtggcaagtaattcagtctgcctggatgcctggacataagaccaatgctgaaatcatgactctgtatctgacattgtgatttctcccagagtggctctataagattttgctaaaaaataaagaagtggcttcttttttaaaaaccatgactctgggcaatggatgccactgaagagttttacacaatagagaaatatgtctacatttgcagagtaaaagaagatttttggtagcagcatgaaaactggatgtgagtggggaggggcgacatggacatatgatatcagttagcggctactgcaaaggtccaagcaaaagataataagagctaaaataggcaatggtcacagggctggagtaaaaaagggagaaacacctccgggggtattcaagatacaggtgtcaggagcacatctctggtacaggggactagctggatggtggcgaccatgatcagtagaaggaaaaagaagaagggctcattcatgagaaaatagcttcatttcaacactagacaatctagcgttcatgtgacattatttagtaatgtgactatagattatggagagacaaggtgagggaataatgcattctagcataggccactccagtctttcagtctggaaacatcagctgggcctggataggaacacctggatcttgaccgttgatcatttcgtatattttggttacaagatagcgttccactgaagggtgactgccaacacatccacactaacgcacctagcataaacgaattaatgtgtgccctgttgattttaaaggacttgctgaacagtgagtcacatgacctatataggacctcccattctgataatcggcagaactaaattaggtgtctagagattcttctaatgctatctttccccacttagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttctgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatattggtgttggtaatccagatcttactgatttcatcaattttatatgtcctcatttgtttgtttgtttttttgtttctttttggacagagtcttgctctgtcgccctggctggagtgcagtggcgccatctcagcttactgcaacctctgcctcctgggttcgagcgattctcctgtctcagcctcccgtgtagctgggactgcaggcacatgccaccacgcctggctaatttttgtatttttagtagagacagggtttcaccacgttggtcaggctggtctcgaactcctgacttcaggtgatccaccggcctcagcctcccaaagtgctgggattacaggcatgagccgctgtgccgagccatatgtcctcatttgtatgtgtctgtttggttctatgcaattttagcacatgtttaagttcatgtacccatcaccacagtcaagatacagagcagttgcatcatcacttgttacacttttataaatacacccatctctctctcctctcttctatccctgaactctggcaacgagtagtctgttctccatctcttcgattttcccatacctaattttgactttatacttttttaaaaaaagaagattccaaaactgtgtaatctatagggtcccacaaaatctggatctgtccctgagccttcagcctagcagatatagagtataaagaggtccatgcatcaccgggactcctgtgttagctctgcaactgtttatgttacgatcaaatggactagtttgcttggcaagtaagatgggcatcgtctctgtcagtgagatccatgaaggataataatatacccaatggcagctatggatgaaggggcacatttccagtcttaccctgacacagatgtcaattccacacccaggacatgtggtattgcaccttgaagatagaaaattcataccctgtgttggccgggcgtggtggctcactcctgtaatcccagcactttgggaggccgagatgggcagatcacgaggtcaggagatcgagaccatcctcggtaacatggtgaaaccctgtctctactaaaaaatacaacaacaaaaaattagccgggcgtggtggcgggcgcctgtagtcccagctactcgggaggctgaggcaggagaatggcgtgaacccgggaggcggagcttgcagtgagccgagatcgcaccactgcactccagcccgggcaatagagtgagactccatctcaaaaaaaaaaaaaagaaagaaaagaaaaaaaaaaaaaagaaaattcaaaccctgtgtttgctattatccaggtgtttccggcaagtcaacataggcattgtatgagagaaggaaacagttaaaaagcaactagtgcgtctcatgtgtatgataaaccattcagcctggggaggcacacacacgtcgttaactgttgcactaggtctataagagcatgggatggtgggaagaagactggagccttacatagaaagcccaggtttaacattcagcctttacaaggattgattgtgtatccccagacaaataatttctctctgtttcctagggttctcaagataaaggagataacatccagctttcctgccccacaccgtatctgaaataaaaacaacagcagggatagcagattacatgtgttttttaatttttatttattttgccaagcactatgctaaatacataatcttagtcctatcaaaaaacttgtttggaaagtttaggtaattggcttaactctgttctgcatggccaacaagtggcagggatggggctctaaccccagattaactgactctagcacttgatctctggacactctggcatggtgggacaggattctgcaagctttaaagtgctgggtagattaaagtcttatttaagagatcttggggatgggtgcggtggctcacaccagtaatcccagcactttgggaggccgaggtgggcagatcaggagatcgacaccatcctggctaacatggtgaaacttgtctctactaaaaatacaaaaaattagctgggcgtggtggtgcgcgcctgtagtcccagctactcgggaggcaggagaatcacttgaacccaggaggcagaggttgcagtgagccaagattgcgccactgtactccagcctgggcgacatctcaaaaaaaaaaaaagacatcttggtagccaacctttgtgattatgggtgatcaagcatgtggatgccatctctcatgaatcctatgaggtattcatcaaccattggaagagtatacataggagagatttagttcaggcacatgccaaaatgttctactatttaattcattcgcttaagctatggggtaggtcttcaggaaagtctcgggcagtgacccatcagcccatgtgaaaatgactccgatctgacacacagcaggtagatttccactgaagactgggaaagataaggaaaggcctaataaatggagaactgttctgaatctgccagggggctggtcgtgctaagttaccgagttcccaagggagaatagcgtcccctaaagttgtgcaacacacaaccagctcagccttacaggggtagccctcacatcactcagagagacttacaggagcatcatgagccttcctggggagagggaactgaaaggacactaaaaggaagtgagaatgggctaaactcacctgcttcataattctgttgagaccaatcttcccctccctcccctcctccctaggttgatgcccccacctaactaaactgacccagcacacacaggactttcctcgacatggctccatttgcaccaggaaaattcactctgttccccaggagggaaacaaatacgagaagcattaatcagtctcagggaatttttaacaaggtcattaattttgtcaaatgcctaaggtggaagtttaatttttgttacttgaattcaatagacttctttttaaaaatgctttatgttactccccaggggcacaaaactcactggctcaaaactattgctatttctaagtgtcttcccaacacctctctctatatgtattcaattttggagattttaaaatgctgtctaaggaaacttaaaccaagatgatggataccaaggtcagaatcctagataagaagttagttatgctttctgagtctttgacttttgaagtcatagtcaatgttgactgtagagaatttagaacgtattaggtgaaaaagaagcactagatattcaggacatctaggtttttagctacggctctgccaacatctagctctatgttataagctagagatgacaaaaggtaatgttttgtgagcaaagtaatcagagactgcttagagtgcagcattgaggattctgaggctaaatttagattgtcagaaggaatcgtgatctcctgccaccactgcaagggacagagtggtgacgagcatgacagggtttttccaccctggcctagtcagtctacacctaacctctctgggcttagcatcctcacctgtaaaatataagtgctgcactacaaacctgcttccacctctgccattcacattcacctcctctgcaccaccccactgcaaaagtgctgagagtgaaattgtgatccataacgagcgcttattttaagcttgtttttaatttattattcactctccactttagagctctcttaccattattatttcctaaataacaccttcctagtttgaatctgggctcattatagttttcccccaggtgtacctcgttgccattatctatagcaaatcccatttcatttactgccatccttttcatgaagatgagctgattaatattactactcaccttataaatccatcctttctggaatttactcctctgctcagtttaggatcattagtgaatttaatcaatgtagactttccattttcatcaagatgattaataaacgtaataggaagtccaagcccctctgggacattttgcatggctcttttttatcccttgaggatgcagcaataattatactcagctaggagtccatcaggcgattttgctgctacattcatttcctttaactatgctttctcctcttttgccttatcttaaaaacagcatgctgcagccctcccactccattttactccaagactcaactcaaatatcaaccctttcatagttattaatttcccccccccattattttaatgtaagaaaatggaggtcctgagatactaaatgactcagcagttgtcaaacagccaagaagtggctattaatatacaattttctcaaatagatgacatatgagccaatcagtgaattagaatagatttgattaactaattaacccattatagcccaaggttatttaatttaaaaaatgagacacagagtaagttttgattgatgagataaggtgagctgggagaggctgggggtgctgtccagctctgttggtaaggtccctggccagccaaggagcacaggggacagcagggagggggtatagttagcaagtgagtgctctttgcttgctctgaacagtgcctgattggctctcctgtcctagaatttccagagcatggaattttttaaattaaaaacaattgttttatttcagcagctttaggggtacaagtggtttttggttacatggatgaattgcatagtggttaagtctgggcttttattgtacccatcagctaaatagtttacatcatactgaataggtgacttttcatcccccatgctcctcccaccctctccccttctgcgtcttcaatgttcattataccactctgtatgcctctgtgtacccaaagcttagctcccatttataagtgagaacatatggtatttggttttttgttcctgattactttccttagggtaatggcctccaattccatccaagttgctgcaaaagacattattgcattctttttgtacagctgagtagtatttcattgtgtatgtttaccacattttctttatccactcatcggttgataggtacttaggtggattccatatctttgcaattgtgaatggtgctgtgataaacatgcacgttaggtgtctttttgatatagtgacttctcctttggaagatttctcaaaaaactaaatgaggcctacaatttgattcagaatttttttttaagagatgaggggtctcactatgttgcccaggctggtctcgaactcctgggctcaggcaatcctcctgccttagcctcctgagtagctgggactatagctgggctgggatttttttttttatggaagtagcagtttcattttatcagtactcgttatcaactgccctagatcagctggcttctctgtcttatcttaagagctaacttcccaatttttacatgtctttctcctttttaaactttcttaacttccggattcttctgttcctttgttatctttgctgtctcctgtttatcgaaaccttttgtttcctgaccctggtcttcatgaagctgtgtgttttctcaagtccatcatcttctcttcttcccgccatccttgaagctcaaatgccaagtgtgaaacgaggaatgatgaaaataaatttttccatagtcatatccttgcttgaggaaaagagacttatgtgggtctaccctgcacttatttctggccgtgtctttggtcaggatcagtggttctgagaactgcttcttctgtgacagactacaatcactgcaattgcccttcaaagaaacgatggagttttgctttgacctcactgaaagcaaaatttgatggccaaaatttgactttcgttagtcttgagatgtatggcacctacacccaggggagtagaagactcagcaccgttttcagatcactcattcatgaggtcacagcaattttcagatcactcattcatgaggtcacagcagacaggggcacagcagacagctccttaaacatagagatgtgttgttcataggaaatcttggcctttgctttcctgtcggagtttgagctggtggagtgggggtctcagagtcccgtgacacatcctagaatctgttaggacttaaggaaaatgggttgaggtagggtatcagggtggcctatggcaatatgggctggaaggaaggccaccccagagaaactcctgtgcctttttcttttgacttgatattcatgggctgatgtgtgaggtgacttggtacctttgtcctgggcacctggaatcaaaaactgaagtcacctttgggaccatcaaatgcatcttcattttccagtttgcctgcattgtgccaaggtcccgcagctccaacctgattccttgcactctgactcccacctggagctctaatcccttctctctgtctctcctgatcccgtcactctccttcagcagctttttcttgttaaattctcacactgtggcaaaacacgaaggaagatgaaagggaaatgttgtaggagggtccacatgagctatccctaggccttccaaaataatcttgcaaaactcttttgaggttacagatgggagccactgggtctacacagtagcagaaattgcttaaaagtaacaagagttgacccaataacaacatgaaagacccacttaggcttacctaagactaacacagcttattgtggttctgctttccctgtgtagacagatggcttggtcacactgcttccttttgtccaggctggttagatcccacctggcagccccaccatttgttcccaccagggggggcggactgcctcacgcctgtggtcatcccactagcctgaaggaggcctaacagggacctttcagatttcatctccaaatgccaggagcagggagttcccacagtgctttcaggcgcagccacctctattggtgcctacatcacccttctaggcatacattctgcctcatggagggatggcagcttgtgggagggagggatgctgtcagggggccagcccctgtgcaggacatattcatctacatcatcttttatcatcacacacatgatttcctaatcacacaggtgagaaaacagatgcagagaggtgaaggaactgctggaagctacacagatagtaggtgggacatccgggtttggaacacagctagaggattggctccacacctgggttcttttcgagatgttccattgccccgggggctattactccagccagggaaactgaggctggaggatgggccacactcagcaagaggggctgggggctgtgcaagcaggaagctctgccagctcttgaccctgtcagcctccatccagacaagccattgggaatgaagttagcctcttcaggccattcttgtctaaatgttcctgtccaagttcttcataagattcatcttaatgaacattttgaaccctaaatccttgaagggtaggaatacccatacccttttctgttcctcagtatctagaatatttggtgtgtgtttatttctcctggcctgagtttatctctctgcatttttagaattctgatagcactccaattttggccttgctttgatgaaagggaaattatcttgatgaatttgttgacacaatgcatttcatcctaatcgtaattatagtaagtaatatttattgagcacctgtgtaccagcactgtgctaagcacttcacatgtgttaattcattcgatccttatccctgttttataatgcaggacatagaagctggagaggctaccctgccgaaggtcactttggtagcaagtggcagaaccaggactaaacctttttttttttttttttttatgagatggagtctcactctctcacccaggctggagggcagtcacacaatgatctcagctcactgcaccctccacctcccatgggggttcaagcaattttcctgcctcagccaccggagtagctggaattactcatgccaccccgcctggctaattttgtatctttagtagagacagcattttcaccatgttggccaggctgatcttgaactcgtgacctcaagtgatccacccaccttggcctcccaaagtgctgggattgcaggcctgagccaccacacttggtctaggactaaccctctttatcccttgttgcttacttctatgtgatgactacatcctctgcagccagctttcatctgctttagcaggttgataaaataggcccagcaaccccttatagggaagaaagttctgggttgcttggggggctccagaaggtacatagcccttggtgctttgtgggaaagcctgcagagaagaaaactgccatgaggaattccccactcaacttcatcaagtctagtcctactgggggatattgcagacaagcagtactgcagtgagccatccagctgatcctgaatgcacacacaaatacacgcatgcacacaaatacacacacgtacacaaatacacagtctccatttcctctctctattcggttaatgcaagcccagttccaccagatgaacatagtgcaagctgtgtgtgtgatccgggtccttcactactctacacattttgttcactgaggctgcattttgctgccctctttttatttctctaaaccaggtacctcccacagtccatttgacagctgccttgaaagctcactcacccaaaaggtctgctcctgacttgcctgcactggaagcctgtgatctggtttgggatgttcattcatgaatgatgccattctcccctccaactggaggcaagtcacaggaagctagttaaaccctgtatcatagactgccatattgacatcctctcaattatccaaccctgttggtgccatttgaacttctcccagcacctgctggctctaaaaacacagcaggcctgctctgttggaagcatcccatcaatttactaattagctcttttccctggaaacctattgttgagtctgaaatcagattcaaaatcaatatgtaagcactgaaagttcatacttacatgcagaatttaaggtgtaacaggcttccaaatcaaattcatctcctaagagctagtagtctaaacttcatacatcatagaattctagatcaagagagactgcagccctaaaagggaagtggcttgacaaagctcccagaggcagagctgggactagtttgggtccaatacttgcagtccttctgccctctgtgttgccactgtcccagcccacctgcaccccatgtcccactccatatacattctagggtcatagaagaatagcagactattggcttatttgcaaggtcaaatgcttaagatgtcaaaaataatggaaactgaggtccccagacaccagacaactgaatttcccaaatgctttacgttagtgatgcctaaaaagcacccaggaatcaaatggggagtctggagagcttctcctccttacaagaataggctgtgtgacttcttctttctgaaacccatctttgcataaccaaatggcagtgcccattgatttcttgaaaagaaacatctgtgacttcctttttaatggcaagaaaggtattctccttgagtcagagcagagagtcaaattacctcgaaatactttttttttaatctccaaggttggagaccccagaattcaaattaagactatactacgggatctcccaaattttatagtattgaaattcttaatcattttgacccaaagaatgtatactctcagtgggatcttccctccttgctctactttcagtaaaaccagagcaggtgcttactttaattcactaatgtactggcatttttttttgcataaataagtaactgaacagtagataatccacaagtaatgtctacttcgcaataggtatgtgaaatcttttgcttgcacaaaattttcctgccaatttatgttttcttcaaggaaaagccgaccttggttgtgttttcaggggttagttctgttttcaactagctataggggagtagccctaatgcatttggggcaactggagaggccaggccaggagaaatgactaatgtgccacctccctcccggcagtgaccgtgactttgcttctcacgtagtaccttgtatgcatcaataactttttttcatttaatgaaataaaatcagggttgcctctatatttttgctaattcagtgagaatcttcgcttatcaaagtgagggctgaagtgaataacttgagagtggtttaactgaaaagatttttgtaatcatggtcagaagaaaacggtactgttatcaaaacttgccatatcaggctaggggatattgcacaagttgagacccaaatgtgactgacagtgtgaccctgataattatttacaacactgccccttctttctgcaggacccacactttttctgttggtttaacctagttataaacaggataactttttttctgctgatgtaccacttgctgaatttgcatccggtgtctataaacctgcagtttctgaatgtggttgtcaggatacttgcataatggttacgagcatggaatagtttcagagatggggccatgaagcaggctgaattccttactcaggaaatcgactgggaaataaagtaagacggtatttgatttgctgttattagtttgtcccagctactctttacattaactaagaaagaatgcaataaaaatgaagtctaacagagccctcagttccaatccagagaacggagtattaatcctggaaccatcgaggatctgtaggatttaggaagacaaaagctttgccactttgagggtctgttttccattatttaacaaaatgtggctaatgcctttttgtaaaacaatagacataagtatatttcaaaaaaaaacttgaaaaaaaatactatagccatagggctaggcacagttggtcacgcttgtaatctcagcactttgggaggccaaagtgggagaattgcctgagtttaggagtttgagaccagcctgggcaacatactgaggccccatctctacaaaagattttaaaaattagctaggcatggtgatgcgtgcctgtggtcccagctacttcggaggctaaggcgagaggattgcttgaacccaggagttagaatctgcagggagctatgatcatgccactgcactccagcctgggtgatacagcaagactctatctcatataaataaataaatagtatagccataggtttttaataaagggcttcagtcccacctagagtttggggaatgtcaggagaaacggtagtttgcaaagcagccacctttaattagagaagctgcctgcacacttagccttatcagaaacggggatacaaacaatagaacagggcttcccacagtgaagcacagagagctatagggatcatgctcaggagagttctcaatgaaaagcaatgcttaaaataagtgaagcgaagctcctatgtattcagtgtgccctcagttttgcagagggagggaggggaatgggattcctacatcaaggctaagagcacggactggttgggcttccgcacttcctagctgtgtggcctgggctgacttactctgtccttttctgcctcagttcctccatctgtacagtgagaataatagtgtccatctcaaagcatcgctgtaagaattaaatcgagaaagtacgtgaagcactttacacagtatctgagcacctagaagcactcagaaaaagcgaatgcaaaaatatgtatagaaaataagctcttagttacttccagtgactactgatttttcttttttcttttttatactttataaacttttaaagttccagcagcaaaaaggcactacttttgttttcttttcttttcttttttttcgagacagtgtcttgctgtgtagcccaggctggagtgcagttgcgtgatgggctcactgcagcctctgcctcctaggttcaagggatcctcctgcctcagcctccctagtagctgggatgacagccatgcggcaccacacctggataatttttatatttttagaagagatgggctttcaccatgttggccaggctggtctcatacgcctgacctcaagtgatctgcctgtgggcctcccaaagtgctgggattacaggcatgagctaacacacccggcccaaaaaggcactgcttttctaaaaccaattttattaaaggtatgtgtacatgaagtgacagtaccctcaactgagtgagtggtgctagaaaaggtgctggctggggaaggatctatggattatatatttcaactgccatgtgtttagatgaggaaaccgaggcccagaatgaccaccttcacagcaagctgagactacaagccaggtttccagaataggcagggatgaaagcactggacaaagcctgcctgtccggcactaatcactgggtacgcagtgacgacatgaaccaagggaatgaggagaagggacagcggctgtaaaggatggaaagagtcaaagtgacttcgaggcttcaggtctgggggcttggaagaatggagactgaaatgggcagttagtgagagaaggggtttttatatgaagaagaacatgcgtttggttttgaatgttgtcagccttgagaaacatccgagcaggttttacctacggacagtttaagatccaggcctggagctgagtgtcaggcaggaccaggaataaaaacctgggaaaagacttcataaaattaaaagatgaagtggtataaacaaacttttcaaagttcaaagaataggccacagtggaaaatagcaaagggtcaaaggatgagtggagagggccaatcgaaattaaaatggggagaagggccatctaagaagagatatgggcaataaagctgaggactcggtttcaaggtgggctcaactatacacagtctgaaattcaggaaggaggtcagtaaaaataaagctggaaaaagaaaccaagcgtcttttgaattagactaggaggaagtcactgtgattaaaaaagcagtgttagagatgggaaatgaagcagcccgaatcccttacataatttttttttttttttttgagacggagtctcgctcttgtcacccaggctggagtgcagtggcgggatctcagctcaccacaacctccacttcccaggttcaagcaattgtcctgcctcagcctcctgagtagctgggactacaagcatgagccagcatgccctgctaatttgtatatttttagtagagatggggttttgccatgttggccaggctggtcttgaactcctgacctcaagtgatccacccgcctcagcctcccaaagtgctgggattacaggcgtgagccaccgcacctagcccttattcaagaatttagactgggaaataaagtaagaaggtatttgatgacagtggagagagatggcaaagcagggtcatggcttattcaagatgaaggactctatgaatatttgaaagcagaagggaagagatgaagaaggagattaaaactttcgggaggtagaagataaagcttggataagggtcctcaggaggcaaaaaagcaagagaacaaggcaaggctggaatcactagcattatatcccaaggtatctctccttcctgtcacttgaatgatttgagttttaattattttggaagtcttaggctattaacaaggacctgaaaattccacttatgtatttcttcttttctagaggaagcagttcatggcaaactgagcatggtaaccttttctcctggtgcggtgtggttgaaatctcaccacagtatttagcacgctcgtcattaaatcactgcttgtgttgctatttgctgagtgtgattctttcctaatggactccatgacaggagcacccatatgtgatctttcgaccactgaatcccagtaatttgtacagttccaaacatataataggagcccagtaaatattagttaaatggatgaataaaggaattaatgaatgagcagcctctcccacggaaaggaaactcatattcagggagatgacacaggatttacattattcaatccggcaggttagcaagcacataacctctttaaacactatttggtaaatggtcttgagtttttcttttctttttttgcaggggggctggtgggggacagagtctcattctgtcccccagactggagtgcagtggtgcaatctcggctcactgcaacccctgctgcctgtgttcaagcgattttgtgcctcggcctcccaagtagctgagattacaggtgcctgccaccacgcctggctaatatttgtatttttagtagagatgggatttcaccatggtggccaggctggtttcaaactcctggcctcaaatgacccacctgcctcagcctcccaaagtgcttggatttacaggcgtgagccactgcacttggcttgagtttgtcttggacgcctttctagtacttaaaagaaaaattacacaccccaaagctatcatagaagttcctagaagagttaatgggtgcagcacaccaacacggcacgtttatacatatgtaacaaacctgcacgttgtgcacatgtaccctaaaacttaaagtataataataaaaaaaagaagttcctagaagaatctgtcccttaaatgtagattcaaagcaaatttaaacagagaataagtggcatacaaaatactgactttctgtactgacttaatggcagttttattcctttcatgtctgtaaaatgggaataatggtaaggggtgctttgaagatatttaagattgaaaagcacttggagtctgatgcctttattgttcactacaagtattatctcatactttacttcctccaaaagtttaatttccaactttgtattttgattgtgatgccattgggttactcaataggcttatctttttgtggattttctatctaaaaaccttactacgtaccaaaaacagataagctccaagatccaagtggcacagtacatggaatgaatgccataaatatttgctgattgattgaataaatcattctttaagaataaaagtggcctcactgccatcatttcatctcaccctatatcaactttgtgagatggctgttacccttcttttacagatgagaaatcttaggctcagggaagttaagctacttgcccaacaccacccagcaccggcaactcaaacctgagctgtctgatgacccaagcctcatcatttcttttacctgctgcttctaacttggactttatatttttttgtttcttttttgttttccaccaggaaatgatgaacacaagcccttgagagagtggtttgtcattgtgattatggcaaccatctgcttcatcttgttaattctctcgcttatctgtaaaatgtaagtgttctttacatttgcgtgcttgcagtggggtttcagtactgcatttttacaggcttaccatgcatccggtaggcagagggttcttattatcaggtaaaatttgtggcatttttgtgcctagatgacctgtccaagatgagtgtaggccaaatcaaaagtggaaatgtccagaggtgatttacagaagttggacagagcacacaatgcagccctcagctatcactcactcctacctgaagttgtcgacagcttttaatttctgtgaaggtttctacttgcgggtttcttttgattccttctcagtcttccactcggtccttggctgtctagggtaagctgccagtataggcttttcacagctcagggaggctaaaatcaccacaatgcctgcatgtcatcatcctcagctatcaagtcaccaggcccctgagtggctgatggttattaggtcaaacacggattctagaaatcgcatgtggatctggtatcctatcctagagtccacaaatggtccataagtatcccttacccattttagcattcagtaaggcacaagaccttttaggaggcttaaaaacatgttttgtcttggccctttcataatttagaaaatgagttttataaggtccgggtgtgggggctcactcctgtaatcccagcactttgggaggccacagcgggtggaccatgaggtcaggagatcgagaccaccctggctaatgtggtgaaaccccgtctctactaaaaatacaaaaaattagctgggcgtggtggtacgtgcctgtattcccagctacttggaaggctgaggcagtagaatcacttgaacctgggagttggaggctatagtgagccaagatcgtaccattgcactccagcctgggggacagagtgagactgtgtctcaaaaaaaaaaaaaagacttttctattaaacagctttactattataaacgttatattcggatggcatctacagtttgggggaaggcagtacaaaggagatgaaaagaaagtaaactcggctggggatggtgactcatgcctgtaatctcagcactttgggaggctgaggctggaggatcacttgaggtcaagagttcgagaccagcctgggcaacatggtgaaaccctgtctctacaaaaaatacaaaaattagctgagcgcagtggcatgtgcctgtagtcccagctactcaggaggctgaggcaggagaattgcttgagcccgagaggtggagattgcaataagccacgatggcgccactgcactccagcctgggtgacagagcaagaccaaaaaaaaaaaaaaaaaaaaaaaaagtaagtaaactctgtgagtaaacataattgaggaaggaatgcttcaatcagcaccacccacttgaaatatacagttcgttttcagatattaggcctggtaacacccactgacacaaagcagtttccatttggtcttccctggatgactcagggccacagcagaggcttgcggtacccacaaagtcttcacctataattttggaagtcttggtacgtaaagattttgaatttacaaaacagcaggttctagaatcaaccaggtcaatttttagagtagatatttagagacaaaaggtatactcatgctcacctaattccttctttactctgttttcagatgtcatttatggatcaagttgtttccaccaattccagcaccaaaaagtaatatcaaagatctctttgtaaccactaactatgaggtaatgttgaaagttcttatgatatgccgtatgtgtccagggttgagtcccctgggagctgtcattcggttcttagttttctatattataaggcagggtttttactcagaaggccaggagcatttctgttgcttcagtcattctgttctttggctgattcagttgtttgtattttttaagagatggggtcttgctatgttgtccaggctggtctcaaacacctgggtctaagcgatcctcccacctcagcctcccaagtagctgggactgcagaagcatgccaccatgcctgcttgcctgattgttttattatgcacgttcattactcttctgacatattggaaaggtactgagttataagtgttcttgacagttagacttaaattttaatttcatatcagccatgccttaactgactttggacaatctcttcaaccctctgagttctgaatttctttctggtataataagggacacagatgagattgtacaatgttctgcttagctctaatgttttaagactccatgtttccacatgaatatcttagttaatagagaattttcagagggaactttagctctttagtataaaaaagaccatagaaaaggcaaattattttacccaatatgcattttcttaggcctgttcaccattcagagcgcttaggttcagcccagtggtcacttagttatggctctccaattgttccagcatcatttgttggagtaaatcatcctttccccagtgaattgccttggcatttctgtaggaaattagttgctgtatgtagttggttctatttctggactatctgattggttttatcgatctatttgtctatctttatgccaatacaatactgtcttgattactgtagctttatcgtaaaccacgagaccatttgtggaaggcctccaaaagtgattttttaaaaatttgttttggttattgtaggtcctctgcattttcatatacatcttagattcggctgacaattttctacaaaaaaaggtagctgggatttggggtgagattgtgttgagttgtcagttaatttggggaaaagtgacatcctaagtcttatctataaacatagcatatcactccatttatttaggttttctttaccttctctcagcaatggtttgtgatttttcagtgtatgattattgcactttgtcaaatttatccttaaggtgaacggttatttagatcagggctcaagaaactttttctgtaaagggccaggtagtaaatatttgagggacaaatggtttctgtctcacctcttcaactctgccattgtagtgtgaaagtagccacagaaaatgtgctaatgaatgagcgtggctgtgctccagtaaaacttcattttccaaaacaggcaacaagccagatttggcccgcggctgtagtttgccaacccttgatttagatcaaacagttttcttagcaaatttaggtttctctcaaatgaagtaactcatgattggatgaaccacctggtgactggttgtagggaaaagaaagcgttcgtggaaaaactcaccaaaatgattaatttcaataagtggtgaactttccttagcatttgcagtttgggtattggaaggatttatagacagttacagttactagctgactgaagtagagaatggaggctggcaaaagaatcattctgcccatggttggatctttgtgttctcctttatcaggggaatggcccatctgctcttgttcactgagttctttgggaagaagagtgggccccagggtggagctttggtgcctgttctggatgtgtgctgccagtccctccttgctctagcacacttacccctgagtaaccacatctggttttgtttgtttgagatggagtctcgctttgtcacccaagctggagtgcagtggaaccatctcggctcactgcaacctccacctcccgggtttaagtgattctcctgcctcagcctcccatatagctgggattacaggtgcccgccaccacgcccagctaatttttgtatttttagtagagacagggttacgccatgttggccaggctggtcttgaactcctgacctcaagtgatccagccttcccaaagtgctgggattacaggcatgagccactgcacccagcccacatctagtttaagcagccaactgaagtcatttgtcctggcctcttaatggaacatcttaatgctggtatctaatttccctacagagccccaaaagatttcctttaatattccgaagttggtgaaataaactggtataaaagcttattgtataaggttgtgatttgttgttaattaaaatcaagtcatgtgtgtaaaataacaacttggggcagacaagctggtttcagaataagcagaggatgaatgacggcactccacagcgcctggcttctcaggacaacttattctcttctcacattgcagagtttcacataaaaacaaagcagttagagactgagagaagaaagaaagagcacacagaatgggagaaatgaagtactgcctggtgctgtgggctctatggcctaaattctccacctgagaggggatgagagccagtgcagagctgcctacagctgggccccatgaggccgtgcacagcctccacgtccaaggacaaaagccatccaacccattctcagaggctgtgctacaagggtgacaagagggcacattggtgctatgggcagtggccactgggaaatgtttggctagtgggaaaggaaaccctctgcttttcatggtaatgtgcacctctgagcttggggtgggtgcccaaagtcccaggacttagaggagctctgccaccctagaagcaagtttttgcttgttcagacctcagttagaaatttggacgtcagtgaagggccggtcacagtggctcatacctgtaatcccagcactttgagaggccaaaatgggcagatcatttgacctcacaagtttgaaaccagcctggccaacatggcaaaaccccatctctgcaaaaaatacaaaaattactcaggcacggtggtgcacacctgtagcctcagatactcgggaggctgaggtgggaagatggcttgagcccaggaggcggaggttgcagtgagctgagattgtgccactgcactgcagcttgggtgatgtagccagaacttgccaaaaaaaaaaaatacacacacacacacacacacacacacacacacactgtgaaggaagaaagttggcctttagcagtcaaaaagaaaggcttattctaaaaaagcatatcctgaattttctgataatttacttatttagacaatttttatagagacaagatctcaccaggctggtctccaactcctgggctcaagctatgcgcctgcttcagcctcccaaagtgttgggattacaggcatgagccacgccacctggcctgagctttcaatttatgagactggtttccagctgttccttgtttctacaatggccaagagagggttcctcctccaattaggttgcccgtaaactattaacagtaaaatggataaaggcaggagccatgcctgctgtgtgcatcagtgaattcccgagacacggcactgtggctagtgtggagcagatagtaaaaaatattttggatgagtaaatgagataaaggaataggatctcttacaggcaattttattttttgttaccaattttccaattattatcagcactattcattatagccaaaatgggtcagaactgtccaaagttagggggatactgtagtaaattatggaaggaatatgatgaagctatcaaaagtgatgccgccaaagcacatttaacaatgtaatttacaatcagtgatgtcagagagaaaaaaatcaatttttaaagatgtgtatccggccgggcgtggtggctcatgcctgtaatcccagcattttgggaggccgaggcggggggatcacaaggtcaagagttcgagaccagcctggccaacatggtgaaaccccgtttctactaaaaatacaaaaattagccgggcatggtggtgtgtacttgtagtcccagctacttgggaggctgaggcaggagaatcacttgaacctgggaggtggaggttgcagtgagccgacatcatgccactgtactccagccagggtgacaagagtgagactctgtctaaaaaaaaaaaaaaaaaaaaaaaaaagatgtgtatccatatgacttcaagtaagtctaaagaaaacattatgcctagaaagaaaggcttaggagaagcagtgggctgtgtttgggagatagatgtatggctaggtattttcttcttcttcccactttatttttcacatcttctttgtgaacatttactatttttatttaaaaaataatagacttaaagccaattgtaaagatttcaaagaacccaaaagttctctaaaagacatctaaggaaagatgatttgttttgcagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatatcaccccatatcaaaagagacgacagattttgttcaaatattatattcttgaaggaagccttaatattctggaaatgtgctgaggaagtcattgagcataattcaatcatgaaagggaccactgaatcaagaatgaactttctgaagagatgtttgctgccaaagacttcagaacaacttgttggtcaagtaatgccagatcaatcctagtctctcaagtttggaaaagtttctacaaggccattccatcaaatatcccaatatacacagaaattcttcttcctaacatcttcatatatgagtctgcatccagattggaggcctttgtggtgggtggtggactgcaggtggaaccaagcacaggtgtgccctgggcagaggtgggcaagaggaaggaacccaaacagtgctgattccacatggcccttggtcaagaagctgaaggcctagaaaggaggtaacagtgcccagaatccccacctggcacactctttaaatgctttctggaggtgttttagtcagttttgatccatcggtggggacacactgactaccatatatttccaggtttgtttgttttcttaactaacctgtaattatccactgtaactagcagagggttgaaccctgggtaataggcacagaaacatcttgaatcttgacaagcctgcactgtcttatagtaatctgtattactgtcccattttatagttgcagttactaaggttcagagaagttgataggaaatggcatagtgaggagttgaataccaggctcaggtaaaagtgaccccagaaatgtgcagaggagtgtcagggaaagctgaggcctgcttaggggtgtggctgagaaggcaacacccatggaggtgctgcaatagttggcaaaatgtttaaaatgtttggtcactcaaatgattcataatctcaaacctgtttttgttttttttgtttttttttttttgtggggtgggtggtggagacagtcttgttctgtctcccaggctagagtgtagtgatgtgatcttagctcactacaacctccctgtcctgggctcaagccatcctcctccctcaccctcccaagtagctgggactacaggtgcataacaccattcccagctcttttttgtatttttttttgtaaagctggggttttgccatgctgtctaggttcatctcgaactcctgggctcaagcgatacaccggcctcagccttccaaagtactgggattacaggcatgaaccaccattcctggccaggaaactgtatttgtaatgaacaccttaggtcagaatcagaggcgcctggagggctccttaagacacagaggagtgggctccattcttagagtctctaactgaataggtctgggtgaggtctgaaaagctgcgtttctaacaagttctcaggtgatgctcatgctgctggtctccaggacacactcggagaactgctgctccaggagagtcttatgaataccaaaatttgaaaatcagccgctgaaggaagatgtgacagaaaagtcctgtccccagaaaactgtccttttggggcggcttggagcaccctgtctgatctctttcaaaccacaacccagacagttggcattgtggaaactgcctctgcttaggaggcaggaacagaagcagggagctccccctccacaaatgtggccagctcttcagtgcttggtgtggtgcccacttcagactcctccctccactcagcagccatagatcacctgggctctgtggagctccttgccacacttccctgagctggtaccattatctggcccttggtatatgt

SEQ ID NO: 11830 - DNA, 65990 bp, Human
  misc_feature (1)...(65990): n = A,T,C or G
ggcctcccaaagtgctggaattacaggtgtgaggcaccacgtccggcctggccaggattaaattttttcatgtgaaccacaacactaaaactttgtatattgctgcgcttatcttacaaatcaggaaataggggttcagagaagttaaatagcttgcttaagtcacacagccagcaagtggtaaagctgggatctgcatgactacagagcacacaggctccccaccagtagattagagagggggaggtctgctttggtgcagagacaggtgggatctgtgatgcccgttcttggtttcaacattcttttaaactctcctatctgagcctaggactttctgcagccttcctgttttaggctggcagctcacagtccctctctggttattttcaggtctgtgtgtgccacagagaggaagggggcaaccacagtgggaaccgctttccagccctgctgcaaccccttttgaaatagcaggcgagagggctggtggcctccactgtgctcttctgttcctgtctgtgggcatggctaaagcaaacaagctcacccacaccagctcccatcgtgcggtggatcagtgcatgtgcttggttctgtctggcactgctgatgggtggttcctacagaaagatccagatgcacggggtctgaggactgtttcagaagctctgtccgtccatgcttggccctgtccacttgggagttccattaggccatgcctgttccagctgtcccaggatctttgatctgggttaggattggcctgaaaccaaaggtagaaaaacacattctaatgagcagttgctggtctagaagcttctcagcctaaactttatttcagcatttttctttccctccagattcagctatgaggccatcctatcagctttaggctctgtgggggtccttgagagagttcccctccaagggacggacagatggtccccttcaaggtccttgtggttgctcaaaagccaggtgcttgtttctttctttttttctctccttcctttccttccttcccctctatccctccttccctccctccctccctcctcccttccttttctttctttcttttcttttttttttttctttccagacagggtctcactgtcatccaggctggagtagcagcccccaatcacggctcactgtaccctggatctcccggactcaagcaattttcccacctcagcttccctagtagctgggactataggtgtgtaccaccacacccagctaatttttaaatttttttatagaaatgggggtctcactttgttacacaggctggtctagaattcctggactgaagcaatccacccacccggctctcccaaagtgttggggttacaggcgtgagccactgcccctggtgttagtgtctgtctgtcaagtcaggagggcagccatgaacgttctgatgtctactgagcacgtgtggcccagaccgtgtgtcaggtgtttaggtgccatccacagaaccttcctaataaccctgggcagcataggctttcttatctctgacagatgaggaaatggagactcagattctgaaccgaagtcacagacacagtagatggtaggtctaaatggggacccaggtctatctgactgcaaagtccaaaccgtttccttgcctctgctgcagcctgcgaggagcagctgggcagaaagactgtgcctttacggtggtgagtcttccgatgcccaagcctcaccccagaccgatgaaatcagaatctctggagacccgacccagacattggtgggttttagggctcctggctgattccagtgggcaaccgggctaccaagcactgttttaccctaagggtaagaggaacatcgcctcctcgagggctctccaggtgtgcctttcacagcgtaatcccgttcacgaaaccaaaaatcaaaactaggccactgcccactggtggctgatacgcccttttctcatcaacagaaccgggaggaagggctctggtggggctggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccggaccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcagggtaagggcttcgggcgcacctggagggctggggcagctagcggctgggggaaaccgccttggtcaccgcagtctgtgggaggctggagggaggaaaggaggtgcgacggatccccttttctgtggctgccttgaggccccgcgggtacctagctgtgtggtcgcgggtagtggctcttgcgccccctgctgcgcttgctcccttggtccggagcgctccccggaatgcccggtgaagctgtgcgggaaccctgcggtctgtgtacaggactgtgtccttgcaaacctgactctcgagcttccttcccagtgcccccaggagcctttacacaaccgcgtcccaggttactctaaggggagactgcccgagagggcgcgccccagcggggtgatgtacccgcctggggagtcctttgtaccagcgcccctcttctccctctgcattgggggtccacctcgcctggtcctccccccacccccgcgggtgcatgtgtggatgacagtgccctgactatgaagggactgacatcacgggcgctgagtcacggatcttcccgctgcacggagtcactttggcagccaccaactctgggaagccaagtgccccagtcctgggaattgagtcgggaggctggcaagggagtgagacctcctggggctggcacgtgctggactcccctctagaaaagagaaggacccgtgagggagagggcagaggcacttactgctcccgttgactgtaatctgcccctggcaaaccaggcttttcttgggctctggccgcatgcccagctgcgtgtctagtctctcttctggaagagttgggcaactggctctccagaggtttattttagggtcccagtgcttctttgaggacacagcagaaaactaaggggcagctgacaggcttctggaacagctgacaggctggggaggctgaaggctaagactttcaaccactagatcacactgaattccagtcctaggtgaacactgatctctccctttgaggaggtgactttctgcaactagaggctgagctggagtgtctgaggctctctttgctttttggatggttgtggtccttatgattggaagaaaaaaagaagggattccattttcaatacacatttataactcctgccagtaacagacactgttgattggggcacccattcaatgttttctaatcctccactgtatctacatataactttgtttgaaagaggagactgaggttcagggaggttgggatggcgggatggcaggttgtcaggccccggtgatggaggccaacccctcccgtggctctgtgctccagtgtggtagatgtctaagactctcaaatatagaactagatcagcaggcagagctgggggcattggggcaagctgagagtcactcttgtctggctgagtgctgggacagaaaaggctgagggagggaagtggaggcccaggcttgcccatggtggtgttagagggatgcaagacaggttccagggctcggatggcctcaggagcaagcagggctcccttggctgcctctgctgctgtcacgccagcccaaggctcctgccccagggaggttactgttactgctgtagttgccaccacctgttgctcctgagtggatgctaggcccttccagggcagccagttacagtcagttttccatttccctggtgctcaggaaggattaggagaggtggtctcatggcctgaacagcccatgaaaggcagaactgagagactggggaggaagtgaaagtcctcccagctcagaaggaaaatgcagagaagtagaaatacccagcccctctcccacacccacacagactcagcccacaaactggagagtaaaaataaagaaatcgtacaggaagcatggagcaaatgactgtgagatgtttcgctttagagaagtgaggagcagagggggagcagaggctggagttggctgagaggggaaatccgcaggtacagcctgcggggctcttagagcccagaggtttgttttcctcgggatcagctgccgcccacacaccctggagctgccaggacttctcaggtgtactcgttgtctaagggcctggactagctgggacttaggcttctgccggttccaacactctggtgctggaaggctggacttgggtgactcaagttccctcttcctactgcaatgcaagaaaatacacaaaagaagtatgtatacctttaagtatctcaaagagctatctcagcttctgaatttccttctagggcacctcttcctgcccccattacccacacacgtgcctagcctcaccctaaatcagtatttctcaaaagcttagttctgagcctagcatcagatctggtgtgtgtgctgggtgggagggctttggtaaacatgatgatttttgaaccctaacccagatttattaaataagaacacctaggagtgaggcctggggcatgtccttttaaacaaactgccccttgtgattcttaggcactgtcaggtttgaggacggctgcctaaatggtgtcattgaggaactgaatgaaggccctcccgcttcgggctctctgttgccagaaatctctccttgctttggcttgctgcttgtttattcattgcagcaaacatttcttgagtcggtgtagagcctgtgaggcctgtgtaggatcagctatgcagactccaccctaaaaggagcctgaaaatggtcatgggtaaatcctgagaagggctgagaaaccccagactctgaccgggccactgggtaccaactacccgtgaacagattgtctggcttggggtagggggtggttagagagaggaagttcctctgactgaggaccaagatcccaaggcagcaggcacactgatcctgaccctgaccctcatctccagccctcagcagccagggtaaacaaatactcccctcactgggtatttgtagattacacaaagtaacctaggtgctgactgctgaaaatatacactcccttcccccgtctcctgaatcctggtcccaccaggcctggaagccacagacccagcaagcaaaagagtttccagtcaatgaatctagtctggattgaagctgtgctctgtaatacggtagccactagccacgtgtacctatttaaatttaaattatgccagcgcagtgactcacgcctgtaatcccagtactttgggaggctgaggcaggaggatctcttgagctcaggagttggagaccagcctgggcaacagggtgagatgccgtctctacaaaaagatttaaaaaattagctgggcacagtgacatgagcctgtagtccctgctactgagaaggctgaggtgggagaatcacttgagtccagtctgcatggagccatgtttgcactaccgaattccagtctgggcgacaggagaccctgtctccaaaaaattaatttaaatgaaatcaaataaaaacttagtttcttagttgcactagtcacattttaagtgctcaacactcacattgctagtggctactgtactgaacagtgcagatacagatctcttccatcatcgtggaaagccctactggacggtgctgggctagagtgttaaccagtttcttccagaggttttctgttctcttttcctttatccccctctgccttctgctctcctccacctgaacacagctcattttgcataggtgatggctaaggtcttcaagccaggcacatctctgccctgcactgccaagtaaaaatgataacaccttgggcaagtgatttaacttctttgacagccagtgttctagaaaatagaaataattgtattacctcgaagggtggttatgaagatgagatgagctaagtaaggtatgaaatagagtgtttacagaagtccctaacacacagcaagtgcttaaataagtgtaggtgatcattcattcactccaaaaatatatttttggagtgaacacctcctactctgttccaggcactattctaagagctggagatacaccatgaataaaagagacaaaaaccccaggcttagttgagtttcattctagtgtgggagactattaacaggatgtaaattaagtatgtggtatgctagcgactagtgctaaggagaaaaactaaagccgagagggagacagaccccatgtgtgtttgtggcagggtggggtggcatggtgccttggatgggaggccagggaatgccttgctgagaacataatatttgagtgaagacctgaagaaaatatacaaatctctagagattccctatatgtccatcttgggcaggaaaattcttgcctcctctttaacaatgtgtactacctgagggtgtgttatgttctggagcagagggctctgtggggacacatggatgctccctgccctggagaagtatctctggggtaacaagtcctcagccctttagctccttgaagtctagcagagggaagtgctaaatgccaggtcataactgcaagtctgcaggtgggatccttgagggctggagtggcaaggggaaggtgacaaagaaaaggccttttttttttttttaaatacaggatcttactcccgtagcccaggttggagtgcagtggcacaatcactgctcactgcagcctcgacttcctggtctcaggtgatcctcccacctcagcttccggaatagctgggactacaggcgtgcaccaccacatctggctaattttttgtatttcttgtagagacaggatttcgccatgttgcaggctgctctggaacacctaggctcaagcagttcacccgccttggcctcccaaagtgctgggattacaggcgtgagcctttgtgtccagctgggaggtttttttgtgtagttaatctgtgttctttaccctctcctcttgcctgggatctgaagaggtcaaaagtccctggcaaaggcagaggcttttctgccactgggttcaggcttgacgttagctggacctcagcagcctcccccactcctgctcatcccttgccagctctgtcgggtgctttctactcttaggagtatgtccctgaggccctgcatccagcctattctccccagcacctgttctctgaatcagttcccactccacttcccaaccgctttcccgaaaagcatcctttggtcttccctctctatatgatggttacaataactgttaccatttatggtgtgtcaactgtgtgcaagtagctgtgctaggcccttggcatctgtgatctcatgtaatcttcaaaacagcctcaggtgagagaagtgctggccccattgcatagatggtgggctgtaggacaagatgagaggccagttttgcacatatggaaacaaatgtcttttgttttcgtttttgttttgagacagagtctctgtctcccaggctggagtgcagtggtgcaatcttggctcactgcaacctctgcctcccgggttcaagcgattctcctgcctctgcctccagagtagctggcattacgggtgcacaccaccacacctggctaatttttgtatttttagtagagatggggtttcaccaggttgccagtctggtctcgaactcctgacctcaagtgatctgcctgcctcggcctcccaaagtgctataggattgcaggcatgagccaccgcgcctggccgcaacgagacaatcaagagaagatgctgataaggagttggatatgggagtcaggaatttgggaatgaggactgagcttgagatgtaaatgtgggagtcgtgtgctggcagatattatttcaagccctgagagtggctgaggtcccccacatctattcatatgcctttggtcagtggaatgttttgcaatccacatcactataaatgaatttcctctgtctctgagagaggccgctgaggtagcagagagaaaacagctttgagggcaggcagtccaggcctgtctccccattaactgcttcaccagctaggggacctttgggcaagtcactacaagctttaaagtataaaatactttttgaggccggatgtggtgtatcatgtctgtcatcccagtgctttaggaggccaaggcaggaggatcacttgagcccaggagttcgaggctgcagtgaaccgtgacagcaacactgcactccaacctgggtgacaaagcaagaccctgtctcaacaacaacaacaacaaaagtataaaatactgtaacagacaaaaatgcatgcttgataaatgttattgatcctaagagccttttttttttttttttttgagatggagtcttgctctgtcgcccaggctggagtgcagtggcgcgatctcagctcactgcaacatccgcctcccaggttcacgcagttctcctgcctcagcctcccgagtagctgggactacaggcatccgccacgacgcctggctaattttttgtatttttagtagagacggggtttcactgtgtcagccaggagagtcttgatctcctgaccttgtgatctgcccacctcgtcctctcaaagtgctgggattacaggtgtgagccaccgtgcccggtgagccttttttttttgtttttgttttgagacagagtctcactgtgttgcccaggctggagtgcagtggcacaatctcagctcactgcaacctctgcctcccaggttcaagcaattctcctgcctcagcctcctggcctcagctgggattactggtgcctgccaccacacccggctaatttttttgtatttttagtagagacggggtttcaccatgttggccaggctggtctcgaactcctgacctcaggtgatccacccaccttggcctcccaaagtgctgggattacagacgtgagctaccgcgcccggcctttaaaagcctattttgatgggaggagggggatgctataatgtgaggactttctcccagaaaaggagagagaggcactaatgcagtggggataataattaaaatcgcttaacattttttttgaaagattaggtatgttctgaaaatagtgctgaggtttttgcattaattatctaatgtaatcctgacaacatttgaagtacctatggttattatttctattttatggatgagaaaagtgaggcctagagaggttgagaaacaagcccaaagtcacacagctagtgagtgactgagatagggttggaacttgggtatatctgaatcctgggcttgacctgtagacccctgctcctgtggactaggaaatttaaacaaagaacttcctctttttttttttttttgtatttcattatatggatgtactgagtttatttatctggttccccccctttttttttttgagacagagtcttgctctgtcgctcagacttgagtgcagtggcacgatgttggctcactgcaacctctgcctcccgggttcaagcaattctcctgcctcagcctcccgagtagctgggattacaggcatgcaccaccaagccaggctaatttttgtatttttagtagagatggggtttcaccatgttggccaggctggtctcaaactcctgacctcgtgatccacccaccttggcctcccaaagtgctgggattacaggcatgggccactgtgtccggccacccggttaccttttgatggatgtttagttgttcccttcttgctcttacggcccctgctgtggggaataactttgcatatgcctcttgttgtgtgagtgcaagtacacctgcaggatatattccccgaaggggaattgatgggcaaaggccatgagatttgtcatcgtgagacagaatagaagttgcaccaatttatacttccagcagcattgtgagaatgcttgtgtccctatgcccttgccaaaagtgtactattaacctggtatctacacagacaatggcgtctgtgtggaattaatttgcatttatcttatctgaataagattgtatgggttttttaatgtataactgacatttgcataatctactatgacctgcctgttcatattcaatgctaattttattttgattgggtcattaatcttattgtttacaggagctcttgacatattaacatgtcatacatgacttttttttttttttttttggtggtgggggtggtttttgccaagaaatttctttttttccatctctctctctctctctctttctttctcagggtctcacggtgtcacccaggctggagtgcagtgacatgctcatggctcactgcagcctcaatttcctgggactcaagcgatcctcctgtctcagacttctgagtatgaggctcagactcaaaagattggggcttttacaggtgcacaccaccacacttgactagcctttgtattttttgtagagacgggattttgccatgttgctcagactggtctcaaactctgggttcaagcgatcctccctccttggcctcccaaagtgctgggattacaggtgtgagccactgcgcctggctgcaaatttttttttccaactagttgaatttaccagtctcttttatagcttctaggttttgtgtcatacttaataacatccttcccattccaatattttatttttatttattttttgagagaatgtcaatccacctttattggaggaaaccttgcactgtaactgttttaaataatgtgtgccctgccccaccctgtgcctggtgggctcagaagatcatctccagctgccgggcatactcggtgacctgtttggccagttctgtggagggaatggtagtgtcttctggctcctgctgctggccggcaaaactatattagttgttggggcccgggacccaccctcacttcttggtgtagtcggtcatctttttgggtgtgttgaagaagaggatctggtggcctcggtaaaagggattttctcataggctttcttgatgcacccggccatctcatccctgatagtgtcaagcaggatgtcgatgaagacggtgtagctcttggcgaggatgttacccttggccaggaacactttgttgtagctgccctccattaggtattgctccagggacacagggtttttggtgtagacattggtctggatgtccttggcaggcagccactccagctccatgtggaactcagccacccgcttctgggacagcaggaagaggagattgaggcccaagagctggtgcatgtaggctgactggggaagctgttccttgtaatcaaagtagcagcatttgagctgggtcatgtggcgctggaaggaggggatgtcctcgcataggatgctccactggccccgatcttcagtatgtcacgggccagaatgagctgctgtttggtcagcttggtccctgtggttggcaagaagttgagctccagaagaactagcttgaggcagcccagctcttccctgcacttgctaagattggggcttttacggttccactcgcccttgagttgcttgtacttgccgtcctcagcctgcaggacagggccctaggtcgccaggggcccggagctcaaggcgccggctgcactgttcacctccacccccattccaatattttaaaagattctccttttctggtattgttaaaagttttaaaagtttaaatatttgatccattttgaatttattaatattatggatgaggtatgaagtctgactccagctttttctttccagttgtcacctgacatctctttacagtttattgaattcatctttcccccaccaattttcaaagttacattttaaatctaccaaattcctgtatacttgggtttatacgcctcttggcatagcgagtagttaaaagcacaaattctgaggcccaattgtctggacttgaatgcaggtcacccctaattagctatataacctcagtctcttcttctgtcaaatagactattgagaagatcaagttagttaatctatgtagcacacttagaaactgcctgtatgtgtagcaagcacttagactaagttatttttttaatgtggtaaaaacacataatataaaatgtatcagccgggtgcagtggctcacacctgtaatcccagcactttgggaggccgaggcaggtggatcatttgaggtcaggagtttgaaaccagcatgaccaacatggtgaaaccccatctctactaaaaatacaaaaagtagccagctgtggtgacaggcacctgtaatcccagctactccggaggctgaggcaagaggggaggcagaggttgcagtgagccacgattgtgccactgcactccagcctgggcgacaagagtaagactcatcctcaaaaaaaaataaaataaaataaccattttaaagtatacagatcagtagtgcagactaaactattttttatttttattagttctgaactttctagtctcttccataatttggtctccctattcatgtgccagtatcgcactgttttaattatgtagttttattttttccttcctatttttttagaggaagggtctcactctgttgccaaggctggagtgcagtgtctcgatcatagctcactgcaaccttgaactcctggactcacgcaatcctcttgccttggctttctgagtagccaggaccacaggtgcatgacaccatgactggctaatttaaaaaaaaatttttttttttttttttgtagagatggagttttgctatgttgcctaggctggtcttgagctcctggtctcaagagatcctcccgcctcagcctcccaaagtgttggcattacaggcatgagccactgcacctggccaagtaaactttagagattaattagggaacactgatgtatttttaatgccgagtcttcctatctcttggtaggcctgatggggcttatgatgagggaggaggagctggggcaggagagcccgacattcaggtctcactgaggggagatgtgcccaggacacttccactggaactgcttccttgatggtgatgtggagtgagctggaccagtgtgtgcgtgcatgtgtctacccaagctcatggcacatgggggagcggagggggtggggatggctcagcagtgattggaatgcaagagtggggactttggggcctgtatgaaaaagtgttatggcagagtgacacacctacgaaagagtgtggtcagcataggcctcacactgggtgggtttttacaaactgaacacatgcatggaaccaccattcagaataagaactgaacagaagcatcctcaggggagccctgaaatccccctatgcacacccctcaaacctccccttatccctcccagctgctccatccacacctccacgtgacttcttaaatcttcagctttgctgcctcatagctaagggggtcagggaggggaagctggggggtctgtagatatggaatgggggtgcgtacatcaggtccctccctctccctgccctcctgccaccttccagaagcacataaaaaaaatctgactgagggccagcctctttgttatactctgagactgtgctcagagatagaagacaagacccctaggccatgcttctgggaaggcagagggctgcgtgttaagcctggaccgagagtcccagagcccagctccggtcctgacaccatgcactgctgtgtgacttctgggccctggttctcctcatccaccaaaatgagcaggttggcctgagtcgtccttaagagtcctgtatagccttaaaacagcgctccttatctcagcaccctacacactggctgtagcttctcctcactgtccctttcaggaccaaaatactgggtgtatccatctgcaggtaccaatggctttactttctaaggccctgctgcgtcctgcttttaatctctttatttctctatctgctccctggggttaggtttgggccagggagtggattgtttgccctccttagatatcctttctttttttgagacagggttgcccagggtggagtgcagtggtgcgatctcggctcactgcaaactccatctccggggttcaagtgattctcctacctcagcctcccgagtagctgggattacaggcatgcaccactatgcccagctaatttttttttttttttttttgagatggagtttcactcttgttgcccaggctggagtgcagtggcatgatctcagctcactgcaaccttccggtttcaagcgattctcctgcctcagcctcccaagtagctgggattacaggcacccgccaccatacccggctaatttttgtatttttagtagagacaggatttcaccatgttggccaagctgatctcaaactcctgaccttgtgatccgaccttctctgtctcccaaagtgctgggattacaggcgtgagccacttcacccggcctaatttttgtattttttggtatggatggggtttcaccattttggctaggctggtcttgaactcctgatctcaggtgatccgccagcctcagcctcccaaagtgctgagattacaggcgtgagctgccgcacatggccttagatatcttttcctctaattagtttataatctctgagagttgacccaggttgtaccttcttggactggagccaggtggttatctctgatgctgccagaggaggattagatgttttatctcctgagttggtcacacgcgcacgtgggtctctgagtcagcattgagcattacctgtttatgggtccaaaggagcctccctcccagaccctctctccagcagtgtacagtccatcgtgtggatgggaggaaggcaaggccaaggtaaatactgactcagacaaatacaagcaggtacaagaagtacaaatacatatgtgggggaggagggagcaggggcctgccagccaaagctagtcatctgagaagagggggttgcggacaggtggggctgggagctgagtcagagaaggttgctgggcctcccattagagcctgggagccttgacttgccgtagcctgcggccttgcctcttcctggacagtggccgagggtgccctctgaaatgttaaggagaaatgaatgggcccagatggtggggtgacttggggaggacgcgagatttggagtccaaggggaggcagttttaggctctaactcatcctatacacgctgcggctgtgggggaagggagagaaaggccaagggcacgactcctggctcctgagagtccccagtgccccattaggttggcagctgcagtgatggcgctgacccccccttgtgcacacccctcaagcctcagcattcccttccctgggcctctgaagggtggaaagatgtgagaagagcagggaagaggagaggaaattgggagagggggagagagagggtggtggggagcccagagaagggagctgggggtggagcatggagaggtacctgggccaagtagagagaggctttggccaggctcatctgggtccagcgtggattccctcatgcatgagctgtgtgaatttgggcaagttccctaacttctctgatctcttgttgcctcaacaatgaaatggggacaagacttcctccctggcagactttttgtgagtagtgtgctcttagggaaagcccagggcgcagggtaagtgtcccagttgctaatgattgttatggttattatcacatcaaagccaggagccagtctcagtccaaagatggagaatgcaagaacaggtgaccaagagcactgggacttgtcctagccctcgtgggaccaaattctatacttgtttccatgtggacacaaggtgtccacaggcttctcctggaggcttctcagcacccacctacttttagatcaagaccattattgctgacaggggacctttgtttcctctgtagccccttctgaaatcctatgcctttgcaacccaagaagctgggttaggctgggggcctcctgtgctgccagctggcctgggcagcggggacctgcgtctctgctcagaaactggggtggtgagatgggattagcaggcacgagccaagcctgtgtcctcggtggcaggccaggcagctggttcaccgcttacataaacggggccaggaagctgaacttgtttttgctggcaagagctgcggcaagctgcaagagagttgagaaatatgtgtctccgtgtgcgtgtttttctctggttattgacatttgcaagtttacttgaagagggggaaaaagtagaaaaacaacaaagctgtttggattcctggcacccaaacttaggtcccaactggggaggaaccccactttcccagagctgtgctgcagggtccccagaccaaagggtgtctgggccatggtgggggtcccagtgtccctgggagggggaatcctaggccaccggggcagggagatatgggcttgcttgttgggagttactaggacctaaactctctttcccttgaggaatgggaggcaagggaggttgtgggaattttccctcccctagagctctccagggagaaagaagcatttttctgagggcactgggatgatctggtcatcatccttctcccaaagccatcaactattaaataataaatccatagattcattatgtgttttcaagctgagtattgtttgcttcctgccctctgagagctaatgattgggcgccatgggatgctagaccgcaggagtgggggcctgtgggggatctacaggtcacagtctgaatcctcatttcacagagaaggccagtgggctctgccaggggcggtgacgtgcccatggctgcctgtgagtcatcacaagaccaggaatagaactcaggtcacctgacagcacagagctgtttcctctacaccaaggggcctcctgcttgtggagatgtactttattttattttatttatttatttatttatttatttattttcaagaaggagtctcgcccaggctggagtgcagtggtgcaatctcagctcactgcagccttcgactcactgcagcctctgcctcccggattcaagcgattctcatgcctcagcctcctgagtagctgggattacaggcacacaccaccaagcctggctaatttttgtatttttaatagagacagggtttcaccatgttggccaggctggtctcgaactcctgacctcaagtgatccacccgtctcagcctcccaaagtgctgagattacaggcgtgagccactgcaccctactgagatgtactttatattaaagaacaaatcaaggcagactgtacgtttgtgtcagcccaaccccacacaattaatagtcagtgattaaactgaccagaccagaccagacaccaacactgactgttgaggaggagcttgggggtttgttttcgggaggcaatactgcctccttttgtgatcttagtcccaggtgaggtgcttccttgtcctctctgcagaatcccattctttcttagcctgggctgaagctgctccctccctgtatgtgaccctggccttggcgcagtccttgggtgctcttcctccctcctgcctctgcgctgcttcatgatgcacaggagccaaggaggggcaggggacagtcggttttttctcagggagattggaagagaacagaaacaagaagcaatggaatgctcctgtcctggaggttggtggggcagtggggagaggtggggaagccattgagcctgcacatacttttgacaggcttggctcatgcctgccaaccccatcccaccgcctgggtttctgagcagggacatgggtccccactgcccaggccagctggcagcacaggatggcctccaacctaacccaggctcttgggttgcaaaggcatagcatttcagaaggggccacagaggaaccaaaagtccccctgcctgtggagtcaggcctgatctctttgagggtgctcacaccctccatgttcccctgtaggtcttccttccctccttactgcatttcagatactccagtcaccagccctccccagaactctcactgttttttgtttttttgagacacagtcttgctctgggtcccaggctggagtgcagtggcacaatcacagctcacttcagacttgacctcctgggctcaagtgatccttctgccacagcctcccagatagctgggaccgcagacatgtgtcaccatgcccagctaattttagagttttttggtagagatggagttttgccgtgttgcccaggctggtctcagccacctgggcacaaacgatcctcccatctcagcctcccaatgtgctgggatgacaggcgtaagccacgatgcctggtgactctcaattctttttttttaaattattattattattattttggagatagagtttcacttttgtggcccaggctggagtgcaatggtgcaatctcagttcactgcaatctctgcctcctgggttcaagtgattctcctgcctcagcctcctgagtagctgggattacaggtgtgtgccaccacgcccggctaattttgtatttttagtatggggtttctccatgttggtcaggctgctctcaaactcccgacctcaggtgatctgcccgcctcggcctcccacagtgctgggattacaggcgtgagccacggcgcctggtgactcagttcttaatgccttgcatatactgttctctctttatggaatgtaactccctgtggctccacttatcaaacccccactcatttatcaaggccccaataaaatctctcttccccctttagaataattgatccctcttcttagttccctcagtatgttggagacatttatatcaggttggcctgtattacagatagttttaagttctagggctttgtggggtttaaagaagattacgatatggaaatgataggaaggagtgccagtgcattgtagatgctcagtagcttcaatatggagttttttttttcctggattaggaacttctgaacttgcacatcatgggtgcacaaaaattattgaattcttgaagaagggacaggcataggcttgcaatcctggctctgaatgctgagcaattgctcacggacaaatgctccgttgattgtgtgctctttgctaaatttcagtgtgtgcaccagccacgccttcgcccccgcgtgccccgtctcctagggcctactatgcaaggcctgtgtcaggccggggtgggagcatgagaatgactgggcatatctcccaggaccaggaaggactgctcctcaggagccccctcctcacctggttcctcatcgtgtctcttccttttggcccttctctttggtagggcctacttagggagggccccagcagattcccaggggaacagaaaaacagacagatgggaggaatcaaggctgagcccagggtatggtgtcttgtgtccaccagggaatcaggcctacaggggagggctgggctatgggtgcagaattcagtgacagtgacagtgagagaactcagcagtgcaagggcaaagtggcactgtttggcctgaaggtgctcggaagctgcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagcaccagctgggcgtggtggctcacgcctgtaatcccagcactttgggaggccgaggcgggtggatcacctgaggtcaggagttcaagaccagcctgactaatatggtgaaaccccatctctactaaaaatacaaaaaaaggaaaaaattagccgggcatggtggtgtgtgcctgtagtccccaactactcgggaggctgagacaggagaattgcttgaacccaggaggttgaggatgcagtgagccgagatcgcgccattgcactccagcctgggtgatagagcgagattctgtctcaaaaaaaaaaaaaagaaagaaaagagaaaagcatatcacagcagaagactatattcaaaccatttatatgaagctcaaaaatgaagcaaagttaagaaaaatgtagggatgtatgggtagtgaaagttaggttggtgggctttcctgggtattttatgcttcataaattaacttttatgtatgtagcttttacatacattatatatatgaatttgcatgtattcagtattatgtaatacattaaaaacaatgttcgcaatgctaaaaatatattgttgaagattctgtgtgaaagctatactgtagttgtggctttttataaccctttcaagccctctgggcagtagcagtccaccccttattgccctcagtggacttcaccttctagggactcagaatttttttttttttttttgagacggagcttcgctctttttgcccaggctggagtgcagtggcgtgatctcggctcactgcaagctccgcctccctggttcaagcaattctcctgcctcagcctcccaagtagctgggattacaggagcctgccaccacgcccagcaaattttttgtatttttagtagagacagggtttcaccatgttggccaggatggtctcgatctcttgacttgtgatccgtctcgcctcggcctcccaaagtgctgggattacaggtgtgaggcccagctgggactcagattttgctgaggaccaggacagtactgtgtgctgtgtcctggccttgcagcagtgaatgtgtctcccgtttctcaagggcaggtctctgggatgcctgactgtgtcttccttgccagtgcctggctgctgcagcctcctcaaatgtttatcaaacacaggacttgcccaccgtgggagaaagtaaggccataggtgtctcaggaacctgcccaaactcgcctggctgcacggtgacaattcaaccagctttcttacccaaggtctgttggtgaccagagaaaaccttagatgaccggctgccatgatggccttatatctgtcccttttctgccagccttgaggtagagggtgccagggaggaggactctggctctaggtgttaaagtgagagggaagtgtgaagggtatctgtatagctagacagggctcaatgccaggcagagctgtctccgcccctttgatgtctatgtctctgtccctggactgtggccagtagccagtgtggactccaacctcaccagctttaggggtgttatctgcctgggagtcactgatccttactccctcctctgacagccaccttggatggggtgaaaggaaggacagcctgccaagtatgagataaaaacgcctcataaacaagaagggatttgcaggccaggcagagagccttgtgctgcttctgagtcccaggagcatgggcgaggaggtgaggtcaggcactcagcagctgctggtcctctctgaaatctttggccagatttattgctactgcttgctaataaatggttatgcatttggttcaaaggaccaagtgtgcttacatgaaaactggctgtgttccctggcctctgtttccttagctggttggactaatttgattggttaataaatgagtccaaggtggttgggctaatttttatcttagattctatgactctataactgctactcaaaaaaagtgtacttgttcctttaatctttaatcttatttttcttgagtagtagaatacacccaatttttttcaaggggtagagaatgcattttttttttaaccttccagtttggtccctagagtaaacacagcattgctgtagtagatgtagggtactggagggagcatggaacagggaaccagaagccctggttcctaccccagctgggcatctgggccagtctcttgattcctctgtgcctcagttaccaactatataacgggcattctgccatgaataccctgcgatttggaaacctcctgtgtacgtgtgcacttgggtgcctggcattcattcctaatggcatccattcgttcacacattcatccagtactcagcagactcctgccatgggccaggcaacgtcccgggcacttggaatataatggagaacaaagcagggtgcctacttctgtggtgcttggagtcttgaggggaagagagacacggaattcgtaattacatggcagcgtgtgggtgacgtattgcagaatgagggcctagtggagctgggggaccggaaacgatgtttaggccgagacctggaataggaggagttgtcgtggggatgatgtaggaagaacgagtgtgaggaggagagcgaggggagttgaggggagggctccacaccttctaaggagtggggagagatgaggcctccaaggacagaagggccctgcaggccacgctgaggagcttggacttcatcttgtggatggtggcaggcccttgaagggttttctaatccagggagtggggtggctggatcatggcttcagaaggctctcccaggcagctggatggtgaagaccaggttggggaggtcaccaggagaatgctgccctaatccaggcagaggtgacggtagcctgggccacttcatcattatcactgaggcctctcgtggcttcctcagaccagaacgaagcccccttcttcagtggctgtgggctcaccaagtgtcttctccctcctccagaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatggtgagttgtgcctcagaggtcccggagatagttcccgtaagaaatgaggctttgtgcattccagacagtccctgtctgagccttcaaactcccaccatttccttggcgcaagaattttggggaaggcccaccaatgtctgccatccagatgctggcaaagactgctgctgggtgggagtgggagcgtctgactggtggggaacattggctttgggagttaggacttttggtgaactggtgaatagcctggggcccggagtcaggcagcctgggtttgaatcctgctccctcacatacagcttaacttctccacccttcagtttcatctttggcaaaataaggttaattttattaccttaccttagagttgttgcaaagggggtgtatgtgaatttgcgtatgtgtgtgtgtgtatatcacacacatatgctgctaaaaagtctgcatagcccatcctaagctctcaaattagctattcttatttttttagaattagcaagttcttagctccctcatacctagataaagacttcctggaaccagtgccctgtgtgtcgagccctatgccaaggcactttcttccttgtatctcttgtaatccttcagcagccttgtcagggaaagcaggcttatcatcatttccatcatcattacattatcatcagtttattttatacatgaggaaactgaagagcagctaggacttgcccaaggccgcacagccaggtctgtgtgactccaaagccctttttttcgatcatcctctctccccttcagacaagttggtcctgaggttcttcccttcccctgtcccgggatccgtgtctcagactgaaaggaggactttggtgtcctttaatttcccagctgcgattccattcatgtgtggctgagtgtggccagggtcctgactagctccagggctggggccgaggggcccagccacgtgctcccctcaagggaggctgccctgtctgcgaggtcagtgcgccccaggatccccgcccgcctgctgacacctgcaatgctttcctttcagttccccccgaggagccccagctctcctgcttccggaagagccccctcagcaatgttgtttgtgagtggggtcctcggagcaccccatccctgacgacaaaggctgtgctcttggtgaggaagttgtaagtatcttgggctgagctatgtgcatgttggctccctccttcccgaggccccccagagaggggctggttcaggtgatttcaaaacattatcattaggaattaattccttcaggctgaggaagaggagatgagagggaactgagatttacatttgactgccccccctgagctaggcactgtgcttgtgcttggaaccttgtcctattcacttgaccttggttatcacaacagctatgggaagtgggctttatttttctcacttaacagatggagagactgaggcccagagactgattaacaggtttggttcacttagctagtaagtggctctgctgggaattcaatcccagtctgtctgatttcattcaaagtccgaagattatgggcgttgctctgaaaaacatgcaaatatccctgggagggggtgtagcacagccagaccattatcagtgtctgggcccttgtgggcgtatcaggctatttccatgataaagacacgagagagaaagcggtgatgggcgggggagagggagcttggggccgtggggggagaagtcacgcctgcctgggggctctgcatcatcaccggaagacggcttaacgtgggaagacctgggatgggttcaggcatggatgtagaggaggtggaagatgctgaaaacaaatctgcctctgcagttttgctggtctccatcccagagccacagtctcccttagtccagaggtttacaattgagtttgagctgtcagtcatcagaatatagggcaaggaggtcgcattccaagacccctagtggatgcctgaaatcgcaaatggtgctgaaccctatatatagtatgtttttctatagatatgtacttatgatagtttaatttataaattaggtgcagtaagaggttagcaataactaaaaatagcatagaacagtgataacaatatactgtaataacagttatgtgaatgtggtctctctgtttctcaaaatgtcttattactgtactcacccttcttgtgatgatatgaggttgtgaaatgcctgcatgatgggatgaagtgaggtgaatgatgtaggcattgtgactcagtgttaggctactagggctttctgaccatgtgttagaaggaggatcagctgttttgggtgactctgggtcaccgagccatgatgatggcggtggatgtcaggacgagtgatgggtagcatgcacagcgcaggaatgctgaacaaagtgatgattcatgtcctgggcgggacggtgtgaaatctcgtcacacttctcagaacagtgggcactttaaaatttctgaagtgattatttatggaatttcccatttaatatttttggaccgcagttgaccacaggtagccgaaatcttggaaagcaaaacctcagataaggcaggactactgtatcagaaagccagagcagtgacttcaatagggtggttcagctcccacttgggtctgtttccatagagttactgggctgcctggcagtcatgtttttgttctgtcctctatgatgaaaagtgcggattaccatctgtgaatgatgcagctgccattagcactgtcagctcatgccccaagcctggatagcttcacagcccagcaaaggatacaccttgtttgtacctcaaaggcttgtaccatagataggattagccaggatagagactgtggctggcagcttcccaggccagcctgtggaaagctctgtcatttctgacacttcaactgaaatacttttttttttttttttttgagatggagtttcgctctgtcgcccaggctggagtgcagtggtgggatctcggctcactgcaatctccgcctcccgggctcaagcgattctcctgcctcagcctcctgagtagctgggattacaggcgcacaccaccacgcctggctaatctttgtatttttagtagagatgaggtttcaccatgttagcggggctggtctcgaacttctgacctagggtgatccgcctgtctcggcctcccaaagtgctgggattacaggcgtgagccaccgcgcccggcttgactggaatactttccatgttgacagcgggagtgggagagagtacagtgcttgtcctcccgagcagcctcgtgcctttgcttccatctgctttgaagagtcagcatgaccactgggcgcctttgaagtgaggaaagagcaggggaagtggcttcgagagcctcaggggccccagcccccactgaggccccacccagacctcaggccactgcagggcctggaagagacaggcccctggaaagggattactgggagctctgctttttctcttgtgtgtctgctttcacacccttgcccaactgcagcactgctccctccttcttccacaggcaggggtgagctcagcctctgccttggaccaggcgcagtgctggggcagtgggaggaagcgggccaacaagactgagccccggccctctgaccccacctgggcacacacgtaaagcagtcggtgaccctgccttcgtggctgggtggaagcctgggtggtgttgggggaaggaggaaaggggctttaactcagcctggaaaggttgggtttgtcccatgtgctggattcagcaggagcccagggttcgaacccaagtcagaggtggcagactcgtcaccccagctggagggtgagtggttgacgtggcctcacatgcccacatgtgtcataagagggtgaagcctcaggtttccaggccaggtgggatggtggctgactcacctcgaatgtcttcagttacccagaattcttttctggactcacctgccagaacccctctagcactttttgtgtctctggagtggcatttctgctgggtgtctagtcatctgaggacagatcttttttgttagtgccttgaaggcagggtggggcctctcttgattcatttctatatcccctacagtgccaagagcacaggcccagcgggagaccagagctggccagccgaccattgcctgagtgactagctgagccctccagcctagctcccctcacccctcgtgccaggcgctaggctacatgtttatatatatttgtaaatccagctagtttcctcatctctagattttacatttattgctcaatttttttttttttgagatggagtctctgtcgcccaggctggagtgcagtctctgtcactgcaacatctgcctcctgggttcaagtgattcttctgcttcagcctcctgagtaactgggactacaggcatgcgccaccacgccaggctaattttttattttattttttgtatttttagtagagacagggtttcaccatattggctaggctggactcgaactcctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgagccccgcgcccggccttatttctcagtcttaacagaaccagccacgtgtgattgttcatgcctgtaatcccagcactttgggaggctgaggcgggcagatcacctgaggtcagcagttcgagaccagcctgggcaacatggtgaaaccccatctctattaaaaatacaaaaatttgctgggcacgctcaggaggctgaggcaggagaatctcttgaacctgggagggaggcggaggttgcagtgagccgagactgcgccactgcactccagcctgggtgacacagtgagactctatcacaaaaacaaaacaaaacaaaaacttaacccctactaggtaagtagtattaatattcctattttcaaatgagaaaaggagacttagaggcacagggcttataagtctggagctgggattcaaaccccgggattccacttcccccttctgtcccgtcttgagtctgtgcgaaactgacaggcaagccctgcccttgttttgtgtctaacagtcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatctgtacgtaagctctaaccccctctccagcagtttccttctcttttgatttaatactccttatcgacttctcagagtggcagggaaggggtggttgaggggtttggtgagttggtgccttttgggcgttgcttgccgggaggtgtggcaatgataaagcaggcccttgtggagctgtgcatggggagtgaacggggctgggtggggccctgcttgctgggatctcagcctacatgggcttctctacactatatttggtgctgcaaaggagtcatgctcacttttcccacagtgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtaaatttatgttttacttctggtcagagaggcgcccctagatgcttaggcgtagtagaaagggtactagaggccaggcatggtggctcacgcctgtaatcccggccctttgggaggccaaggtgggcgaatcacttgaggtcaggagttcgagaccatcctggccaacatggtgaaataccgtctctactaaaattacaaaaaattagctgggtgtggtggcgcacgcctgtatcccagctattcgggggctgagacaggagaatcccttgaacctgggaggtggaggttgcggtgagcagagatcacaccactgcactccagcctgggcgacagagttagactccatgtcaaaaaaaaaaaaaaatagaaagggtactaaaaggaaaaccataggctctagttcctgcttcacaattggctaccttcgttgctttggataaatgttttaagctttctgagccttggtggtatatcatttattaaatgaaaaggataatgccaggccagtctcctcttcccgggcttgtctgtgaggagagcaatgtgggaagagatttgggctgtagacatgtcaagggttgtggcttgcaggattctatagtgcatgggtggggcagggactttctgcttcagcttccgtgggccctgagggcaaccccctctctagcagagcctctggggttgtgggagcctctagaggcctccgccagctgaagcacagggctggccaaggcaccaacccactggggtgctacctgcccagcaccatcctggatacctccccagagtcaccgtgcccccgccctcaggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacaggtactgcggtgggcactgagaaaggaagggatgtttcaactgtcattgcatcaggtatccattgctatgtgacaagttgcctcaaaactagtggcttaggccaggtgttggtggctcacacctgtaatcccagcactttgggaggctgaggcgggtggattgcctgaggtcagcctggccaacatggtgaaaccctgtctctacgaaaaatacaaaaaattagctggacatggtggcaggtgcctgtaattccagctactcaggaggctgaggcaggagaatctcttgaacccaggaggcggaggttgcagtgagccgaaatcgcgccactgcactccagcctgggtgataagaacgaaactccgtctcaaaacaaacaactagtggcttaaaaacgaccatcatttatcggcttgaaatttcaaaaatacagtcagttaggcagctcttctgctggtcttgcctgaatcaggaatgcagctgccatcagattgggatggtctgagatggcctcagtcacatgtctgacgatggtgctggctggtggccgaggccctgggttctccctgtggcttctcatcctcagctgccagcccagactcagggcaggcgggtggggatcccaccacagctggagggatgcactgcagagaagttagccgtatttaatctagggctttttatttttttcaaatgttaaaggtagtaataattgccattggggattgttgaaattagagcatgaaaaattccagaaagatatgaagaataattatcaccagtacttttactccctagagaaaaccagtgagaacatgttagtatgctgctttcctttttctaggtacatgtatgtgtgtgtgtatttatatatataaatgtaatattccccatgttgtcaattacttttggaaacttattatttagtaactgcctgattaatacatatattttaaaactccatggaaatttgttgttgttgttgttgttttgtttgtttgttttgagacggagtctcactctgtcacccaggctggagtgcagtggcatgatcttggctcactgcaagctccgctttccaggttcatgccattctcctgcctcagcctgccgagcagccgggactacaggcacctgccaccacgcccagctaattttttctattttttagtagagacggggtttcaccgtgttagccaggatggtctcaatctcctgaccttgtgatccacccgcctcagcctcccaaagtgctgggattataggcatgagtcactgtgcccggtcggaaattttttttaacttaaatttttttttttttgaagacaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgagcagtggtcccttgtcccatgccttccatttctagtcctgctttctaaggaagctgcttgactctttctgtttctagttcctctgttggtgccctccttaactctaaacaacaagcttatatggcttttttttttccctgataaaaccacttgagacattatctatcaacaccctgctatgaaaggttaggatttagcagatctagaatgcaagaatctccctgaccacaacccagagagtggtcagccagcctctgcttaaatgcttccagagacagagagcttactaccccttgcagcaatctgttttattgttcccagtgtttttgttgtagaatggcttcatggctcactttggggtcaaatgtttctagccctgtggcgtagttgaaccaaattaatcattcttaaatacttggcagttaggaaaaaaaaaagaataagatacccatttatttgagtaagtatggataaaaaggaaaaggtagaattgacatcagtcccatcccgacccctgccactttctcccagccctggccccagggagagaaggcttttatctatgggctgcacattcttcccccagattggatggtgtggggtgatggctcttcctcctggctggctttgtactgtggggtccttgtcccttgtctttcctgtcctggggagagccagaggagtatgctggggcttagggtgtaatcctagttggatgcaataatatgaagtgccggcttccatctttgttggcactttccttgttcatcaaggacaggaggcagctttctattgggccctctcctcaaaagcttttttcctgctcagacctggacaaggagtggggcctaactactctatcttacttagggagaccattttaataaatcagtgcatccttcagggtagatcgtattgacctgtccatggttttctttgatttgtgtatactttgagccaaacacactcatttatctgaatgctgagcatcagtatggctttgggggcctttttaaggggggaaaaatcagctctaacatcgtgcagaggaataggaattccaaatataggctgatccctattttaccttttattccaaccacttagttcagatagtcacaagcagcttaaagcttgtgacaagcagcttaaaagcaatcttgcttttttataaagtttcttctaaaaattttcaaattgtaaaatgtacataagatttaccatttatattattattattattttttgagacggagtctcgctctgtcgcccaggctagagtgcagtggcgtgatctcagctcaatgcaacctctgcctcccgggttcaagcaattctcctatctcagcctcccgagtagctgggactacaggcacctgccaccatgactggctaatttttatatttttagtggagatggggtttcaccatattggtcaggctggtcttgaacccctgacctcaggtgattcacccacctcagcctcccaaagtgctgggattacaggcgtgagccaccgcgccctgcccatttatattatttttaagtgcacagctctgtggcattaagtattgttgtgcaaccatcaccactttacttctccaggacttttttcatcttgtaaaactgaaactcagaatctgttaaacagtaactttcctttcacccactccttcccccagctcgtggcaaccaccagtctacttgctttttctgtgagtttgactactctagtacttcatttgcttgcttgcttgcttgcatgcctgcctacctgcctgcctgccttcctttgtctctttctgtctctctctttttctctttttttttgagacggagtctcactctgtcacccacccaggctggagtgcactgtcgtgaccttggctcactgcaacctctgcctcccgggttcaagcaattctccagccttagcctcctgagtagctgagattacaggcgcctgccaccatgcctggctaatttttgtattttttgtagagacaaggtttcaccatgttgcccaggctgcactctaggtacttcaaataagtggaatcagagagtatttgtcctttggtgactgacttatttcacttagcataatgtcctcaaggtttattcatgtggtataacatgtgtcagactttcctccctttttaaggctgaataatattccattgtgtagagataccacattgtgttgattcattcatttgtcaggggacactgggtttgcttccccattttggttgtgcataatgctgctatgaacacgggtgtaaaatatctgtttagattcctgctttcagttcttttgtgtatatactcagaattataattgtggcattatatggtaattctatttttaaattttcatggaaatgccatgccgttttccacagtggctgcaccattttacacttacaccagagtgtataagggttccagtttctccacatccttgccaacatttgttatttttcattttgctgcaatagtcctccttatggatgtgaagtgttatctcactgtggttttgatttgcatttccctaatgattaatgtctttttttttttttttttttgagacagagtctcaccctgtcacccagtctggagtgcagtggggcgatcttggctcactgtaacctccacctcctggggttcaagtgattctcgtgcctcagcctcccgagtagttgagattggcatgcaccaccacacccagctaatttttgtatttttagcagagacggggctttgccatgttggcgaggctgctcttgaactcctgacctcaagtgatctgcccatctatgcctcccaaagtactgggattacaggcgtgagccaccacacccaggctgaggatcttttcatgtgcttcttggccattcatatatctttggagaaatatctattcaaatagaaagttctttcttatgtgaacctaactctggcctcactggcccttgctctgttctcagggataaccaatgacaaatttcctagtctgctctctctgaattcttttggagttcccagacctgcatctgcttgggctcctcttcccaggctgttacatgagatggtctgtgaattcttcacctttctggcccccttcccctgaatctggtctcatttgtggatgtccctctttaagttgctgacactctccttctattggaagatggtgtggtgggggctgtctggccagcactgggtacggtctccactttccagcctcaggtggatgtgcttctttggcatagacacagcttctgtgggagctcagatagaacagtcggtttcttctcatgtaaggagcggaagactttgagccctccaccctatgcatgtgtggtttgaggcaggggaagtcttcaaaacccagttgtgaatatatccaagaaagaaacctgctgctcccctctctgctgagggaagagcaagaggaacttggatgattttgacgcaagagggggattcaggttggaaattggcgggcagttctgaaaaataaggggaaggttagagcactaggtgaggtgtgtgttatggaccacggttatttggctgttagggacgcatcagtgtactaaacactgtatcaccgtgtggggtgagcttacccaccccaaggaccttcagctctcaaggcccagacagacaggatgcacctgcctcccagactaggtgtgggagtggtggcctttgggagacacagaggtcctgggaagcacctgggagtcaggttgtatgacactggtaaagttagttcagctctcagagcctcagtcttgtcatcggtaaagtagagatgatagcaccaatcttgttcctttcagagagtttttgtgagtctgatgaaaaaatattctttagaaatgctaaagcatactgcatttgtaaggggatcagcaattacaggacagtgctggttcttgggaggagagtgggaccaggggcatcccagaatcactatcctggatgccatcgtgaactcactgcattggaatctggaggaggaagtagagtgggtggtttgagaaagctttcctggtggttttagtatgtgcttgagggggctggaggagggtgcgtgccccactgtagtatgtctaatacgtaatagatggtgttcacagcacgataaggccgtaagcagactgttctgttggggcagtttagagatagcaggaaaagcttcatggaggaggtgacaattgaattatgtcttgaaggatgtgtaggagggtcccagacagaaaatggggattgtaggcagagtacaaaggcacggagctgtgagcaaggggagggtggcagagagctgcttggtgaggccgacacgtgtgtgggtgggtggtctgagtgggacaggtggaggccggccttggtgggcccctgtaggagtggaagtggaatgccatagagtggggctctggagcctggacttcagcaggtgctgcccccttgaggctggggcctggccccccgcacagactgtagcccaggatagccttttgtatgaagttgggggtcccagggtcactctgtcttagccctgctttggccagcaaggccagcacggtcggcagctttctctcaagcgggagttctgaatttatcctctccctgatgggagttctccctgtcacatcaacattgagtctgggggaatcacaaaatcattttcttctttttttttttttcagagatggtatctcattctgttgcccaagccggagtgcagtggcataatcatagctcactccagccttgaactcctgcctcagcctctgagtagctaggactataggcatgcatcaagatgcccagctaattttttaaaaaatattttacagagatgaggtcaccctatgttgcacaggccttgagtgatcctcctgcctcagcctcccaaagctctgggatttatagccatgagccactgtgccaggctggagccccttttcaaagagggcgtggggcaaaatgcctgggaaaagcccattaggtataagggggttattccttgcttctcacaaataatccctttaactccctctcctattccccaagaatgggaatcacacctgttggaggaggtgataccaaaggtttgcatttgcacatgagggggtgccctgaagccaggactgggcggtcagtgcctccagctacacgttatcttctcaaactctttggccatccattctggaggagtttgttttgttcctctctgcagcactcccaagtgggacattctggggttaaagagccttggttacacatttccggagagattttgccctgttcacttatccatatggcatccctgaattccctctctgccctgttttctgcagctttctggaacattccactggggccccgcccacttccactgcatcacctgccactttgtgcagagcactggctctggagtcaggcagcattgggtctagttgctgcccttgcccttgactagcacgaccctggggaagtacctcactgagactcagtttgcttatttgtcaaatgggaataataatgcctgcctcaaaaaacccaaaccccagccttgctgggttgtgaggcttcagtgaggtgagaagcaattagcacagagcctggcacatgacaagggtgcaataaatgccagcatgactgcctttcacccgtatctcctgccaagcctgtctctcgagctttggattcatgtcttcaacttggcccagacttctggccagatcctccctcctgtgccaggtgctccgcatgacccaaaccaaacatatcacacccctcacagatctccctgccctgcttgtccaggggacaccccacccacccagctacccagccaggagcttgcacatcgcaccaaatgtctctgccttggtttgggttcttgccacatctcaatagcatctagcagtcagccattctgttgcactccactcttcgtgcccctctccacgaccctcctccctcatcctcgcattgcctatccgcctgacatccttgtgcacaactgggtgattcctaaacgttgggatttcacgggtctgtaaaatttcaaaaacaattctggggaccaattaaagttgctagctttttttttttttttttgaaacggagtttcgctcttgttgcctaggctggagtgcaatggcgtgatctcagctcaccgcaacctccacctcctgagttcaagcaattcccctgcatcagcctcctgagtagctgggattacaggcatgcgccatcatgcccggctaattttgtatttttagtagagacggggtttctccatgttggtcaggctggtcttaactcttgacctcaggtgatccacccacctcagcctcccaaagtgctgggattacaggcatgagctaccgtgcccggctggttgccagcttttaattttgctaagtaaggacataaaatgtaacaagtaagtgataaatagctattagcatttaccatcaccataatttcataaaagaaaggatgcttggtcaggcgtggtggctcaggcctataatcccagcactttacgaggctgatgggggaggattgcctgagcccaggagatagagaccagccgggcaccataaggagaccctgtctttacaaaaaaaagttaaaaaaaaattagttgggcatagcagtgcacacctgtagtcctagctaagtgggaggctgaggtggaaggatcacctgagcccagcagttggaggctgcaatgagctatgattgcactactgcactccagcctgggcaacagagggagaccctgtcttaacaacaaaaagactccttaactgccccccacacccgccccccccaaatgaggaagggtgaaacctcaaaatgaggggcgcttttggcacccagacactgtggagatttgtacacacagccttttctgtacttgtctccactaggcttctctccacagaccatcccgggtggcatttgggacccagctggaggtgagtcatttctcctcaggaggctcctcagtgaggtttatttatttgtttctacacgaatagaggagcagtgatgagctgtctgttgggtggtttaaaggctgcgaggaaaggtgtgaagtagggtccccttgctcagcacgcaggagctgcctggcgccactgagcctgtgggtcccacggtctctcctcccctcttcctgtggctttgtggttcattaccactttaaccccagaaacctgagccgccagaggttattgggcattctctgggccacaggctgtgttgggggtcaggactgagagtagaaactttcttcctgaagcatctgtcttgagtatagtatggggagcctttaaaaaaccctaatgacagctgggcgcggtggctcacacctgtaatctcagtactttgggaggctgaggcgggcggatcaccaggtcaggagatcaagaccatcctggctaacacggtgaaaccccgtctctactaaaaatacaaaaaattaggcgggtgcggtggtgggcgcctgtagtcccagctactcaggaggctgaggcaggagaatggcttgaacccaggaggcggagcttgcagtgagctgagtttgcgccacagcactccagcccaggcgacagagcgagactcggtctcaaaaaaaaaaaaaaagccctaatgactgggtcccatttccatggttctgaggcaacaagcaaggtggagccttcaaggctccagacgaagctgactctggcggggtttggaaaactgctgaactgcacgagcatccatgggcagccatattttctatttagggctgccccatcttcttcttgttttcttcttttttttttagagatgaggtctcactatgttacccaggctggtttcaaactcctggcctcatgggattctccagcctcagtctcccaaagtgctgggattacaggtgtgagtccggcctgcccccatcttctttgtcttctgattttagctttcattctagtgcctccatgccctcaggtcatcctttagataccctgggctataagtgtgtaactgtcctctgctgggctgggaagaacgcaaaggaacaataaactgggtccctcccatgaattctaggttcaattcaggtcgcacttgctgtgcggccttgaacaagtcgctttccctctccgggcctctgtttcccctctgtacaattggaagagtggatgcattcttatacttcctctggtgctgctggtgtgtggtttcccccttactggtgatggcatactccaggaattctggaaaccctccctgatgccgaagcagggtcaccctctccccgcctccttgctagtccttactcctggcccagcgaggctcgtgatttttgtttaaaccattctgtggaattttagaattcttgatggaaaaatgatgagctgacaagaaaatgttttgaaatccagagcattccactcactgcctgttacggttaaggcccaggctttcgcttggatacttagcctcctcttgccttggggtttccgcagaaacactgttcccgtgcagggggagggagccgtgagggtgcctggtccacatccctgctgctgcaatgtgtactaaacccatacaggcaaatgaatatttatttgttatatattttttattgcaaaaaggtgcatagaaggaaattgaaatagtgcttatctctggtgatgtgtatctttccattttcttcttcctgtgtgcaaatatatagtattatgatatatactgtgttacacaataatcataaaaatatatttctttagaaagtttgaatcaaaatacatagaatttttcttgtcttgcattcttcatacagcattatgtcatgtcttcaatgtttttctaaaatatttttggccagacgtggtggcacacgcctgtagtcccagatacttgggaagctgagatgggaggatcactgaagcccagaagttaaagctacagtgagccatcatcatgccactgcactccagcctggcgacggagcgagaccctgtctcaaaaaatatataataattggccaggcacggtagctcatgcctgtaatcctagcactttgggaggccaaagcggatagatcacctgaggtcaggagttcaagaccagcctggccaatatggtgaaaccctgtctctactaaaaatacaaaaattagctgggtgtggtggtgggcgcctataatcccaactacttgggaggctgaggaagaagaatcgcttgaacccagtgggtggaggttgcagtgagccgagattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtagtacctgcatccttgcatcggacctgtaaggacaacagctgcttcagtgtatccactgagcatcttctctgtgcagctttaagcttttggtggagaggcaggtggaaagaaagccccacctttagcaggcatggtgtggatagaaaaaatgcaaataatagtattattgatttttccactgttatgaatgaaatggagaaaggaatgctttgggtggatcagggagggctctgaggaggaggtaactcctgaactggttctgaatgatggtgcaatctgcagaaacaggctgatggtgaggaatgtctcttttaggcacttactactaataaagacgatgataatattctcttcagagattctgcaaatgcgacaagcctcccaggtaaggactgggtattttcatattcccagggtccgagggacagaagatttgtctctgcagaaagtcctttcttatttggacatgtcgtcagaggatcaatcacagatcaatcgcagaaatgttctgtgtgtgtgtgtgtgtgtgtgtgtgtgtgtgtgtgtgtgtgtgtgtgtgttggagagagtcttgctcggttgcccaggctggagtgccgtggcatgatctcggctcaccacaacctctgtctcctgagttcaagcgattctcctgcctcagcctcccaagtagctgggattacaggcgcatgccaccatgcccagctaatttttgtatttttactagagacagggtttcactatgttggccaggctggtcttgaactcctgacgttgtgatccacccacctcggcctcccaaagtgctgacattacaggcatgagccaccgtgcctggccagaaatgttcttttattactttatatgttgaactttgatattgttagctaagatataatgaggagaccgtaagaaaagtgggacaaatcacttcgagatatttgaaaagtgagatatttcacagttggcccacaatacaaatgaatgtgctgcaaacaagattattggagtctgaaatggaatacctgttgagggaaatctttattttgggagcccttgatttcaatgcttttgattccctatccctgcaagaccaggaaagcttaccagtatttgaatcaagaaagatcacaagtcctgtgtttgactaggtatatgggacttatggaatccagactccagaggttcagtagttgagcagctcccctgatgactcttgggcttcgtgaggcagtccttgccctcgttccccatccctgggtggattcctgcctgcactgatgctggctgcctctgctacaacagcccaggtacaaagccctaccatggtgcagtgcacctgtggaggacctgctaaatacctggggctgagctctgcacagttggggactcggagaggattagagccatccctgttctcaaggaggctacagtccaggctctgacaaagagtaaattggtaactgtgacaaagaccagcatgtgagatgggccaaaagggaggcacagataaagcaaagtggaatttagagatttgaaagagtatatcaagctgagcagtcacagaaagctcatggaggaagtgccatttgaaatgggctttgaatggtatgggtgggatgcaagaggttgggtgttcaaaggttgctatgggccgggcgcggtggcttacgcctgtaatcccagcactttgggaggccgaggtaggagaatcacctgaggtcaggagttcaagactagcctggccaacatggtgaaaccccatctctactaaaaatacaaaaattagccaggcgtgatggcaggtgcctataatcccagctacttgggaggctgaggcaagagaatcacttgaacctgggaggcagaggttgcagtgagctgagatcgagccactgcactctagcctgggccacagagtgagattccatgtcaaaaaaacaaaacaacaacaacaaaaacaaaagctgctatggaggaggggaacctccagtcctcttcgtccaccctcactgatgattttttttcttttttttgagacggagtctcgtcaagcgattctcctgcctcagcctcccgagtagctgagattacaggcatgcaccaccacgcctggctaattttgtatttttagtagaaacggggtttctccatgttagtcaggctggactcgaactccccacctcaggtgatctgcctgcctcggtctcccaaagtgctgggattacaggtgtgagccaccgcgcctggccagcattctcaaatttaacatgtctaaaagagaacacctgacgcctccccacctattcaacccagatctgttcttctccatcttccctatctcagtaactggtaccgcatttgctcaggtgcgggggatcgggcaggcttcctccctactcctcatcctgtgtccagtccctcagcaagcgttgtccttgtgctttgagacgtatctaggaattgaccactcctcaccatctccagtgccaacacccagtccagcccctgccgcctctcatccagcagggcttcctgggctgccaactggtctaccaacttctagtcttaacccccaaccaactcttttccaaccagcacttagagtatcccttaaaacacaaatccaagctctctctggctcagtaccatctcccccagagtaaaagtcaaagtcttgacaaagtccccagtttctacgaggagtcccagcaaagccatgtggtcccctatctttagacgttgcctctccattctccctttcctcgctctgccccagccacactgccctccttgctcctccacacatgctctacctcagggcctttgcacttgctgtgtgctctgcctggacacgcttcctctgacattcactttgccagctccttcctattactcaagtctctgctcagatgcacccttctccgggaggcttttcctgataatttttttaaaaaacatttgtttggccgggcgcggtggctcacgcctgtaatcccagcactttgggagccgaggcaggtggatcacgaggtcaggagatcaggaccatcctggctaacacggtgaaaccccgtctctactaaaaatacaaaaaattagccgggtgtggtggcgggtgcctgtagtcccagctcctcgggaggctgaggcaggagaatagggtgaacccgggaggcggaggttgcagtgagccgagacagcgccactgagcaagactccgtctcaaaaaaaaaaaaaattcatttgtctgtctcccttgattggatgtaagatccatttagatacatgataggcactcaaagaatatttgttggatgaaagaaggaacaaatatatggccaggcgccgtggctcatgcctgtaatcccagcactttgggaggccgaggtgggcggatcacctaaggtcaggagttggagaccagcttgggcaacatggcaaaacctcatctctacaaaaaatacaaaaattagccgggcatggtggcatgtgcctattgtcccaggtacttgggaggctgaggtaggagaattgcttgaacccgggaggcggaggctgcagtgagcggagatcacaccactgcactccagcctgggtgacaagagcgagactccatttcaaaaaaaaagaaggaacaaatagaaaagatgatgaaatgttaataaatgagcaagccaagcatactgctttcattacacagctgcatctctcaagagacatgggacatgcttggagaaacttgtctttgcagccagcgcccgctcaccagtctgggctctctgcgctgcctgactctagtaggcatctgaagtgatggctggcaggcagcctcttcgtcagcagtggattgcattttgggtagaagagcctgaatgctgggtccatacaactgtgactgcattcccagcagaaggagatggttttgtttagatgtgccctctgtctagtccagggactctggcagtggtaggaagagcctttctgtgggaagacatggctgcttgcaaagctggtttgttctttccttcattcaaagaaatattttggcgatcctactttgtattcggcactgtgtaagctgctggcagtgttacagtgaaaaagacacatgtggtccctgccttcagagaactcagtctagaggtggaaatggagaaatactgggaggggcacttgctcagcttggagtggggtcaattctcaaaggaaatgacatcacctcatctgagatccaaaggccaagtagggactagaccacaaaagggtgcagcaaaggtagagaaaacagacaggagagaagagggaacgtgtgtggagagccctggaggaaaaagatcatggcttgttggagaactgaatgaagttcatatggctggggcttgagtaccaaatgcagggacaggcaagagatgacacccccatggagaaaactgcttccaaacacttgatttaaagcatccaatcctctctgacattgtcctcaaaggaactgccatcaaggaggtccccaaagccttccgtttgttgtaccctctttgtgccttgtgggagcaggtggaatgtcaccagaaaagccactctgaaagtgagtaggagtctgtggctagccacaggcgctcagaaaccctgagcttgaggtgtctctcttgccaagtggtggaatcctggaatctagagtgggctttgttaagaaacaaacaaacaaacaaacaaaaaacagttaagcttgtcaaatggcctgttggttggcagagctgtttcattttctgggaggggggttggaggggaaggttccctttgaggcttttgacagcaccagctaagtggttttcttctcctcctattcctttttctccatattctcctcttcctcctctatcttcaattttttttttaacctagtgcaagattcttcttcagtaccactgcccacattcctggttgctggagggagcctggccttcggaacgctcctctgcattgccattgttctgaggtgagatgggtcccaggggatggccctgtggtgttctcatatttcttatctagctttcctttgcccattctgaaatttatggtgcatttattcattcatttatccattcatcaaatgaatgcacacaccacaacacacacaacacctactattatgccaagccgtgttttaggtgctgcaggagacaatgctgggcaggacagatacagtctcaggaagaagtcagacacgaagaggtaatcactactgtggtaagagctacaaaaagcatgccatggtgaggagaactgacctggcattaaggaggaagaggaattggtctgagaaagaagagggttctttttttttgagtcagcatctcactctgtcacccaggctggagtgctgtggtgcaatctcgcctcacaggacaacctctgcctcctaggttcaagtgatcctcccacctcagcctctggaatagctgggactgcaggtgcacaccaccctgcctagctaatttttctattttttgttgagatgaggtttcatgttgcccaggctggtctcaaactcccagggtcaagtgatccgcctgccttggcctcccaatgtgttgggattacaggtgtgaactaccatgcccggcccaaagagggttcttaggagagaagcccagcatgtaatatggttgacagcgtgtgcatgcacgtgtctgtgaagggggcgcagcacggttggggcaatatggggcaggaagagtggacaggtaggctggcaccaggtcataaaaggccttgaaagaggtgggaggattttaggccttctcttgaggctaaggagtgtctgttggagtttttttctttttctttttctttctctttcttttcttttcttttttttttttttttgagacagagtcttgctctgtcgcccaggctggagtgcagtggtgcgatctcagctcactgcaaccccaccttctgggttcacaccattctcctgcctcagcctcctgagtagctgggaccacaggtgcccgctaccatgcccggctaatattttgtgtttttagtagagacagggtttcaccgtgtcagccaggatggtctcgatctcctgacctcgtgatccgcctgcctcagcctcccaaagtgctgggattacaggcgtgagccaccgcgcccagcctggggagttttaagannnnnnnnnnnnnnnnnnnnnnnnnnnnnnnnnnnnnnnnnnnnnnnnnnnnnnnnnnnnnnnnnnnnnnnnnnnnaaatttgctgggcatggtagtgcttgactgtaatcccagctactcgggaaactgaggcaggagaatcacttgaacctgggaagcggaggttgcagtgagccaagattgcgccactgcaatccagcctgggtgacagaatgagactcatctcaaacaaagaaaaccaaaaagtcactctcaatgcagtttggagactggatggggtgagtgaaaatggatgcagtagcccagggtctgggcaagagataataataaactgttttaggatggtggcaatgggttggagagccatgaatagattcttttttttttttttttgagatggagtttcgcttttgttgcccaggctggagtgcagtggtgcaatctcagctcactgcaacttccgcctcccgggttcaagcgattcttgtgcctcagcctcctgagtagctgggattgcaggtgaatgtcactacgcccggctaattttttgtattttcagtagaaatgggatttcatcatgttggccaggctggtcttgatctcctgacctcagatgatccgcccgcctccgcctcccaaagtgctgggattacaggcgtgagccactgcacccggcctcaagatatattttagaggtagaattgacaaggcttgacaacagattagatgaggaggatgaaggagagggaggagtccgggatgaccctcccatttctggcttcagcagttgggcagatgatactgtcattcactaagactggaaacacctgaggatagacaagtctcagtgaaaagtggtgattccactttgggacccacttgagtttgagatgccccgagaacctcaagcggacacgcttggcaggcaacacagatcgtcaccagcaagtagatggcaataagagtcattgggtgggggttggggatagggctgaaccctgtggggatccaaggtgaaaagttctgtagagaaggaagtgttgggaaaggggctgagaggaaccacaagattctggtgttgtaagaacgagagggagggagtgtgcattagacactgaagaaacacagtaggtgttggaattacaacatgaatatgacctttcctcccttccgagaaccacatactcaaatgatgaaaataccatgtgaaggtattttcatggtagctaacgcctgtaatcccaacactttgggaggccgaggcaggtggatcacttcatgtcaggagttcaagaccagcctgaccaacatggtgaaactccgtctctactaaaaacacaaaaattagctgggcatagtggcacatgcctgtaatctcagctacttgggaggctgaagcaggagaattgcttgaacccaggaggcagaggttgcagtgagccaagattgcaccactgcactccagcctggacaacagagcaagactccgtctcaaaaaaaaaaaaaaaaaaaaagaaaagaaaagaagaaagaaagtaacattggagaagcaccacacagttaaatccaaggcgcccaagcaggacctccttaggaatattccatgtatcaatccaggaacttaaaggtcacctttaaatgctctgccctagtgttcttttccagccatggttaggaaatactcattcaggctgagttgcaccctggctgctgtctcatcatgcccatttcatcccaatcatcttcgctccatttggtcattggttttgtcattcatttccaagtctgcagaaaagtcagccaatagtgccttcagtgaacaagcaataatgaaatttttcggtgttcacaattttactgcaggaaccggctttttttcataagctgaaaccctaaaagatgtcaggctgggtcttctaggcagtggttaatcgcgatgatctacaagtggaggagacattgcactctgtcctttctacatgtagagagctttctacacgttagctcatcagaccctgccagtagccctgacctagcttgactaccaagtgtggtgtgggttgaaagattagcaagatgactactcaaattgggttcagggttgttttcactttttttctttttctttttctttttcttttctttttttttttttttgagacggagtctcgctttgtcgcccaggctggagtgcagtggcgcgatcttggctcactgcaacctccgcctcccgggttcacgccattctcccgcctcagcctcccgagtaggtgggactacaggcgcccaccaccacgcctggctaattttttgtatttttttttagtagagacggggtttcaccgtgttagccaggatggtttcgatctcctgacctcgtgatccacccgccttggcctcccaaagtgctgggattacaggcgtgagccaccgtgcccggccttcactttgctttttcaatgaagtagattacaagccgtctgaagggtgcgtggaagataagattcttaatgagtagaggtagctccttggaggatgcaaagcctgttatattttttggccagtgaggggccatgtcagcatccacgggttcacctcctgcctaccaaaggattccttgcctcaccctaggtataccctcctgtgttctggctctgtgtctacgttagggcttcaacagacttttctcataacccaccacaggccctatagagtagagtagatatgatatacatttgacgggaggaaactgaagctaaaagagatggtgcgataacagctagtaagaataggccaggcgcggtggctcacgcctgtgatcccagcactttgggaggccaaggcaagtggatcacctgaggtcaggagttcgagaccagcctggccaacgtggagaaaccctgtctctactaaaaatacaaaaattagctgggcatggtggtgcacacctgtaatcccagctacttgggaggctgaggtaggagaatcgcttgaacccgggaggcagaggttgcagtgagcccgagatcgcgccactgcactccagcctgggcagcagaaggagactccatctcaaaaaaaaaaaaaagatgaagaagaaggccaagaatcaaaccaaaaactcctgctatttctatagggccttaagggtcatctagtcaaactctttcattttataaatgaggaaacagcccccaaaggtaaaatgacttgcccaaggacaagcaagaacacacaccctgagagtccctgcccatggtccccacctgctattggctaagagctgggcccagctggtcccattggcccaccactggcccttaacatgcagcaccatcttggtgtgttgtaatggctaatagaggagcattaggttgggaacagacctggtttgctattctgctgatgatgcttggacactggctggttgctaaacaaccagagtccctgcaggcacagacagggccagtgccctgtgctgagaacatgccaggaatttattttctagcctagtgagtttccattttcttctgtataaggcaaatttgtttggaaagaggccagttatttcaagtgatgaagaagccttctattccccaaatcccctctgtctagcaaagagtataaacttagaaatactgtggggctctgggctgccaaaatggctgaaccatggttaccatgggatggccacatttacagtaggtgaagtgtgagaggttgacttcatcctgccagtctatactatatttttttgtatggccctaaatctttttccagcaatatcagtgatttttttctttgttttttattactcattctttttttctgaatcatagatgattttttaaaatttaaatatgctatcgaaaaggcttgccatcttacaggggccaattcctcccaccctattctctgtcccccactgattctctgtattttaggttatcaggcactgggaaaatagaattctcctagtagagaattatttttctgcatatttatctagaatgagcttacatcattaagtgaggacttcctatgtgtatgcctatgacttaaacatcatttcgttttgaatgtagtgtatcattccggtattttaaaatcagagcttttgctacctccacagctgggggacgggcagagggactttcatggtgttccgggccatggaggtggctgggtgcagtgggcactgtctgtggcctttggggtaaaaggggtggcaacttggtttctacatatctttctaaaaaagagtgagagttttgagcattttaaaaaacttcttttagctacagaatcttttctttaaatgaaactttttgaagcccaaatatgtaaaatagataaaaggtggaggtcaaggtgcaaaagaaggcagcagagagctcatctgtttcttctttctgcccaccctgtgtcctctccagcccccaggccctgctcacacccatccaggccagctctggacaccctcaggttggctggtttcaaagtcctctttgagtttagtgattttcagaaaagaattcatactcgccttagaatatttcaaaaggaaagctcacgtttctttgttacccattcagttacttcgaaaaaaaactgaggacagagattgcttccatattaggtcaacagggacttgaaaaatatatacatacacacatacatatgtatgtgatatgtgattattactggtgatttgctaaataatgacaaatggaaaaaaatatatgtcatccaaagagagccactgttaattttcaaaatgtaaatgtgattgaagtctaacaaacatacagaaaagttcccacatcatgtgtacagcgccatgaagtgtacacacccatgtcattataatgagatgcacgtggcaagtcaagatgccaagacaccaggttgcagcagagaaagaggtttaatcagagggtcaccaaaggaggagatgggaggaaacctctgtagggtccagccgtacggagcttagcgggtgttctccccgtgtgtggagacgagagattgtaataaataaagacacaagacaaagagataaagagaaagcacctgggcctgcgggaccactactatcaagatacagagactggtagtggccccgaacgtctgggctcgctgatattttttgcatacaagacaaggaggcagggtaaggaaggtaaatcttctaagtgattgacaaggtgaagcaagtcatgtgattacaggatcgggggcccttcccttttaggtagctgaagcagagagcaggcagcatatgtcagggttttcttctctgcacttataagaaagatcaaagacttttaagactttcactatttcttctactgctatctactatgagcttcgaagaggaaccaggagtgcgggaggagcatgaaagtggacaaggagcatgacccttgaagcacagcaccacagggaggggtttaggcctctggatgactgcgggcaggcctggataatatccagccttccacaagaagctggtggaggacagtgttccctgactcctccaaggaaaggagactcccttttgccggtctgctaagtaacaggtgccttcccagacactggagttactgcttgaccaaggagcgctccagcggcccttatgccggcatgacagagggttcacctcttgccttctaggtcacttctcccaatgtcccttcagcacctgaccctatacccgccggttattcctaggttatattagtaatggaacaaagagtaatattaaaagctaatgattaataatgtttataataatgattgataattgttcatgatcatctctgtatctaatttgtattatgactattcttattctattttctttattatactgaaacagtttgtgccttcagtgtcttgcctcggcacctaggtaatcctctgcccacacctcaaatccatctccccaaggaatttggggctagggttgtaaaaatgttggactgggccaaagtgtggagatggttgactggttgcagggtgtagggtgaggtcctgggacaaggagatgaagaagctgtcttctcatgccaatcccgttcctctgtgagggtcttcaaactggttgccggaattaggggtccgtaaaacatcttaagtgatccttaaacaaaagtcttaggatcctaatgtcagaaatcctatctacagaaacaacggggatgcagatggtcagtgtctagggctacgtgactttttgcaataaggaaatgggccaaagtgcagcctgattactgcttcattataactattaatatatttctgtccagaacccagcatgcaatttttgtcaaccctgtggagatggttttacaatcaacacccagatcaagaacacttaatatttagacaaatctcctgagtctttttcctctgcctagtttcttgtttgtttttacacagccatgattattctgtatcctcagctctgcatcctgcctttcacacttagcactataacacaggcattctttcacattagtacaaattcttgtaaatctcagactttttttttttttttttgagacggagtttcattcttattgcccaggctggaatgcaatggtgcgatctcagctcactgcagcctccacctcctgggttcaagcagttctcctgcctcggtctcctgagtagctgggattacaggcgcctgctaccatgcctggctaatttttgtattttttaatagaggtggggtttcacaatgttggtcaggctggtctcgaactcctgacctcgttatctgcccgcctaggcctcccaaagtgctgggattacaggcgtgagccaccgtgcctggccataaatctcactttcattagctgtagtattaggtggatataccaatttctcttaatcaacctcctattactcctaattggtggcacccaaacattaccaattatttgggtgttattttgcttttatttaattaattaattaatttatttatttattgagacacatcactctgtcacccaggctggagtgcagtggcataatctcagcacactgcaacctctgcttcctgggttcaagcaattctcctgcgtcagcctcccaagtagctgggattacaggcatgcgccacgacacccggctaattcttttttagtagagacagggttttgccacattggccaggctggtcttgaactcctgacctcaagtaatccacccaccttggcctcccaaagtgctgggattacaggcatgagccaccacacccggccttattttgcttttataaaaaacactgtgttgaacatctttgtgcataaagggttttttttttttatagctatgttctttcttttcccagaagtagaattcctgggtcagagagtctgaattctttgaaatccagagtgtaatgattctctcctcagtcctttcttacaggagaactccattcaatgactcagcatagctccagtcagcagccctgctgggctctcttcctgtgtggtgtccacatggtgaagccctaaataatattctgcagattgtttatttcatttggataccaagctaaaagccagtggcagatttggagccaactattaattatttatcataacaaggacaggaataacctgtcgatataaaaagaaacccaaggaaaatccccaaatcttgtttttgacattggtttcccctcctctttcccagcccttcctggagtaactgatcttccatggaattgagggaggccaccttgttcccactttggggttaggaggcatgtcagtcacaaagtgggaagcaagagggaggggctgaggcttggggcactggccaccctggcacagttgaagggcccctttaggaaggggacgtgactgtgtttttgaagatccatgtcaccatttcatctttctttgagctgtcaagtgacttttctcagttactgagccctggctttgggcccagagtggagcactgtgaaccaagctgtgatcagaaagatgtctatctccttcctgtgtagcattgactttcctgtcagatgagtcaaattgtgcccagtggtgcccacagttgagtctgtgggaagtcaccagcatggtgggagtggaccgagaggcgtagggagaactggggaggtcagcaacattaggagcaagaggaacaggaaggcagttgagggagcagtgggacccttttcctgctattacatggcggttgcaaattatctgcctcctgccagccttactttgaccgagaggcccattttctttccctactaaaagaatgctttctttttttattttctttccttttcttttttttttttttgagacagagtttcactcttgttgccccaggctgaagtgcaatggcacgatctcagctcactgcaacctctgcctcccgtgttcaagcgattctcctgcctcagcctcccaagtagctgggattacaggtgcctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtttgtgtgaaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaaaatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggag

SEQ ID NO: 11831 - DNA, 11020 bp, Human
gagaaagagagaaagagaaagaaaggaagaaagaaagaaagaaagaaagaaagaaagaaaagaaaagaaagaaagagagagagaaagaaaaagaaagaggaaggaaggaaggaaggaagaaagacaggctctgaggaaggtggcagttcctacaacgggagaaccagtggttaatttgcaaagtggatcctgtggaggcaaaacagaggagtcccctaggccacccagacagggcttttagctatctgcaggaccagacaccaaatttcaggagggctcagtgttaggaatggattatggcttatcaaattcacaggaaactaacatgttgaacagcttttagatttcctgtggaaaatataacttactaaagatggagttcttgtgactgactcctgatatcaagatactgggagccaaattaaaaatcagaaggctgcttggagagcaagtccatgaaatgctctttttcccacagtagaacctatttccctcgtgtctcaaatacttgcacagaggctcactcccttggataatgcagagcgagcacgatacctggcacatactaatttgaataaaaatgctgtcaaattcccattcacccattcaagcagcaaactctaccacctgaatgtacatgccaggcactgtgctagacttggctcaaaaagatttcagtttcctggaggaaccaggaggagcaaggtttcaactcagtgctataagaagtgttacaggctggacacggtggctcacgcctgtaatcccaacactttgggaggccgaggcgggcagatcacaaggtcaggagatcgagaccatcctggctaacatggtgaaaccctgtctctactaaaaatacaaaaaattagccgggcgtggcggcaggtgcctgtagtcccagctgctggggaggctgaggcaggagaatggtgtgaacccgggaggcggaacttgcagggggccgagatcgtgccactgcactccagcctgggcgacagagtgagactctgtctcaaaaaaaaaaaaaaagtgttatgatgcagacctgtcaaagaggcaaaggagggtgttcctacactccaggcactgttcataacctggactctcattcattctacaaatggagggctcccctgggcagtaccctggagcaggcactttgctggtgtctcggttaaagagaaactgataactcttggtattaccaagagatagagtctcagatggatattcttacagaaacaatattccacttttcagagttcaccaaaaaatcattttaggcagagctcatctggcattgatctggttcatccatgagattggctagggtaacagcacctggtcttgcagggttgtgtgagcttatctccagggttgccccaactccgtcaggagcctgaaccctgcataccgtatgttctctgccccagccaagaaaggtcaattttctcctcagaggctcctgcaattgacagagagctcccgaggcagagaacagcacccaaggtagagacccacaccctcaatacagacagggagggctattggcccttcattgtacccatttatccatctgtaagtgggaagattcctaaacttaagtacaaagaagtgaatgaagaaaagtatgtgcatgtataaatctgtgtgtcttccactttgtcccacatatactaaatttaaacattcttctaacgtgggaaaatccagtattttaatgtggacatcaactgcacaacgattgtcaggaaaacaatgcatatttgcatggtgatacatttgcaaaatgtgtcatagtttgctactccttgcccttccatgaaccagagaattatctcagtttattagtcccctcccctaagaagcttccaccaatactcttttcccctttcctttaacttgattgtgaaatcaggtattcaacagagaaatttctcagcctcctacttctgcttttgaaagccataaaaacagcgagggagaaactggcagataccaaacctcttcgaggcacaaggcacaacaggctgctctgggattctcttcagccaatcttcattgctcaagtatgactttaatcttccttacaactaggtgctaagggagtctctctgtctctctgcctctttgtgtgtatgcatattctctctctctctctctttctttctctgtctctccctctccttccctctctgcctccctctctcagctttttgcaaaaatgccaggtgtaatataatgcttatgactcgggaaatattctgggaatggatactgcttatctaacagctgacaccctaaaggttagtgtcaaagcctctgctccagctctcctagccaatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacaggtcagtggagacgctgagaccagtaacatgagcaggtctcctctttcaagagtagagtgttatctgtgcttggagaccagatttttcccctaaattgcctctttcagtggcaaacagggtgccaagtaaatctgatttaaagactactttcccattacaagtccctccagccttgggacctggaggctatccagatgtgttgttgcaagggcttcctgcagaggcaaatggggagaaaagactccaagcccacaatacaaggaatccctttgcaaagtgtggcttggagggagagggagagctcagattttagctgactctgctgggctagaggttaggcctcaagatccaacagggagcacccagggtgcccacctgccaggcctagaatctgccttctggactgttctgcgcatatcactgtgaaacttgccaggtgtttcaggcagctttgagaggcaggctgtttgcagtttcttatgaacagtcaagtcttgtacacagggaaggaaaaataaacctgtttagaagacataattgagacatgtccctgtttttattacagtggcaatgaggatgacttgttctttgaagctgatggccctaaacagatgaaggtaagactatgggtttaactcccaacccaaggaagggctctaacacagggaaagctcaaagaagggagttctgggccactttgatgccatggtattttgttttagaaagactttaacctcttccagtgagacacaggctgcaccacttgctgacctggccacttggtcatcatatcaccacagtcactcactaacgttggtggtggtggccacacttggtggtgacaggggaggagtagtgataatgtttcccatttcatagtaggaagacaaccaagtcttcaacataaatttgattatccttttaagagatggattcagcctatgccaatcacttgagttaaactctgaaaccaagagatgatcttgagaactaacatatgtctaccccttttgagtagaatagttttttgctacctggggtgaagcttataacaacaagacatagatgatataaacaaaaagatgaattgagacttgaaagaaaaccattcacttgctgtttgaccttgacaagtcattttacccgctttggacctcatctgaaaaataaagggctgagctggatgatctctgagattccagcatcctgcaacctccagttctgaaatattttcagttgtagctaagggcatttgggcagcaaatggtcatttttcagactcatccttacaaagagccatgttatattcctgctgtcccttctgttttatatgatgctcagtagccttcctaggtggcccagccatcagcctagctaggtcagttgtgcaggttgggaggcagccacttttctctggctttattttattccagtttgtgatagcctcccctagcctcataatccagtcctcaatcttgttaaaaacatatttctttagaagttttaagactggcataacttgttggctgcagctgtgggaggagcccattggcttgtctgcctggcctttgcccccattgcctcttccagcagcttggctctgctccaggcaggaaattctctcctgctcaactttcttttgtgcacttacaggtctctttaactgtctttcaagcctttgaaccattatcatgccttaaggcaacctcagtgaagccttaatacggagcttctctgaataagaggaaagtggtaacatttcacaaaaagtactctcacaggatttgcagaatgcctatgagacagtgttatgaaaaaggaaaaaaaagaacagtgtagaaaaattgaatacttgctgagtgagcataggtgaatggaaaatgttatggtcatctgcatgaaaaagcaaatcatagtgtgacagcattagggatacaaaaagatatagagaaggtatacatgtatggtgtaggtggggcatgtacaaaaaagatgaacaaagtagaaatgggatttattctaaaagaatagcctgtaaggtgtcagaaagcccacattctagtcttgagtctgcctctaacctgctgtgtgcccttgagtacacccttaacctccttgagcttcagagagggataatctttttattttattttattttattttgttttgttttgttttgttttgttttatgagacagagtctcactctgttgcccaggctggagtgcagtggtacaatcttggcttactgcatcctccacctcctgagttcaagcgattctccttcctcagtctcctgaatagctaggattacaggtgcaccccaccacacccagctaatttttgtatttttagtagagaaggggtttcgccatgttggccaggctggttttgaagtcctgacctaaatgattcatccacctcggcttcccaaagtgctgggattacaggcatgagccaccacgcctggcccagagagggatgatctttagaagctcgggattctttcaagccctttcctcctctctgagctttctactctctgatgtcaaagcatggttcctggcaggaccacctcaccaggctccctccctcgctctctccgcagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaaggtagttagccaagagcaggcagtagatctccacttgtgtcctcttggaagtcatcaagccccagccaactcaattcccccagagccaaagccctttaaaggtagaaggcccagcggggagacaaaacaaagaaggctggaaaccaaagcaatcatctctttagtggaaactattcttaaagaagatcttgatggctactgacatttgcaactccctcactctttctcaggggcctttcacttacattgtcaccagaggttcgtaacctccctgtgggctagtgttatgaccatcaccattttacctaagtagctctgttgctcggccacagtgagcagtaatagacctgaagctggaacccatgtctaatagtgtcaggtccagtgttcttagccaccccactcccagcttcatccctactggtgttgtcatcagactttgaccgtatatgctcaggtgtcctccaagaaatcaaattttgccgcctcgcctcacgaggcctgcccttctgattttatacctaaacaacatgtgctccacatttcagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaaggtaaatggaaacatcctggtttccctgcctggcctcctggcagcttgctaattctccatgttttaaacaaagtagaaagttaatttaaggcaaatgatcaacacaagtgaaaaaaaatattaaaaaggaatatacaaactttggtcctagaaatggcacatttgattgcactggccagtgcatttgttaacaggagtgtgaccctgagaaattagacggctcaagcactcccaggaccatgtccacccaagtctcttgggcatagtgcaatgtcaattcttccacaatatggggtcatttgatggacatggcctaactgcctgtgggttctctcttcctgttgttgaggctgaaacaagagtgctggagcgataatgtgtccatccccctccccagtcttccccccttgccccaacatccgtcccacccaatgccaggtggttccttgtagggaaattttaccgcccagcaggaacttatatctctccgctgtaacgggcaaaagtttcaagtgcggtgaacccatcattagctgtggtgatctgcctggcatcgtgccacagtagccaaagcctctgcacaggagtgtgggcaactaaggctgctgactttgaaggacagcctcactcagggggaagctatttgctctcagccaggccaagaaaatcctgtttctttggaatcgggtagtaagagtgatcccagggcctccaattgacactgctgtgactgaggaagatcaaaatgagtgtctctctttggagccactttcccagctcagcctctcctctcccagtttcttcccatgggctactctctgttcctgaaacagttctggtgcctgatttctggcagaagtacagcttcacctctttcctttccttccacattgatcaagttgttccgctcctgtggatgggcacattgccagccagtgacacaatggcttccttccttccttccttcagcatttaaaatgtagaccctctttcattctccgttcctactgctatgaggctctgagaaaccctcaggcctttgaggggaaaccctaaatcaacaaaatgaccctgctattgtctgtgagaagtcaagttatcctgtgtcttaggccaaggaacctcactgtgggttcccacagaggctaccaaattacatgtatcctactcatggggcctaggggttggggtgaccctgcactgctgtgtccctaaccacaagacccccttctttcttcagtggtgttctccatgtcctttgtacaaggagaagaaagtaatgacaaaatacctgtggccttgggcctcaaggaaaagaatctgtacctgtcctgcgtgttgaaagatgataagcccactctacagctggaggtaagtgaatgctatggaatgaagcccttctcagcctcctgctaccacttattcccagacaaccaccttctccccgcccccatccctaggaaaagctgggaacaggtctatttgacaattttgcattaatgtaaataaatttaacataatttttaactgcgtgcaaccttcaatcctgctgcagaaaattaaatcattttgccgatgttattatgtcctaccatagttacaaccccaacagattatatattgttagggctgctctcatttgatagacaccttgggaaatagatgacttaaagggtcccattatcacgtccactccactcccaaaatcaccaccactatcacctccagctttctcagcaaaagcttcatttccaagttgatgtcattctaggaccataaggaaaaatacaataaaaagcccctggaaactaggtacttcaagaagctctagcttaattttcacccccccaaaaaaaaaaaattctcacctacattatgctcctcagcatttggcactaagttttagaaaagaagaagggctcttttaataatcacacggaaagttgggggcccagttacaactcaggagtctggctcctgatcatgtgacctgctcgtcagtttcctttctggccaacccaaagaacatctttcccatagcatctttgtcccttgccccacaaaaattcttctttctctttcgctgcagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaagggtctttcctgatcattgacttgtcttggatttgacactgaacagtaaagacaaacagggctgtgagagttcttgggggactaaagcccactcctcattgctgagtgctgcaaagtacctagaaatatccttggccaccgaagactatcctcctcacccatcccctttatttctgttgttcaacagaaggatattcagtgcacatctggaacaggatcagctgaagcactgcagggagtcaggactggtagtaacagctaccagtgatttatctatcaatgcaccaaacatctgttgagcaagcgctatgtactaggagctgggagtacagagatgagaacagtcacaagtccctcctcagataggagaggcagctagttataagcagaaacaaggtaacatgacaagtagagtaagataaagaacaagaggagtagccaggaaggagggaggagaacgacataagaatcaagcctaaagggataaacagaagatttccacacatgggctgggcatggtggcttacgcctgtaatcccagcactttgggtggcaggggcagaaagatcgcttgagcccaggagttcaagaccagcctgggcaacatagtgagactcccatctctacaaaaaataaataaataaataaaacaatcagccaggcatgctggcatgcacctgtagtcctagctacttgggaagctgacactggaggattgcttgagcccagaagttcaagactgcagtgagctgtgatcgcaccattgcactccagcctgggtgacagagtgagaccctgtctctaaaaaatgttcccagatagaaaagaaaagaaaaagccctcaggtagaggaaccagcgtgaacaagagcatgggtgtataagaatgaatgatgcaaaaagtacactttcagaattgcgggaatcaccagaagcaaagtcaaagcgcaaaacaagccagaggaaaagtagttgtaactcacaccccagataaagagataacttgtttcacatgtaaagaactgcctcaaaacatttgaaaaaaaagaacaaaaatccagcaaaacaagaggcaagggatcttaacagtctgttcacagaaaagaaaatactatttgatcttgggcagagtaaaatgatgcttaacattgtaataagaaagtcaaattaaaagcactttgagatactagtattttcccatcagattgacaaaaatcaaaagtttaacaacagaccttgttggtcaaactgtcgggaaatccccactgttaaatattacgcgtgggactataaattgatatgacccttatagaacaaaatttgctaactatgaaaatcacaagtgcacttcccctttgatccagcaatttcactcctggagatttatcccacagatggacataacccatgtgaaatggaaaatgatcaaaattattcattgcacatcatttgtaataggaaaaattggaagtaacccaagtgtctatcaacaagagactgcctaaatgaagtaaaggacatagaatactaggcagctatagaaaagaatgagaaagcactctggtattgtttggttctgtgtcccagcccaaatctcatgtcaaattgtaatccccgatgttggaggtggggcctggtgtggggtgattggatcatgggggtggagttcttatgaatggtttagcactatccctttggtgctgttctcgtgacagagttcccacaagatctggttgtttaaaagtatgtggcatcctttctctctctctctctctctctcagtcctgctcctgccatataagacatccactcccgctttgtcttctgcatgagtaaaagcttcctaaggcctccccagaagcagatgctgccatgcttcctgtggaacagcctgcgaagctgtgagccaattaaacctcttttctttataaattatgcagtctcaggtatttccttatagcaatgcaaggactgactaatacatgctgtctg

SEQ ID NO: 11832 - DNA, 5421 bp, Human
ccagctactcgggaggctgaggcgggagaatcccttgaacccaggaggtggaggttgcagtcagctgagatcatgccattgccctccagcctgggcgaccgacgagcaaaactgtctcaaaaaaagaaaaaaaaatcttttagatgaatttgaatactttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaacttcctgtatcctgttgtttgtgttgctctctccagggctgggggtaggaggatgcaaggacttcctggcctagctcaccctggagaggtttgttgagtgcaaaggactagcttgtgccccacctcccacccacccagcagctaatctggtccctcccaacaacatggaaatgattaccctgtaccgcattctggttcagatttgggggtagggtgaatgcagcctgaggaggccagggagggaggactccggcagcgtttccttggcctcggcgagctactgggctccacttaaggaggctggggcagagcttccaggactctgcccggttagaaaacccgcacgagggcggtgccgctttggagacagggaggagggagaccggaagcctagatccctctggctgtcccctgcactgccggtaacatggcacaggagaggagggctgtttgtgcacgggcagctcctgcagctgctgccgtcgcccaccagcctcctatgccaaaccccacatcctaactcaggaacctctgagaaaaaacggagccctcgagggccccagcccttggaagggtaacctggaccgctgccgcctggttgcctgggccagaccagacatgcctgctgctccttccggcttaggaggagcacgcgtcccgctcgggcgcactctccagccttttcctggctgaggaggggccgagccctccgggtagggcgggggccggatgaggcgggaccctcaggcccggaaaactgcctgtgccacgtgacccgccgccggccagttaaaaggaggcgcctgctggcctccccttatagtgcttgttcggggcgctccgctggcttcttggacaattgcgccatgtgtgctgctcggctagcggcggcggcggcggcccagtcggtgtatgccttctcggcgcgcccgctggccggcggggagcctgtgagcctgggctccctgcggggcaaggtactacttatcgagaatgtggcgtccctctgaggcaccacggtccgggactacacccagatgaacgagctgcagcggcgcctcggaccccggggcctggtggtgctcggcttcccgtgcaaccagtttgggcatcaggtgcgccgggcggagcggggcggggcgggggcggacgtgcagtagtggctgggggcgccggcggtgtgctggtgggtgccgtcggctccatgcgcggagagtctggctactctctcgtttcctttctgttgctcgtagctgctgaaattcctctccgcccttgggattgcgcatggagggcaaaatcccggtgactcatagaaaatctcccttgtttgtggttagaacgtttctctcctcctcttgaccccgggttctagctgcccttctctcctgtaggagaacgccaagaacgaagagattctgaattccctcaagtacgtccggcctggtggtgggttcgagcccaacttcatgctcttcgagaagtgcgaggtgaacggtgcgggggcgcaccctctcttcgccttcctgcgggaggccctgccagctcccagcgacgacgccaccgcgcttatgaccgaccccaagctcatcacctggtctccggtgtgtcgcaacgatgttgcctggaactttgagaagttcctggtgggccctgacggtgtgcccctacgcaggtacagccgccgcttccagaccattgacatcgagcctgacatcgaagccctgctgtctcaagggcccagctgtgcctagggcgcccctcctaccccggctgcttggcagttgcagtgctgctgtctcgggggggttttcatctatgagggtgtttcctctaaacctacgagggaggaacacctgatcttacagaaaataccacctcgagatgggtgctggtcctgttgatcccagtctctgccagaccaaggcgagtttccccactaataaagtgccgggtgtcagcagaactgtgtgtatgtcctgtgtcattgtcatttgggaattctttttcttttctttttttttttttttttttgagacggagttttttgctctattgcccaggctggagtgcagtggcgcaatctaggctcactgcaagctccgcctcccgggttcacgccattctcctgcctcaacctcctgagtagctgggactacaggtgcctgccaccacgcccggctaattttttgtatttttagtagagacagggtttcaccgtgttagccaggatggtatcgatctcctgacctcgtgatccacccgcctcggcctcccaaagtgctgggattacaggtatgagccaccgcacccggcctggcgatactttttctaacctcattgtcatagtggtgggaacttaatcctccttcccttatcctagccaagtctgaactttctgtccttttgtctgcagcgtgtaggatccactctttcctttgtgggaagtctggctcctggcctgcatttctgccttcaccagaacatgcaaagggccatctcaagacccagttacaacaaagtccttacttcaaaaaagacacaaggcaatggttgactgcctaactcaaatgatagacttctgactacttgctgcacgctgaaatgactgtcacaaaataacatgagcccccactcacatttggagtcatggcctctccaattgttaggtccacacaatcccattttacacggaagctcatgcaatgttataaattctgttatctggctagatctttccatgttgctaccaagtgcctgtatctgctgtgacgatgatcttacaagtttctgcctcatatattcaagagtgagaaaactataatttaactggcccttctgactatgccctgcccaacacttaacgtgcaattaattgcacattcaggcccaggataagggcttgtctttgaagccagctgctgcttctcgggcaccactcaggtccagcctctccatctgttgaccctgctgccaataatctttaattttttttttttttttttttttttttgagacagtcttgctctgttgcgcaggctggagtgcagtggtgtaatctcggctcactgcaagctccgcctcccgggttcacgccattctgcctcagcctcccgagtagctgggactacaggcgcccgccaccacgcccggctaatttttttctattttttagtagacggggtttcaccgtgttagccaggatggtctcgatctcctgacctcgtgatccacccgccttggcctcccaaagtgctgggattacaggcttgagcagcaataatctttcaagacagatttggagccatttcctaacgcagtgcaggggactgcagggcctgggtgtagcttccgcttgtgcaaacaggtacccagagacatggtagtgctgttcacccgctgactgtggaccagaggttctggagtcccagcatttgtgttcaaattcgtgactcaaggtccttcttagtctgaaccaactctcaaggacttttcctcttgccctaagcagtgatctttgctgctgctttccccctttgtctgcccttaggtcactaaggattgtagggccttctggacctgctctggctccatcctgagaactcctgaacaggcccacctccctctggttctctctgccccagcctttgagtcccccttggggtgacccaggtagaactatcagcttcccctttggacctcactctacttgtgttgttccttggaactctcaggagtctcactcttgcccaggctggggtgcagtggcatgatctcagctcactgcagcctccacctcccaagtttaagcgattctcctgcctcagcctccccagtggctgggattacaggtgcctaccaccatgcctggctactttttaatatttttagtagagatgggatttcgccatgttggccaggctggtctcaaactcctgacctcaggtgatctgcccgcctagg

SEQ ID NO: 11833 - DNA, 11683 bp, Human
ttggtagaaccagattgtggtctgaaatcttttttcagaaatgctgccatcgtgtggcactgcggagctatgaccagaagagtcctgtaaagggtcgtatggttcatctcaagatggctgggctccagcataatctattcctataattaattctagcttcatattgaatcattcccgtgggcacagagtaaactacagtaaatcctgtggaaattttgttgtttttagaattttcggacttccctccactaaattgacaacatgacacgcttatgcgggtatgtttaaaggaaaaaaatagtttttagaagcagaaaaaagaagtctattttgcaactttataatctgtgtgctttctattttatagagatagtcgtcatcttacttattaaaatgggtgcttattacctacaaaccaatcatatcaattcatctggaatacatccaatttaagggagacatatttccccctaccaaatgttcatgaaacctatgaattagctatacactatcactgcaagacattatttaatctatatttatattaaaagtaatatttggcaaaaggaagctgacactttaggactaataaaaaccacaattacttttgcagcaacctaataataaataggaccatttatttttcatctcaattacacacaagtcttaacaataaaggtgtaaggtaaataaatagtgcaatctgcatttcacaactgagaaagcaaatgaagataagtaatctcaaggcaatattaaatattttaaaaggacccagagctctgctatccctgaattctgctctaatattcggactttccctgtaattttctttcattcagacaccttttaaatacctagtaaagtgttttttaatacagaaatttttaaaaatgtttttctttttaagtggcctactttacataccttgggagaaaaactagaaaaaaagatgattccaaaatcgaatctgttcctttagaaatgtgcaaaatttccttattgatgcatacaatttaaagatcttacgtctactctcattttaataacctgttcttttaaaggacattacaattcgtgactgcctgcccctcttaaaaatttcataatagttaacacacatatagtccttaagatacgcagagcatttgcatctaatatgtgctaagcattgctagtttaacatactaattcatttaaacccctcaaaaaccccatgacctaggtaatagtattgcatttcatggatgagggaacaaggataggtaggctgggcgatttgcccaaggttgcacaggtcagcagtgacacagcggaattcagaaccacggtctggctcctgaagcagccctctcaagcagtcatcctgctctcagtcagaaactgctttacttctgcaacatctagaataaattaccattcttctatttcatatagaattttatattttaatgtcactagtgccatttgtctaagtaacaagctactgcatactcgaaatcacaaagctaagcttgagtagtaaaggacagaggcaagttttctgaactccttgcaggcttgaacaatagccttctggctcttcaataagtacaatcatacaggcaagagtggttgcagatattacctttatgttacttaaaccgaaagaaacaaaaatccattctatttaattttacattaatgtttttccctactttctccctttttcatgggatccctaagtgctcttcctggatgctgaatgcccatcccgtaaatgaaaaagctagttaatgatattgtacataagtaatgttttaactgtagattgtgtgtgtgcgtttttgtttttttttgttttaaccacaaaaccagagggggaagtgtgggagcaggtgggctgggcagtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggtacagcttcagtttgctactgggttgtgcattcagctgaatttcatggggaagtccaaattctaaggaaaaatatttttaattgtaatgctgttaaacagacttaaattttctagcctttttaataagcagattagatacattgcaggtctcctggaacaaaggtgtctagatattttgaatgccaatcaaatttaaaacttaaaaatacttccactgggtcctcaaaagaacggaaaccaccgatgctaatcagaaaatagtaaaattaaattcccctttggaataattatacctatataattttcagtgggtgactgtgcaggaatttaaaagaaaagggatcttttatgctaattaaaccaattacaatgctattttttaaatgatgtatctcacttttaaggggaagaaaaccctttctgaatatgccactgctaaatttagctgttaaaatattcaccaagatacctgtatgacactgtgtaggcttattattacaaatagaaaagctgttggctattttcaatgttttcctttgaatttcaaatttttagaacatcttacttaaataacaaatttcagagatagtttgatttcacctaagtagcacctacttgataattaagctaaaagtcacatttaaagtacatgttggaaaaatggataaagcaaatttttttcatttttttctgtgagttttttcttctctaaaaaatattcccatactagcttattaatataattaagttactgttgatctgtttgtaggtttagagagctagatatataaggtagtaatggtataatttctggaactctaaattttaaagttgaataaatacagacttgcaaaatttccctttcccttgcctaatagtgaaagatggataataggtggcaatataaatattaacttgaaagactataatactaaaaagaaaaggcatctctaagaagtagaaaagattctatagaaaatatattttatttgtgatcattttgtaatgtggtagtataaaaaggtatcactgttgtaacctatgaagatgtcagctattccttatgaaatattttgcaggaaaactcactaccatgagaattgcagtgatttgcttttgcctcctaggcatcacctgtgccataccagtgagtacagttgcatcttaaagaaaattcctgaaaataactgaattgtgtgcttccatgtgctaggaggacattcttgtaatctttcttcatcttttctgtttctaaggttaaacaggctgattctggaagttctgaggaaaagcaggtaagcatcttttatgtttttatatagttaaatcatttactcaattatggcgagaggtgcaagaaacgtatttgctgcgatattacttatcttctcagtcaaatccattggtttacaagtattgattgactgcctgctatgaatctaggccagtaccaagcacagtatagtttttaataaatataagtttataaaaccaacccagatattttaaatataataatatctaggcatgtatgatgagttatcgcatgtaagataagttatatgaagttgtgtgactttttttccattagtccacatactgatctaaaagcagaaaattccagcttttgctttgtttagtggattgctaagtttaaaattcacattggatattagtcagaactgtttgtatgaccataatattcacaatattgtctgagatattagctgagaagcccattgtgaaaagaaagtctatgtgtgctgtttgtatctattgtgattgtcagctgatgttagatcacattttctaaccaaacataagaccaaccaaactctttattataattatttgaccagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaagtattctgtgttcgtttgtgtgtggaggggtgtgtgtgtctgtttttcaactgatttgaaaatacaggtgttgaatcctaataataaaccagaaaaattaacatctccagagaagatagaggtcatactatttgaggcaagaattagcgtctttttaataaacgaaaatatggcaaagatgcattttagaaggcacgtggagctataacaatttaagaaatacgtgaagagctcaaggctcagccttctagaatcccagaaacttaaagctagtaaaaaattggggaagtctctaaggatatatgcctgaaaatacacactggttatctgtgagtgttaggattactgggtggtttttagtctattcattttgcttacctttattttcttcatattagtttttaaaaattataaatgtaacttatacatccattctctctgagcctgtattacatgtgtcatgagaatagatagatagatatgaaaaagtgaagagaaaaactctgaactcatctggtctcactgtttttccgccttctttttttttttttttttttttttttgagacggagtctcgctccgtcgcccaggctggagtgcagtggtgtgatctcggctcactgcaagctccgcctcccaggttcaccccattctcctgagtagctgggactacaggcgcccgccaccacgcccggataattttttgtatttttagtagagacggggtttcaccgtgttagccaggatggtctccatctcctgacctcgtgatccaccctccttggcctcccaaagtgctgggattacaggcgtgagccactgcgcccggctgttttttcatcttcttaaagcaaggaaccccttctttcagcaaaacctttcggagaagcccaatactaagctcctctggttagagccagccatgagagaaactccaagtacttctgactggttctctctctactcatccaccccttaggtggctgcagaaggaactctgtgcaacccccagagttctcattctcagtgacagggaaatgtaatgattggccctggatgattcagcagatcagatgatacttactcagagcaatttccactcctttgcagtagcatattatcagtattttccagataaataacttggctaaagaaaaatccatttcatttacatctttggcaccttacagcaatagaacttttgtgcaatgattttaatattatatttctacattggctgataagatacatatggctattgagcactcaaaatgtgggctagtgcaactgaggaactgaatttttatcttctttttttttttttttttttttgagatggagtcttgctctgtcacccaggctggagtgcagtggcgcaatcttggctcactgcaagctctgcctcctgggttcacgccattctcttgcctcagcctccccagtagctgggggtacaggtgcctgccaccacgcccggctatttttttttatttttattttttttagtagaaacggggtttcactgtgttagccaggatgttctcgatctcctgacctcgtgatccgcctgcctcggcctcccaaagtgctgggattacaggggtgagccaccgtgcctagccatttcattttaattaacttaaatttaaatagctccatgtggttagaggatactgaattagcacagtcttagagagttccttcttgttccatggactggacacaatgaagattaacagtaattaaggtcacttctggtttagatgtgctttatctgagaggaaaattcagccagcaaacatacaaaaagaaagcacagtgtgaagttcggtgttaagagctagtttgcctgcgtttgaaccctgcctggctctgccatttcctaccacttaactgcactgtggctgagttttctgatctgtaaggtgggaataataatgatacctatctcataggggaatgaaaggatcaaatgagttcatatttgtaaagcaatttgaaagagtgcctagcccacagtaagtgctacataagagtttgttaaatgaatctgcaaaaaaaaaaaaattacaaaaaggtacctaagggtccgggtgactatatgcttccatcaagactagtgaagaatggttgttttttccattcatccctacatttctttttttaataatgataaacatgcaacttttttgtagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataagtttagcattacagaagatgtttattaatgcctgttatttgaaacattaatctgcttgcaatttatttaaggtattttgtagatatctaatatctaataagcatctaattaatgcatatcaaagctaagattttgcctttaggaaagttttctttcctaataaaatagtttatttgacaactattctttttattaggatcattcatatatttgctaagcaaagagtaaatttattttccttaagattcaatttgaatatactaagaatattaaagcaagttagataaattacccaatatatttgtcaatttgaaatttgatagacattagttgtttaattcaatgggcagttttgagctgcagtttatacacacatgcataacagagtcacctttcaattatccatgttaataggaaagtggttatagattttagtacacacattaaaatatggatactcttctcttttgataaatctcatttcaaataaaaaaaccagtctcataattatgtatctgtatctattacatcattgaatttagtaaataatgtttaatatgtataaggaaaaacaatgttattgacatgaagattatactcacatatttggcttgaaaatatctataaaaataatttctgttgcaaagtaagaaatgttcttcagaatgttattaatccctgtgttaaaagagaaattggaagatgctcactttagctcctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgctcaagtctaggaaaccacagtttgcatattcattcattcattcatccattcattcatccattcagcaagaattcattcatattctactttatgaccattgaatacaaatctttttctgcttggcggtttttgtaagtctacataatttctctctagatttgattctcaaacacaattctactttttgaaatcctggatcacttattttcagattaaaataaatggaaaacaccaattatttaaaaaaaataatggtcatgttttgaagttaaatacctaagaggaattgtagttgcaaattacactgaatccttagtcacagaatctggatttgacatagccttgccgtttactattctctttactttttaactaacaattcacttcctctttatgtaggtttcaatataatgaaacctacctcataggtttcattacatatgtaagtgatgtagttattaaactaaatgagatgacatatgtgaaaggccttggtaaagtactatacaaagtaacatgctagtattatttcagccagatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaaggtttattttggtttcaattgatacataataagtgtacatatttatggggtacggtgtgatgttttgttacatatatacattgtataattatcaaagggtaattatcatatccatcacctgaaacacttgtcatttatttgtgctgagaacattcaatcctcttttctagctattttgaagtatacaatacattattattgactatagccaagctactttgcaatagaatactagaatttattcctcctagctaactgtaactttgtacccattgactaacctcccctcatccaccttcccactctcccagccgctggtaatcactattctactctctacttctatgaggtcaacttttctagattccacatatgagtgagatcatgcagtactcttccttctgtgcttggcttatttaacttaacatcctctaggttcgcctatgttgtcaaaaataccaagagaaaacatgcacaaactatacatctaagaaggaattaaaatccagaatacataaggaactcaaacaacttaatatcaaaaaaaaaagaaaaaaaaagacaactcaaataatccaatttaaaatgggcacaaatctgaatagacatttctcaaaagaagacatgcaaatggccaacaggtatacagaaaaatgctcaacatcactaatcaccaggaaaatgcaaatcacaaccacaatgagatatcatcccacccaagctaaaatggcttttatcaaagagacaaaaaataacagacacaggccaggattcggggaaagaaggacactcgtacactggtgagaactgtaaattagtacagccactatgaaaaactgtatggagacttctcaaaaaaacaaaaatagaactaccatattatttagcaatcccactgctgagcatataaccaaaagaaagcaaatcaatatgtggaagagatatctgaacttcaatgtttatggcagcactattcacaatagccaagatgtgcaataaatgtaaatgtccctcatgatgaatagataaagaaaatgtggtatatacacacaatggagtactatttgaccataaaaagaaattaaatcctgtcatttgcagcaacatggatggaactggaggtcattatattaagtgaaataagacaggcacaaaaagacaaatatcgcatgttctcacccatatgtggtagctagaaaagtggatcacatagagatagactgtaaattggtggttctacaagaggctggggagggtgagggtaaggggcagatgaagaaaagttgattaatgggtacaaatatacagttaggtagaagaaataggatctagcatttgacagtacagtagggtaactatcaataatttactgtatatacatttgttaaaaaccctaaaagacaagaattcaagtgttcccaacataaagcaaagataaatgtttgaggaaatggatatctcagttatgctcattggatcattacacactatatgcacacacaaaaacatcatatgtgcccccaaaatacagacaactattgcatatcaattttttaaataatcaataaatttaaaaggaaactataaagatattagataaatacatgagtgagtaacttcacagtctgggtgtggagaaacctcttctaatgatgagaagacaatgccatgccatagtccttgtagatatcattagtcaggtgcagcagccccttaggctcccagcatacttgctgcagtgggcacttcctcacactcacctgcaggtgatggctggattgatggtgttgttcccacatgcttggcaaggggcttggcactgtgctcaaatccaagggcatgaccaagttactcctggaatcacttatttgaatagtggtactatttaacaactattccctgcatcacttctctattagtcagggttcattcagaagacagaaaagagaccagtcatttgaacagggaaaatttaatttaaaga

SEQ ID NO: 11834 - DNA, 46368 bp, Human
taaaaaatgaaagaatgagctggtcttaaactctgtatcaaaattcgtagaaaataatctgagtgtgtctttttgaatgaactaatcagaagatgacgaaatacagttgaataaaagggatacagaagtataaatacagtgtattatcttaaagaaaaatgaaaactgtatcaatatgctaatgtgttacctacctcttttgagttccggggttctgagtagtttttaaactttttcacactcatttggagtatcatttccaaataatttgccatagaactaaaatacatttttaaattaacttgcacagtaaactaggaattcagccaaagggaactgaaaatttagatttatagtaatcaggaagttgatccttgaacaagatagagttggctcttggacaggaaagctatctccttgaccatatggatttccactggccttacagaaatacttgtgctttgatctggcataggtatctttttccaactagctggactctattttctgaacctaacacccaaggattttcagtatagatagaaaatctgactaaacatgtaactacctaaattggtttactgaaattttgatagactctgcccatgtagataatccttggctactgagttgataatgaagttttaaatcacttatctgcgggaccctggacacagggctgtctttaaactcttccactgagttccaatggcctcattagtttcattgaccttcacagatattataaatttggaaagccagtgggagaacgtggcaataactagaataagagtaataggtgacattaatccatgttactatgtgatggatgttaccatgagccctgcacccagattaccttaattaacctcatagcaatgttgtgtcaaatgtactgagttatcaccacattgcatatgaggaaaatgaaacttagaggggtaaaataaatttcccaaggttacacagctatgaaagctgagtagggatttgattttagagcatgtgtaacaacctgtacctgaccatttcctgaaaatagggctactgcaaaaaccaggagtggaactcatctaattccaatgaatgatctacctatgactctctagacaagtcacagaatttacccagtgctcagttcactcttctgtaaaatgaagatgttggatttcatgtcctacagggcctctctgagctctcaaattacatgcccataaaatatactagttgtaaactattagtagaaggagctttaaaatcactgtagggagtccaagatttgccactaactttttatgattggcagtggtgagccatttaacctctccagttatttgcctcacttcaaaggttatttttcatatatatgtcagtgcttcacaaagtgcaatacagcatagaaatacaaagtactatgccatcatctaaaataagattacttcatagcatcagaattatggatttaaaatattatgttgaattggcttctcactctttttccccttttacttagaacatctggtctgcaatattttaaggtaatgcttatttgtagtagatttaaacaaagagaggaagagaggtaaagacagagtttccgattttccacttacatatgagaaaggtggggtgtccaaagaagacacacagccctatacagggggagaaggtgtgcgttactaacatattaagtaaactttagtgaggaacagcagtggaaaataatctatataccttggctcttttgcagtttgacaaagttaatgattaaaatctcctagattttccactacagtatccccagggtgtctatttaccttgattgatattattttatctcttttgggccaaagataacagccccttgcttctgtgtttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggtaagatttcttttgttgtgaccatttacaggaattcttactagtttaattttatattatcacttaaaaaatgaaataaaaagtaagaaacagaagaactggtgaatatgttggggagagggataaggaccagagaggcattaatcagagctccacgatgccatgtaatgttgaattggaattgacaaaaaaaatcaacacaagaatcttgttaaagaaagtaaatggaatgatataatttgtcaattatctcttcctcctttgttgataagcaagacctagagagaataatttaaaattagacatttgctaattgttacaagataatgcaaataaagactgtgatccaccattaagcatttattcagacttcaaatatttattaccattgagtgtaatataccatgccaatgatgcatgatgtcaacttagagatttctttgatccccttagaggaatcttatacatgcagtatttgaaaatgcattgtatttttaaaaatatccctcacataaaatttttctatagctatgaaacataaccacaaataagataattcagttatatttttcattgaaattattcttcagatggtgtgttcatctttgggcaatgtttaaaaatttttttacatgataaagactgagattatgggaagtatacaactttatgaattctacagctgggaaacttttcatcattagcttcaatttacttttctggctgattctttaatgttcacaagggacatctgcatttatcctgctttgtaaaattaaggttttcatttagtgctgtcagttaacagcctcacctaattcgtacattattattcataatagtaatgtgttttgccagtggaataaaatgtgtgttcccaagaattatcagttattaactgtaacatgaataaccttactcttgactttttattcttcttcttacatttacttttccttggtcttatttcatcattcaaattattttaactcgtcttacccatcaattcttaagtaagctatgcgtccttaggtaagactacaaagtctttcccagacagcatagggtataaaaaagcaacataaattgtgtcccttataagacctctgaataggccatgttccaagaaatccctttaagtcttattcttttggccaaggatttgctggggcagatctgatcctgaaaaatcctactgaagcaggttcagatcagggtcttcaaacacagaaggtccaataatggctaggaattggaattatatatggaggccataagcaggagcatgaatcaccatcttagactgctgactcaataggtgcacattggcttcacctcaaagaatgaaagtgtcctttggagaataacagagcattctgcaatctatatttcaacattctcagcagtcctcagattctgatgaaatggatgctaaaaacctccagtcagtcccctagaagatctaaacttcattcttataacccatgtgccatatgccagatgatatcttgagacatacataatacacttgtaagcattaactttcaatatttggggagagtagtcctgatctatcaattctctattctctaatacctgagcatgacccaaagaccaagtcagcagtttacttagaagctagctgtgttcttcctggcaggaagttacaaagtgtacagattaagggagttctgagaactcttaggttctgagtagccttgtattgtgggggattggtttgaattgcagttttctctgcctgttatagttctagagagctgaccacccacagcatttatttaagcacctgtttcaaaatatattacactcaagacttaccttgaaaagaagtttctgtggccaaatatatttaagaaatgagccataatttattccttcttggtggtttcacaattcatgcctttgtcgtcctaaaggttctgagaaacactacaggaaagaaatcttatctaactcagagtatctaaacatattgacccttttctacaatgtctatacctgtggaactattctttggaaaccttgggtctaaaatggatactgttacagatgaccctttactggacaggttccaattaagccagccctctcctatcaaacagcattgggaatcttgttcccaagccactgggtacatcttggagaagagagcttaccaaatctgctaaatctggttagtaccataagaaaatgtccacttttgctaccctatgaaaagcaacaaggcagtatttcccagttgcctacaagtagcttcttcccctaggactgaaatggatgaaatactaatatacaatatatctttccctcttcccttccaaagaaaccaagtaacaaagactggtgatacagctataaaatttttttttaacttgcagatagaaaagttaccttaatgaccaggaaacatttataaaaattgattttttaaaattaaactacagcaaaaaaattctcagttttaagttacacactgttaacagagcactaaaaatattttttttgcatttttttcttttcttttttttcgattcaagttttcttttttattattgttatactttaagttctagggtacatgtgcacaatgtgcaggtttgatacatatgtatacatgtgccatgttggtttgctgacacccattaactcgtcatttacattaggtatttctcctaatgctatccctccccctgctccccaccccatgacaggccccaggctatgatgttccccaccctgtgaccaagtgttctcattgttcaactcccaactatgagtgagaacatgtggtgtgtggttttctgtccttgtgatagtttgctcagaatgatggtttccagcttcacccatgtccctgcaaaagacatgaactcatccttttttatggctgcatagtattccatggtgtatatgtgccacattttttaaatctggtctatcattgatggacatttgggttggttccaagtctttgctattgtgaatagtgccacaataaacatacatgtgcatgtgtctttatagcagcatgatttaaaatcctttgggtatatacccagtaatgagatggctgagtcaaatggtatttccagttctagatccttgaggaatagtcacactgtcttccgcaatggttgaactagtttacagtcccaccaacagtgtagaagtgttcctgtgtctccacatcctctccagcacctgttgtttcctgactttttaatgattgccattctaactggtgtgagatggtatctcattgtggttttgatttgcattcctctgatgaccagtgatgatgagcatttttttcatgtgttttttggctgcataaatgtcttcttttgagaagtgtctgttcatatcctttgcccactttttgatggggttgtttgtttttttcttataaatttgtttaagttctttgtagatgctggatattagccctttgtcagatgggtacattgcaaaaagtttctcccattctgtaggttgctgttcactctgatggtagtttcttttgctgtgcagaagctttttagtttaattagatcccatttgtcaattttggcttttgttgcctttgcttttggtgttttagacatgaagtccttgtccacacctatgtcctgaatggtattgcctaggttttcttctagggtttttatggttttaggtctaacatttaagcctttaatccatcttgaattaatttttgtataaggtgtaaggaagagatccagtttcagctttctacatatggctagccagttttcccagcaccatttattaaatagggaatcctttctccatttcttgtttttgtcaggtttgtcaaagatcagagggtcgtgacacagctacaaaattattaaggtaatcatgccaacaggaaataaaccactgcagttgataagagctgttggcaaaaagaggtttttattatgaacattttcctttttgctttaagcatttcattcacagcatttttttttattaaacatgatataaaactgcaagaagaaagttccctttgggttggtgggtgagctacacttttccttctcttccttccctgtcaaaacagccctacgcaagggctgaagtcatacagctctcatcactgagagcaatgttaacctccctgaaaatcaatagcaatgtttcatcttactgatatcaggtgcaatgccacatatgcagtcaccaatatgtaatataaggagaagtgtgcacactctgtaaaacaccaccagcttaatctatttaggacaggagaaaatgaagaaacctctaaaaggaattgatgatgcccttccccagtatttttggtcacctaacttcttcattctacccattgcttcttctctctctctcctatttttctcattcattctgatctgaccacactggcctccacattatctcacactctaagtcctttgcaccccagggctttgcattagttcttctctattcctagaacattgattgtccagatattctcatagctcccttcctcaccttcttcaggcatctactccaagtccatttatagagggggcttccctagccaacctaccacaaataacacctaccagtccattatcttctatccccttatttggatttattttttcttcttagcacctagtaccttaccttatcactggttgttcatttgcttattgtaataaatatagaatgcaagccttgtgaaattaagaacttttgttatttcctgtaattcccagtaatagaacattacttggcatttagtaggtgttcaaaaaattattgtgtaatattacaaaattgggtttttgtatatgtatgtctaccatcagactcaggttccttaaagattggtggctttagagttttctttcatatgatgccatgctcccaggagatagctgatgtgtctgtgtgtgtttttgtgtgtgtgtataaataggtatgtacataaatatatacactcatatgtataaaaatgatcatgaactggatttagctaataataataataataataataataataataataacaataactgacggcaatattctgtttcctgaggatacaatcttcattttacaaatgagaaaactgaggaagaacagagaggataagcaacttgccagcggtctcactatcacctagggtagcaggaattcaaatccaggtggtctgtatccaaagcctctatcttaaatcatgataaaatacatcctcatatggatgttttctttggccctcatggtttgggccaacaaagtttctttaagtctgtctttaaagtctcatttcacttgtcaacattttaaaacctggagattccacaaaaaaatctagatttctagcttctctggaaacacaggaatgtgtggtaataagggccaaattttcacatggcaatgatgaactggagctgaattgtcactcctccttttggactaaaccctcagttttcaccactgagcatttaatgctttcttcccttggatcaaatgtaagttgtgtggttcctagatcctatgagcatttgggtttgctaacctgggtgtcatggtaaaatagtaacttgaggtttaacactacctaaagaaaataatattaacaaataattgtatctttacatttaaaataggcaaaataattagttaccagtcatttttattctctataaatgaaatcacatatgaattgtttaaatatgtttacatttaacaaattgtgtttttcatcttagagaagtgaaacttacataacttttttttgaaagctgatttagaaagatttattggaatatacaaggagtgttatgtagttatacatgtctttcacattcatatctgctgatgcagctgaattcctatgtgggttttattttgtttttttatatatatatataaactttaagttctggaatacatgtgcagaacctgcaggtttgttacataggtatacatgttccatggtggtttgctgcacccatcaacccaccatctacagtaggtgtttctcctaatgctattcctcccctagccctcaacccccgacaggccccagtgtgtgatgttcccctccctgtgtccatgtgttctcactgttcgactcccatttatgagtgaaaatatttttatatggaaataactgtgatttttttatctattaaaaaatacaatagcaagagcacagtcttagaataaccatttcagtcttcaaattttactacacgaaagtaaatttgttattttgatattatcagttctgctgcaaatgttaggtaataattggttttaaaatgaaaatacttttatttgacaattgcatactagattttaaaaaatataaataacaaaatacatggttggattgttgactaggctaacattgaagtgagtgttccttttaagttttcttagcaaatatatctaaggaattatatcctggtggcaattggaatgtaatatctagtatatatcctatagaaaacattggcattccattttccatctacatgatactgcaaagctcattattaatttatttgtttaaaaggctctctttagccttactaagacaaatgaagtgctataaaagcacttaaagcaatgtatatcacaatggttaacacaaaatagcattgagtacttgatagtgaaatttcccatttaaattacagttcttacaattgtccaataataagccttcagtttcttactgggatttaataagaaaattagaaaattatattccattcatgaaaaaaaaattcttgctaacacatcactatagcagacaagcaccataaaactcttttggccatactaaaaattaatatataaatatctactttttataattttaaaaagataaattactaatctttgaaatagaaattttcctatacaagataatgcaatctgttggacttcaaatgcatttaaatggctcggggatctgtttgacaaaaacatgtgtgatgatagagacataaataatgatacacatccaatatatcctctccattagattgcataatttgatttcggtttatacagtataacttcagtagtcattaagacgtgtattttgttaggaaacagtgaaagaaaatcacccatgtacagtgttttctggtttaaaatgtactgttttttaattggcaaattataattatatacatttctggggcacaatggaatagtttgatatctatatataatggggaatgataaaatcatcaatgaactcctctaccatctcactgcttatcattttttctgaggcatttgaaatttactcaagttattttgaaatataaaatacatgattaactatagtcaccctgacgcaaaatagatctcaaaacattcctcctgtctaactgaaattttgcactattttcccagcagctcctcattccctccctcctcttctccctgcagcctctagtagccatcattttactcttctgtgagttcaactttttcagattccatatatgatataatgcagtatttttctttctgtacctggcttattttacttaacataatgttctccagggtcatccatgttgtcacaaatgacagaattcccctccttctctttttaaggctgaatagtattcaactgtgtaaatacatcacattttctttatccattaatctgttgatggacacttaggttgtttcagcatctcggtagctgtgaataatgctacagtaaacatgggagggcagacatcccttcaacctgttaatttatatttctttggatatatacccagaagtggtattgttaaatcatatggtagttctatttttagtttcttgagaaacatccatactgttttccataatggctgtactaatgtatatttccaccaacagtggaaaagagttcccttttctccacatttttgccaatgcttatctttcaatctttctggcaatagccattctaacaggtgtgaggtgatatctcattgtggttttaatttgcatctccttaatgattcctgatgctgaacattttttataaacctgttggccatttgtatgttttcttctgagaaatgtctgtttgggttctttgctaatgttttaaatcggttattggttttcttgttattgagttgtttgagttccttacatattttgtatattaacctgttatcagatatgtggtttgcaaatattttctcccagtctgtgggttgtctcttcactttgttaatttttcttttgctgtgcagtagccttttagtatgatgcaatcccatttgtctattttttgcttttgttgcctgtaatttcagcgtcatgtccaaaaaactcattgcctagaccaacatcatggagcttttcccctatgttttcttgtattagtttaacagcttcaggtcttacatttaagcctttaatccattttgagttgatattttctcaagttttaattgagatagatcatacatggctagccagggaggcagaatcaccaccacttactgtttatatcaccttatcaaaggagtgccatgtggaactatgactgtgccagcccttgttgaatgatactttcttcagattttataatacttgcttaatgaagtgacttttatgggaatgtccagaattgtgccaggcatccaggacctaaaaatttagacatgatctttgccctgaaagaaccttcatggaaaataaagacaattttgcttaaaggcaatattagtatatgctgcctttataagatctattagcaaacgtctagtgagtattacttcaagtctctgtcactactaagaccaaagcgcctgagtctttcaaccaatctgctcacctttctattttcctgtgccaaaccctgcaaactttttcatttaaaaaaaaaaaaaaaagggccggggaagaaaatgaagaataagaatgacttttttccaggactgatagtcaaagataaagatttttaaacaggcatgaataataatgaatctttcgataccataaaaagaatatcactaaatttcaatagagtaattctctaactcatggacaaaatgtactcaaaaagttatatgttatttagaagttaaagtacaatttttcatagaaataatttaaatatgagatgaagttcttaaaatgatgcataaaaataggtagtaaacatgggatgtaaactgtgataaccacaaacctcataaaatttttgtgaagattaaagcaagtaatacatgtcaaatatttagaacagtaccaccaaattgttggcactcaaattttaattgttatcatgatattattattatttatatttatattgctgtagaatctaagtgcttcaatgtgttctaagcgtccaaattaaatgcaggggatatcacctttacccatcccaaaagtggaagaggcaaacctcccccctctatctttacccctacaaaagcaattacagatgaggaggtaaccaacccacaaaaggaaagagaggtgggatgagatgcatggagaaaaaatgcttcctctggaactttggtaagtgtcacaaaggacaggctaccacccgaggtgaacccaaggacattagtttgagtgagtctgtgatgctgtctcctattgcagttgcagtttctgagtaattaacccattgactatatatcttttgctgttttcgtttgtgtttgaattttcaaagtctgaaaggacgctcaatttgttgcactgatatcatcctaagaggtacagttaacttctagattagtttatctatagatgtcatgtgggtctctgggtttagtattaaaagggttgaatttcttttcattgactcaagctcaaactttttcattggcaatatttttagtgatacagaaatctcttataaccagatcagcttcctaaaccagctcaataatgtttactatttaagtcaattcactactgtgaaatgaacaatatcatgcctgactagtttgaataaacactgcaaaccatattcttaaaaggtaaatttatttaaaaaaatactaacaaatatactgagcttttctgacatggatgagtctgtcagtacagaatagaaataaaaatgccaaagaaatgaaattgtgaaaatataaaatgcccaacagagctgttaaagcccatgattctccagaacacaataggaaaacagcaacttgagatagttcctagcatcctgtacgagcacttatttatgtcaatgatatttaggatccattaatgtacttggtatacgaataactgttctagggagccaaattaggttttagtgaaagactagtaatagtgaaggcatccaaatacctactttaataaactttgtaacaaagcagtatcttattagctatccccattacaacgaaagttacatgagggcaaggatgtgtctattttgggttccattgtaagttcaaattcaatattgaacccaatgcctggcacaaagtaagcctcaaaaaatatctgttacatgtatgaatgaatattgtcaactctgttggcagaggtaaggtgcctgaagcagcaaagatttcctgaaaataaatcacactggctttcaaaagttcagaattaaacaagacttaccagaatgtttcacaatatagataaaaagtgaaacatgctattgcagaaagcaaaaattctgttagtgaaatttgtaaacacttagtactgtggggggtcacttcatgtgaaagtgatttcatcagagtcactaagattatgccaatatttactagggccatatcaaagtccaaatcaccttctttataaccgaatggtacatttgaaaacagagcgtataattttacagttcatttgagacaggaattaactatatgaattggagtgagctcaactggttttacaccaaaaacatttattaagcagtattccatggaatggggaatcaattagtaataatcacattgcaaattaactttagtatttatttgctgtatttgaaaattgagacaatgattgacatacattggctttgtcttgtaagctagatatcttctctttgggcaaatgaatttataaaattattttatcagaagtacattttgggtagctcacctgaaagatcatggtgcaacagcttcctctacaggttatttttatattttaattctgagctttctcaatatccctcttgagcttcctcccttgcttcctgttatgcccaaggctgaatgttccagcaaaaatagtttcaaaacctctttaagccttattcattccatctagtttcccacttttctctcatcagtttgcattctaactaaagcagtatataatgcccatgaattctaaagtgctgtgtgcaaacacaaatagttaaataaattcaaactatttaatgggataacatgcagtgcccagttacactaccttcacatgcacactcacattcccataatatatgaaatgaaactttacatttttagtgaaatgagaaatcagaatctggaaggttagaaacaaaatatttctcaaaatgttcatcgggggtaccccatttgaatacaggatttcactttgcatgttattgaatggtcacaagagaagtactaataaaaataaactcttccattttgtaggggggaatttaaacaaacttagctcctatttattataaggaaaagaagttcttattagggctattttgtgtatgtcttaaaatacagtaagccttgggaaaaaatattccttataatctctcgctatttttaaaagagactagattataatccccagcaagtgatcttatagatgatgaggatacattgtactaaattcagggatctttacaatatatggttatttaaatctattttgatatttacaatgataaaacaaactcacctcttcaaaaggctgctttcatttcagttataaaatagacacagttggaataaagatttcttactagaatctactgccatgtaactgccagacatttctcctagctctgctttaggagcaaactaaaaacaactcttgacatcgtaagtacagctcatcaccacatgaggacagttctagccctaattattcttctctgtgttctagtcttcaattccataaaataccattaatgattaatggaagttttctgccttgcttaaccttttgaacgtgtcacaatatccagccttgtaaactaatcaatacatttcagaaaatgtacaagatgtgaaggttctcagacattacagaggtttgttgcaagtggtttttttggttccactaacaattagctttatcaactctactgccttgtcctagttgccagaataacatcagattcaggattcaggtatgtgggttattttccaccttctgtgtggttttgagggtgtttgagtaggtctcttgttaaaaagtgctgctgaagaatgtctttttctcacaattatcaaatccgacttttctcacctcaaaaatattttgggggggtatccatccaaaaaagtacatgctgcgactgcttcctctacaggcaatctgacattaaacaggtgacattaatctgatgagccctaaagagaatctttaaaaaaaaaaatacaaccctttcaagtctgtatctaatcaccaccacctccactgcaagccatcaaatagaaatttccacccaggcatatgtttacactgtcttccataaaattgtaactgttagagaggagaggaaatctttgggattaaagcctgacagcagttaccatcatatcacctgagatgactttcccaacccttaaagtgagaaggataaaccactaaaagttaaagccacttaaaacagagtaagcaatttatatacttcctacatttttttccaaagatataacatcacaggagggaaatttcctgggcttatttgcataaatgatgagtcaggttaggagaacactgactgactttgatgtgtccgccctattacatatgtgatggacatgttgaacaagggggtctcatgattagtaactagctcttccctgtagcgtgaatgaactcaagagcaggtactgtgatttttctgttccctctcaaataccaatgtcatttcatcatgagaatggctagttacatttaatagtcaaaaatgttttaattcattgaaagttgaagctactaccccattcaggcctgtttcagttctattgcctgtggtgggaaaggaagacacagatacctgcctcttgtctcctttgcctgttctcttttcctccttcctcctacgctctaggctgcttctacctcctccagggctaacacaggaaaggagaagctagtaagagagatagcagcaggaaaaactcaactcaatgggcaaaaaattcaatggacagcatggtgagccaaggttgtctcctctggttaccaagatgtgtaaagctgccgttttctcttactgtgttcttctgtgatctctctcccttgttattcctggagatctctcatatgcagctggcaccttaagactctcctctgggcccctggttttcaaattgtctacctccacacagagacccaactgttggcagtccactgctctgtagatagcactttgttgggggtagagctgggactgggggaaatatatttaagacaactcctagccagctcgctctcttgcttgagctacatcaggtctgcaggtcacatgacaacttcccacccagtcctctgctttgttctccaggccacttagcaagcccatcaccctctagatttctccagcctgaatcagacacctgtccattacaccccaaattccaagagctccctgtcaagcgctgagtggtttcttgaagcccttgtcactatgtgaaagtgaaaggaaacacttcccaccatcccccagactcaccacactttgtctaaaatattctttgcctgatttccaccttgtccccagctgaattcctagccttcccttagacagccaggagccaagtagcagagcatgggtggcagcactaactctcctgtacctcctttaaagtcctgcattagtggcaccagcccctcaccttggagtggagacagtctccaattatttgtagttctgtttttcttttcaggccttaggtaaaactgagacaataaaagaaggaagggaggaagcagggtgggaaggagggagggaaggagaaaaattctcattttggtatcattataaagataggacctaatagttgccatatcaatagcttctgactcactagttgacatgtatcatttgactcacttacgttcagtattagtttactctctccttttgttctgctggtgactaaaatataacagaatgtcataaaattgtggcctgttatgagagaagagctagaaaggcccccaaaatatgaaattgcatatagacattgagaaaatacgactttcattgtaggccacgtggaagatcactttatacatgtacatgtaacataatattcatcaaaaggggacacatacaaatttttctatttctgcctcctaggccgggattatgaaaagaataaagtctgcaaggaattctcccatctgggaaaggaggacttcacatctctgtaagtgtgcagcagccactcactctgttggtgatttgatcttgaacaaaactgagtgtgaggtaactttgattcagcatggaggttaatccttaatccttgccaagagtaagaggacagagccccaggcccaaggtaggcacaggagtcaagcaaattaaggacatccagagattccagatgacctctgattaccacagtctaagaatttgtcaccagtaagtttatgaatgagttcaaagataatacgtaaagcatagctttctaaggtcattaaaatgcaattgtacattctaggaatctgggaaaccaaggcaatgaggtacagagcaagtacatttggggaggcttaagaaggacaacaccagattggtttgatggaagccctaagttcaatttctactgctttccaagataaatttgcctagaacaaaaactgctttttaaattaaacctcatttttttcattagccaaataaagaagtaaatgtgtacaatatttcatttaaacattgaacaggtttcatattttaatgtgccaaaatgtaaaaagaaagtttcagttctggtcgggcacggcggctcacgcctgtaatcccagccctttgggaggacaaggagggtggatcgcaaagtcaagagatctagaccatcctggccaacatggtgaaaccctgtctctactaaaaatacaaaaattagccgggcgtattggtgcacacctgtagtcccagctactcgggaggctgaggcagaattgcttgaacctgggaggcagagagtgcagtgagctgagatcacaccactgcactccagcctgggtaacagagcgagactccgtctcaaaaaaaaaaacctttcagttctaattgatatattgtcttattttcccctcaggtcactagtcctgtacagtagaaaatttcccagtggcacgtttgaacaggtcagccaacttgtgaaggaagttgtctccttgaccgaagcctgctgtgcggaaggggctgaccctgactgctatgacaccagggtaggtttctgtggctggccgtctctgtggcagcccagagaaggaagccaaaataggcctttataccacgtgttgaaaaaattttagacagcaactccatttactcctagtttgggggaaatatgaagcctgttgtgtttacagcctggtttattctaacataatgagtcaatattacccattattcctacaaggttcaaatgagaaaactgggtcatagagtaatttagtgatttattaaatgtacattgctagcaagaaggagttataaaatataaatccagatatgactctaaaacctaagtttttatcaccatacatttgatcttctcaaatatcagcccatggatcattattctaagtgaagtaactcaggaatgaaaacccaaatatcgtatgttctcacttataagtgggagctaagctatgaggatttaaaggcataagaaggatataatggactttgggaacttggagagaagggtgaagggggtgagggataaaaaactatacattaggtacactgtacacggctccggtgataggtacaccaaaatctcagaaatcacccctaaagaacttagccatgtaaccaaaaacaaaatagttttgttcccccaaaactattgaaattaaatatatatgtatatatacattttatatattatataatttaatatatatatatatatcagctcatgaacctcttgaaagaattctaaaatattgtgtatagcttaaaaacctgatcatagctttatcctcttttatcatcatgccaggactggtaccaagtgctccagaataatttagtgttggtttcaaatttggaaggaggattcaaaagttgccctgtatgcacataactgaattctaggtttctcccctatagcacttatgcaaaaattaaaatgctgacatgttcagacagtagctgaaaagggttaaatctaaggagtttcagcaatttattaatgcagtcgtcaggcctgatgcaaatgacatttagatgcattttgataaaggcttttacagacagatttgtctcactgttcaagccttcagcagatatcatacagaaacaatgctccaaagatctgattagaatagattctacacaatgaatattcttacccattaattgctttacctgtcccttatctattttttcagaattttataatccttttcttccaccaagttcataaatattttttattttaacctgaacttctgtaccaccttaaaataagaaagcgtcaaatcatcaacatgacagagcacatttttattttatttcatatatttgctaatacatcccttgatcagagatatgatctgtctctacaatcctggagcataagaaaacagatacggcattgatattttttgcatgatatatttctctttctcctgcttgttcaaaacatttttgaaaagtgttttgacattttgtcaacctttttttacttgaaagaagataactttaaaaaggcaaaaagaagggttgccagggaaatgaatggaaaggaaaaagatggactgaaaagagagataggatgaaaaagagtctaatttttaacttctccgaatctgatgaaaggatggtacggaagatggtgagaagttagtttacataagtaattcatcacgttgccattcttcactggtagaaaagatttttagaaattttaccttaaaaagatgactaacttataaattaagtataagaatgtcaaagtactgtttcccatataaatcccaaagtaattttttccatgatgactatttctattcttttttcctctatggtgactctattttagattttaatttcaaatatgaaatttttccaaaaagaacattttgatgctacgattgttttgatggtgcttagtctgctcacaggtatcagtgtatcattgttgaagcagtaaatgcaggtgcatcagtggttttcaacctacactgcacctgcacataaatcttggagcttgggaaaaacagattttcaggccctatttttgacctactgaaacagaatttctgtgttgtgcaaccaaagcattttttattttatgcactctatgagtaattctgatgcaaaagccggttcaagaatcattaggtaagagaatgcaaataatgtagaaagttaaaggaaccagcaatcaagagtctactcatttcacaaagggagggaaggagagctcatttaataaacagagggaggtcctcctcactcttattggggcatttacagcagaaagcaggtgggagatgatgacagaatcatctgtggagctttttcaaatgaccctctcatcctcagagatgttaatatccccacggaggaacactaggctagagaatacaattctaatggctctaatcagataaacactgtccatttgttattcaaagttctatttttgttctactctgaggagtcatttactaacataaataagatcctatacttgccgataatcacacaacttgtcatgttaaaaaatcacttcatggagcccttggcatgaatacatagttataaatgagaattttctaattataggctaagatattatattaaatggaagtctaaaagcctggaaatttacatatatatatgagtttcctttttccttctcctccagacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcagtgagtgccttcatcataaatagaactttaggacctaaagtatcagaaatgactctaatctaaccccctactctgtggaaacacctcttctacagcaacctgaacaaattctgataacttgactgtcatctgagacagcccatcttccctttggtgctgagttttgtgaatgcctttctcagagataaaatcaattttcccaaactcttactaaccctaatcctattatctgaaccagaatcacttgagtatcctgtccacatgatatattttcaaatatttgacagcccctgtggtgatttccctgatgctaaggatcattgcgtatgtcatatgatagaagcaattttattgctgtacacattttaaatacttaatttccagtaaagcataaaaaataaacagcttctctcttcactcctatacatcccagaaacatgtgacgtgtacgtgtaaatatgacacatctactacatcaagtaaacacgtaaccttaaaatttttatggtttaacatgcacaaggggccagattatacactgaatctttatgttagtcttggaaggtcacaaaaatgaacaaaactgggggaaaatacatttattaaagtaagaaatatatacatattcaaaaaccaggagcaatgtcattcaaagtggtcacaaattgtaaaaattagtaggattgctcattcctgtcaattttcaaagaggattttgcccagaatttcagtcccttttagatccataaggacatctattcccagaaatagaaattatttcttccaaaaaataagtaatctatacataataattatctaaagtaataaactgagatagataatgaaaaattaatctagcaattacattcattttaattaattcaattagcagcttaattaacaagcagataccatgggtgatgcacctgaccagacattaagtgaataaagggacaaatggcccctcctctcacacaaaccacatagaaatttgtaaatctatttttaatgaatgaatatactgattaatagtggccagtattataaccttttctctaaattcttagtgttttttagatattaaaactataaattaatgtaacatatatcctttgtccatcaaaatacttactaaaaagtaggttttgggggccaagcatggtggctcacatctgtaatcctagcactttgagaggctgaggtcggaggatcacttgagcccaggagttcaagaccaacctgggacaattagtgagacctaatttatacaagaaattaaaaaattagatgagcatggtggcatgcacctgtagtcccagctactcaggaagctgaagcaggaggatcgcttgaggccaggaggttgagactgcagtgagctatgattataccatgtactccagcctagatgacagggcaagacactgtctcaaataaaaaagtagattttgtttattcacaaattttttgaccaattctattttttcctccacagatttatgtgggaatattccactaattacggacaagctcctctgtcacttttagtcagttacaccaagagttatctttctatggtagggtcctgctgtacctctgcaagcccaactgtatgctttttgaaagaggtatgtcccattttacttattatatgtttacgtttttttcttctaatagcattccttttagataatggtagaaattgagattttgcaatcagtaaaagtttctaaaatgccacccttgcatcttcttaattggaaaataaatgtaatacctctggaaaagtaatatcaataagttcctttcaccagtgttcagtttcctattcattaaaaaatcatgaaattaatagtccctatttttgccatttatacagtattcaatgagtcttgaccatataatgagattctttcacttgttttctagagactccagcttaaacatttatcacttctcaccactctgtcaaatagagtctgctcacaatatgctgcttatggggagaagaaatcaaggctcaggtaaagattaagtgctattgtcatatttagatgtttggttctgcactgtctatccataatattagggtttttttaagaagctgtctatattgaaagatataaaatagacttttcagctccaataatctccaaaaatctggccaaattctcgttttcttttctctatacagattatgaaaaataaggaaaaagtttatgtcataaaacatgagatttgcttttaatcaatcttttccatatagttgaccactagaaaatattttttcagtgttcatattagcatatgttacaaacaaaaaagcaaaacaagaacaaaaacaaaccaaaaaaacacaaccttttgtttattacctattatttgccttgcccaatttttcttggaatgagacatctgaattcttacttgttgtatgaagacttgtgctatacagtatatatctcttgcccttcattaatttattctcattagttatctacctttgtattagtctattttcactccgctgataaagacatacccgaaactggggaatttacaaaagcaagaggtttaattggactaacagttccacatggctggggaggcctcacaatcatggtggaaggcaaggaggagcaagtcacatcttacgtggatggcagcaggcaaagagagagcttgtgcagagaaactcctgtttttaaaacgatcagatctcatgaaactcattcactatcatgagaacagcacaggaaagacccaccccaataatttaatcaccttccactggtttcttcctatgacatgtggaaattgtgggagttataattcaagatgagatttgtgtggggacacagccaaaccatatcatcccacccctggcacttcccaaatctcatgtcctcacatttcaaaactaattatgccttcccaacagtcccccaaagtcttaactcacttcagcattaactcaaaagtccacagtacaatgtctcatccaagacaaggcaagtcccttctgcctatgagcctgtaaaatcaaaagcaagctagttacttcctagatacaatgggggtacaggcattgggtaaatgcagccattaaaaatgggaaaaattggccaaaacaaaggggctacaggccccatgcaagttcaaaatccagtggggcagtcaaatcttaaaggtccaaaatgatcgcctttgactccatgtctcatatccagctcacgttgctgcaacaggcatattcccatggtcttgggcagctccacctctgtggctttgcagggtacagcctccctcccagctgctttcaaaggctgtcattgagcatctgtggcttttgcaggtgcacagtgcaagctgtcagtagatctaccattctggggtctggagaacggtggccctcttctcatagctccataaggcagtgccccagtagggactctatttggaggttccacacccacatttcccttctgcactgccatagcagaggttctccatgagagccctgcccctgcagcaaacctctgcctggacatccaagtgtttccatacatcctctgaaatctaggtggaagttcccaaaacccaattcttgacttctgtgcatccgcaggctcaacaccacatgaaagctgtcaaggcttgaggcttacactctctgaagccatgccccaagctctacattggcccctttcagccatggttggagcagctggaatgcagggcaccaaatacctagactgcacacagcacgggaaccctgagcctggtccaagaaaccactttttcctcctaggtctccaggcctgtgatgggatgggctgctgtgaagacttctgacatgtcttggatacattttcccccattgtattggggattaacattcagctccttgttacttatgcaaatttctatagccagcttgaatttctcctcagaaaaagggcttttcttttctctcacattgtctggctgcaaattttctgaacttttatgctctgcttcccttttgaaactgaatgcctttaacagcactcaattcacctcttgaatgctttgctgcttagaaattccttctgccagatatcctaaattattttcctcaagttcaaagttccacagatcttcagggccggggcaaaatgtcaccagtctctttgctaatacataacaagagtcacctttgctccagttcccaaaaagctcctcatttccatctgagaccaccttagcctggaccttattgtccatatcgctattagcattttgggcaaagccattcaacaagtctctaggaagtttcaaactttcccacattttcctgtcttcttctgagccctccaaactgttccaacctctgcctgttacccagttccaaagtcacttccacattttcgggtatcttttcagcagcaccgcactcctggtacaaatttactgtattaatctgttttcatgctgctgataaagacatacctgagactgggcaatttacaaagaaagaggtttaattggactcacagtttcacatggctagggaggcctcacaatcatggtggaaggcaaggaggagcaaatcatatcttacatggatggtcgcaggcaaagagagagcttgtgcagagaaactcctgttttcaaaactatcagatcttgtgagactcattcactgtcacgggaacagctcaggaaagacccacccccatgattcaatcacctcccaccaggtttctcccaccacctgtgggaattgtgtaagttacaattgaagatgagatttgtgtggggacatagccaaaccatatcaaccttatatttgcaaccttcactttgatttttgtatgactactgttaacttgtattttaattttgatagtttctatgctgcacttctctcatactttctcaaacatctagatttgccaactttttttccctccatacttacagtctctttgattccttctactatcctcacaagtttttttcctctaatgataatcaaagaacttcttgccagcaatgcataaaaagcttccgtaatgcgaatagaaactactttcttgtccaggcacggtggctcacacctttaatcccagcactttgggaggccaaagcaggtggttcacaaggtcaggagatcgagatcatcctggctaacacgatgaaaacccgtctctactaaaaatacaaaaaaaaaaaaaaattagccaggcatggtggtgggcgcctatagtcccagctactcaggaggctgaggcaggagaatggcatgaacctgggaggcagagcttgcagtaagccaagattgcaccactgccctccagcctggggcgacagagcgagactccgtctcaaaaaaaaaaaaaaaaaactagtttctttaaatataacagttcctcagaactacttgaatactcaatgacagtttctctagtcctttctttagttttccttttacgtagagatagtagtttgacaggcagaacagagggaatttctaatataaagccaccatatatattacttatataatcattaagtgatacttgtattcatgtccagaaatgtacttcaaggaaatagcatttgctatgaacagatttagctatctgataagggtttaatattcggaatatataaggaacttctataactcaataacaaaaaaacaagtagcttaattaaaataggggtaaaagacttgaataaacaattattgaaacaaaatatactaatgtccaataaacatatgaaaagatgctcaacgtcactaaccttaagatacatgcaaatcaagtctaccgccataccactctgaacacgcccaatcttgtctgatctcagaagctaagcagggtcaggcctagttagtataataattggatgggggaaatgcaaaccataactacagtgaggtatcaccttatacccattaggataatcactatcaaaagaacagaaattggcaaatgttagcaaagttgcatagaaattggaacgcttgtacactgttggtaggaatgtaaagtggttcaatcattatggaaaacagtatggaagtccctcaaaacattaaaaatagaattaacatgtaatccatcaattccacttctgggtatatatcttaaaaattcaaagtgggatctcaaagagatttgcacttccatgttcactgcagaattattcacaataaccaagaggtggaagcaacccatatgtccatcaacagatgaatggatgaagacaatgtggtatatacatacaatggaatattatgtagcctgaaaaaaaaagaaaatcctgtcacgtgctacaaggatgaaccttgaggactttcattatgctaagtgaaatatgccagtctgaaaaggacaaatactgtacaattccaactcatacgaagtatttaaagtaatcaaaatcataaagacagaaaatagaaaggtggttgccaaggaatgggaggatgagtgaggggaagtgggagcagagcaaatcagtgtttaatgagtacagagttttagttttgcatgagaaaaatttctagagatctgttgcaaagcaatgtaaatatacttaaatactgaatgtataccttaaaaatggtcaagatagtaaatttaatgtcattttcaccacaattttttaaaataatatttaatcatattcatgatatattaggaatattaatattgaaaaaatatttaatgttattcctggtatattaagtgaaaaaggcaaatatgagaatagtatagcataccattcacacataaaatactgaaaggttacacacccaaaatgtgaacatttgttaactctgtggtgtaaagctacaggtctctatagtttctaaaagaatttataaaacacacttttacaactctgtgagaggccacaaaaatacaacattggccttatgaatagaaagagacatttgtgacttcttcattgatgctttagatctaacattttaaaggagtgctttcactatgtatatctggcaagaagagaagctgcatttgggtactgaaaatttggaaagattcattagggatctcttgatcttgagtctgtggcttgggtacataagatctatcgcatggcagatgtgctcccatgcatctcttgaggccaaggaggtgaaattgtgatattatttctccaaatagtgcgttcatcacgaaaccaagaaaactgagaatgttgataagctaacatatttatttttaactgtttagcaatctcataaagttagcccaaaaagtgcctactgctgatctggaggatgttttgccactagctgaagatattactaacatcctctccaaatgctgtgagtctgcctctgaagattgcatggccaaagaggtaagacaagctttattatcattatcaccatgtgccaggtattgagtgccaagtactgagtggcaggtactcttctaagttctatttcatatgcattatcctaacggatgcttacatgtattctatgaaatataaataattattaacatcactgtacaggtgagaaaacagaagattagtaagggtcaataatttgttaccacacaactagtaggtggcaaagtccatatgcaaagatgagattatctgatttccaagaccttatgctacttgcactgtatggtattcattaccacatatggtcatttaaatttaattatagttaaagttaaacatatatgtttaagttgaatatgatttaaaattcagttcttcagttacactaaccacatttcaaatgcacaatggtattggatagtgcaaatacagatcatcattttcattattgcgtaaagttccattaagcggcacttcaaccattatactagtagacgctactactgtttttattatactttttataatttgatgcccatctcaattttttttaccatttttcattttcataatcctttaaaactatttaaatttgaataattgctttagctgaaggtcagtctccaagatcttgtcaatctctgtagtaatagatacattgtgttgccttgtctttttccattaaaaatgcatgtctgtgttaatagatgcttttctataaggatttataatggctaaataggactctgttgcctatatccatgtcatgtattacatctatctatctagacacaccatatttttattttactaatcctctattgtatttaggttgtgttggtttttttaaaatattttaggcaatcgttgcacttaatagccttatagttgttgtcgttttatctacaattattttctgagtataaattcttaaaaatagaattgtacatttttaagacttttagtacatattgacaaactgcctttccaaatattgtaccaattttctttctgagagtcttcatactgactttcataaatgtgatgccaaagcttgtaagcctatgtaattcttatttttaattagactatcaggaaactaacaatgcacaaactaaccattcgttttgtagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtaagtagaggtgatgtgaaaacgtgttcccattttaagttcatctggacaaaaagtgggggccagccagatggagggaaggtatgctatcactcatttcaaacataggcaaagtactacctttatgcttttcatggactttaagtatttgttaattaattgtaaatgactaaaatttttaaaacaccataatcgagtgtgatagaaagattttgggtagggagaaaggagcttagagttcctaattgtgccttctctgtttcctgtgcatggccaaaagaagtgacttgataattctgaacttcagcctattgttaattaatttggaaatgttaactcttgccttacttagcacacagactgctaatgagaaatgcatgtagaaatgtaagtgaaagtaaatgtgaaaacacatatttgcatacaatgctgaacacatgtaaaatatatcatgcaaccagaaatgtttataatattattaactagttttatcatattacttctggttcaaagtcacaaatcaaaagcctaaagtatactaaacttttggacaataagcatttgatacaaataaaagagataccaagcacagaatattttttcttagcattatcaatattcattttcattaaatttaaaaagagatttaatgcaaagaaatggtaaacttttatcctgtttcatccaactaaaaaaaagtaagttaaaaatataccatggtttgaatagatgtgtatgcataatgatggcatacaaatatttcacaaatagtttgaagcagcaggttgaaatatcaattagcaatatcagatggcagaagttacataggactgaaactttacatttttctaaatgtgtattgcttttataagtgcatagacagcagtggggtaagacataatgaaggaatttacacaaaccaattttcacagaaaagccttttgaagtatccacttgatgctttatacagagtcaattgcattatgcttgcacaaagacagttccatatgcatttgaagtagatatgtttacatataatatatttaaatgtatattacatgcaaagctttaattcagtattgactagtcacaatagcaagtattaatagcttgtatctcaatgaaagtattttataatccaaagcctgttgatttagagtcagtctgagctaaatctcttctttttaattaagatgcagaaaccaggtgctctgcctttatgatagatatttcacattttaaaatgtaggccaggcacagtggctcatccatctaatcccagcactttggcaggccgagtcaggcgaatcacttgaggtcagaagttccagaccaccctagccaacatggtgaaaccctgtctccactaaaaatacaaaacttagccgggcatggtggtgggcgcctataatcccaggtactcgggaggctgaggcatgagaatcgcttgaacccaggaggcagaggttacagcgagccaagatggcaccacttcactccaacctgggtgacagagggagactctgtcacaaaaaataaataaataaataaataaataaataaataaataggaaatatataacacatatctccttttctccctcatgctaggtatacatttgaactaagcagaaggactcatcttccggaagtattcctcagtaaggtacttgagccaaccctaaaaagccttggtgaatgctgtgatgttgaagactcaactacctgttttaatgctaaggtatatttgttggattttctttatcaagcacatagatcaagggttggaaaattatagttcatgggccaaaacttgctcactgcctacttttttatggcctacaaactaagaacagaagaatggttttacatttttacattgttgggaaaaaagcaaaagaacatcagtatctcatgacccatgaaaattattcaaaattcaaatttcagtgttcatacatacattaacttccactgggacacaatcatcctcattgtttctgcaaagcttacaactgcttctgtacagagttgagtagttgcaacaaaggccacatatggcctgcaaaccctaaaattattatccggccttctgtagaaaatagttgccaatgcttaatgatacaatatttggaattttgatttaatggcttgatgggacaaggtttcaagacaaataattttgttatgcaattattgttttcttacagggccctctactaaagaaggaactatcttctttcattgacaagggacaagaactatgtgcagattattcagaaaatacatttactgagtacaagaaaaagtaagaaacttgttctggctgtatcctccaaatttatcaataatattttcatagtactatgaattgaaagcatagttgaacacttaagcttgtcttcagtgaacaacaacaaaaggaggttcaattaggagttttttaaagtagtcagaatctcatagagtggaataatagacactggagaccccaaaaggtgggagggtaggagaggggtgaaggataaggaattccctattggatacaatgtacactatttgggtgatgattatactaaaaacctagacttcaccactatgccatacatccatgtaacaaaaatgcacttgtaccccctaaatcattttatttttttaaaagtagttggaatctaacatctgtataagaagaagctaagtttttctggaggaaacatgtcatgtgtagcaagtgggtggccaattaaaacagccataaaaatatagatgacgaaatctatctgcaggaacttgagtcaaaatggcaaaatgagcacatagcttagcaacattcttaccccagaattttctgtagatattgctgtacaaaattgaggacctataaaactgctaaaaatgttatctaacttcatggcatattgcctggcaagaagacccaaactttcaatcaagcatactgtcagctatcaccagcatatattccctataaattagaaatagaaatgttaactaccaataatgttatataatagtcatttttctcaattaagagaaggaaaaagcatttctctataaatagacattaacagtaaaataataggccacaataaggtaagaagtggtactgggttcttggggaaagtctccattgagaagaccatgtcatttttcctaacgttagtaaatttctcagatcctattccctcctccccccaactttctttttttttttttgcctcctttgagtctcttcttgcctcatttgcaccccccggcagctcaaacctacttgtttcaacaatgcttttatgaactaactggtcccccttacccttttgtcccttcccagcatccactcttgccaagcccaactctagattaatttgagtctccttacctcccattgccccccgctgggctggcaagcatttcctgaagaaagtcataaaaccaggctgagttgttcatgggagtggagagacgccgagatcatcgattgtacaaattgaaagaatcaggagatatcaagtcttatcaccatcctgaaagagaaatggagagttcgtttttagtagagctaaaaataagagcgaaaatttccttactcctgtattggtgttttccaacatagtgagttgagaagtagataaattgagggtgaaattatataaattatgagaggaaaaaaaggcattaagctggtatgaggtcctgtaaaggaaatattctttaaggaatttgaaatttaaaactgaagagaaggtgaaaggttaggataaaatagaagaggtactcttccattttgaaataatgagcaaatgaaagaagactggacttccaattcagcagcgatttgtatgtttatttttatgatctcgaagaggcatgtttcactttctgatctcaaattgactattctataccacaggtatagaattttcttgagacaggcaagtatttctattttcatttttattgtaaaagatctgaaatggctattattttgcattagaaatttgtataaaataaatacatgtagtaagaccttacatttaaatggtttttcagactggcagagcgactaaaagcaaaattgcctgaggccacacccacggaactggcaaagctggttaacaagcgctcagactttgcctccaactgctgttccataaactcacctcctctttactgtgattcagaggtaggaaaatgtaaccctccacttaacatggcagaatcttttaagaacgtatgcactccaatctactcatttctttcctgttattgagatgccattatgtgacaggcttttcctggtgttattgtaacttggctgtctttgcaatgaaagtaagaaacataactgatttcatgctatgctcatttaaaagcaagttgaggtagttgtaaaacttaggaaattttatactttttttaagaaacaaaagagtctgtgaacacaggcaacaaagtatgtgtagtgttttacaaattgtgagttgtaacctagtaacagcctatttaaatgaaaaagagaagaataagaatacagtgagaacatcagagttcattaccttcacatagtgaaggtaaattgtatttcatatatctgtatgtgtgtttatgtagatacatacatatgcatatataggcaggtagattgataaaaataaatactttagaaaaatggggtcatatcataccttctattaatatgttaattataaaaatattatttaactttgttttaatatgacataagaaaaaaatgcaactgaagaatttctaaaggtcacataaatgtttcattactataagagttattttctaaaaactaaaaaatgattttaaagaatattaaaattttagtcattttttattacgaatttcttttttagacactatcaattgtctccaaactctgaaagctaaagatattagaagtcctatatatcttccagtttccctccctactcccctcaattttggatagttcttggattcatctttctttaaatgtcccttcccctcctccctgtctcccctttttcttccttcccctcccgcttcctggttcaggtccaatattgttaacagtaaaataaccccttcccctattcccctcctcctttctctctttccccttctctcccataaatgtatttgcataattgccagatcatttattttttaatttgtgcaaaacaccagcagttctggccagacctttttgttttctctgatagtattaatagatgaattagtgtttatctaatcaccacatctgaggcctattggttttctcctataaaccacagtgttaggttggtatcttgtattctgcccatctttatatagactgaaggtgtgagagaggggaggagacctcaggtaggttgtgtgggcccattgttagtagacctgagctatgcttcgacttctgagatttcaagtgtcttatgctaagatttctttcaccaagtcagcatctgccctattttcatggtgaggggtgtattttgctggcctttttcagaaaatgtcagcccatacgttcacatcctccattttacctgttactctccagcaagcatttcatttttttagaagagtcaaaagataaaaacagcacttcatttcactttactgcttatttggagacattagtaataactccaagaattgtgttgtcttgcccactctatttctgaaatatagaggcagggttaggaacaattctatgccataccaaatgatacttaggttaaatgatttcatgccaattagaattagaagcccttaaacccgttttttttgtttgtttgttttttggagatgaagtcccgttctgtcacccaggctggagtgcagtggtgagatcttggctcactgaaaacttcacctcctgggatcaagtgattctcctgcctcagcctcccgagtagctggtattataggtgcccaccaccacgcccagctaatttttgtatttttggtagagacagggtttcaccatgttggccaggctgatctggaactcctgacctcaagtgatccacccgcctcagcctcccaaagtgctgagattacaggtgtgagccactgcgcccggccagaagcccctttctataagtgaaataatttaagaatttacctgaagttttgttcatttatcagccacgaaagcaataaagcccagtttctattagactgcatttaaaaatacccaagaacttaatttttaaaaaagcaagtcacgaaagtataaatgttcaaagaaaactataaagatcatctagtgtaatttctcactcagttaattccttctagaggtgcattcagcctccatttaaatttctatagtcaatttatctactcctaagagtagaaatggaaatggcctatttcattgccaggtagctgcattatgagaacattcttctataaattaagctgtgatattccctttgtaatttctcctgcaatcaccctggctttctctatcaactagaaaatgtctattctctgttcgcaatagcagctcttttatacttgaagtgactttttaaaaattaagctgtgtaaagtatttttttaaagtcttgggctatgcattccaaatttcttaatatccatattttagtaaagttttatttgttttgttatgttttgttttgttttattttattgtacagtgcctaagaaaaaagtcttagtttgacaaatggagctacatctttttctaatttcttccttataaccttagggattctggtttcttttctaatttccatatttacactctggtcccaaacctatttgctaatcttgtttgtaacaatttataaagtcagaattccagatgaagagagtacggtagaataaaagccttttctttaaattctcctgacaaatatgccatcttaatctttcattaaaattcaaactacttaagattctcaacataaaaacagaagaagctggattgtcagaatattttggtcattaaaacatttttagcataaaataattaattaaattgaacagttctttcttttcataccaagttgcttttagtaatctaaatttagttccaatttaggtggccttaacctagaaaaataaaatcaccttacatagaagttgtttgctaccagaaaaattttctctgagagtctgttattacgaaagaagaagaaaacagtctaaatgtcttttagattctataagaaatatcacttttgaaacctttccctgtccctttgttatctgtctatacagatatgcactgtcctgcctgacaccatacaagacaaactgagctttaagcgcaaattcatgcttcctaaaagcccctggtttttcatttctttgagttggttttcaatataacatattgccattcaaatcattacaatgatgagaagacaggtttgtagctctctcacttcttgctttatcgacagtaaatttatagcagctgagtagcctttcagtaattgctaaagtagagtgcgatgaatggagttgttgagatacttgtgcacatttgattattcagagtacacagagattaaatcctctgctatttcaattagccctctgattgcctttgtaaactgatctcatagctaggtaggcaagctcacccctcctttctgactttactttagtgcaacatctgtttgaacagcattctctttaatttccaatgcctaacgtgaatgtcccatttgtcctataatatttggatcctaatttgtgagatctccttgtcatacatttgcttgaaaaaacttttccttaaaagtaatatccatctactcctttcactgcaagtcacttatatccagggatcagtctctacttgtcattccaaatacacttggcacaactactggaagactgggaaaaggggcttctgaaccatacttagtgtttcattacatgggtatctacccctatcctcacccaatcttgaaatgaccaggaaatagaacaatcaatgtcattttcttttggctttaccatggcactcttagaagtggttcatttgtttatgccaaaaaagacccatttgcctacagaaaaacctatagttacaaaattagacttgaaatcttcttttctctttctaccatcattcaggcagggcatccctttgggctcttctgagaactcattactatgcttcctttaaaatgtttcaacagactgctagtgagcatcagatatgatttcccaaagtattccaaaagtcattgtaatatgctggaattgatcactaaaatctgaaaaacacagagacaaatacaaatagccaagtggaagccgggcaaagaggagactgacaagtagagtgatatactgtctaccccccaccacctgtctttcttgtgtcaggaaaaactagtatagtcactgtagtttgttttatctctcagtataacttgattttataatcttcagtgtcatagctatcattgattaagccattgctatttgttaagcagaaatattaatagcctggcatgtatgtatttatagaataacccaaaacaattctagatgttaattaatattttaattcccccttttacagatgggttgaatgaaacttacagaggttatatgatgttaggaaaatctaaatttattctgtattagtctgttactctccctcaatgtccttgtcatagacgtcagccctaacttagctagtcatgacaaaagcaaactattgatagaagactattgactgaaaatccaaaattatttttaagtagcaaaaatgataccaggttggtaatatcgctgtgaattttatccatctcacttccttggactcttcctccattagacatactctcttcttttgtgtcaacatttttgccagctctgtctaatttgtattaaagttactcttcttcttatctcaaaaaataataaataaggcactttagacacctctctagctatatttctttctcctcccttacagccaagattcttgcaagaataccatatactccaactcctcacacctcttattaattcctcaaccctttgcagtctggcttttgatggtaccatatgactgtcaacaaaggcacgccaacaatatccttcttgttaaatctaataaacatttttcaattcttaccagatttctccacaaaacagttgatacccataagtataccttccttcttgaaacaatttacttagcacctgtagtattattttctactttttgtctttctatgattcctctcttcttgttctatttcatattgtcctcttcctttacctgtctcttaaatttgtttccagagttttttccttgttcttcatttccatggcactacattttctcaactgttttcatcaatgcttaggcttttaatctccaaatctctacctccaaccaagatctctccctcagcattaggatttttaatccaactgtctaggactctcttctcccccaatatcttgtcccataagaaattgaaaatcaacatggacaaaatatttttcctataaactgctcttatgttttttgagtttatgaatattatcatcatttacccattgccccacgatgaaaatttagtgactctttttatttctccttctctttttccatatgcaccaaataaaattccaaatcccatcaattctaattctgcaacatctctcaatctcccacccacattcttctacattcttggtatttagtttcaggcaatctttcacctggtttatagcctgtccattggtctcctcccacctccagtctgcccacagtgcttcacattccaatcccatctctatactgaggtcaaatcaacctttttaaaacacaaaaatggttaatactcttctctaatagctctcattgcctccaaattaaagtagtttttttttttttttttttttttacaaaatagaggtattttggaccttgatttcttctccaagtagtgacttgctatcatgacttgttgtgcctcctgcttgggttctcctgaactacttgcagttttccaaacacattaaacttgcttttacctcaaggcctttgcacataatgactccacccgcttgccctatttctcatcaggcttgccgtggctgaatcattcatcaggctttagagttcaagttagaagacatctgctccgctgagaattcttccctggcactcaaacttctctgttgtcccacaacattctgtttgcacccaataattagcacttattaaactctactgccattttttcttgtctacttttcccagcagactctaagcccttcaagggcagagatgatgtaaagctaaataaatgcaaagggtggctaataaaaaactgcaatgtaacattgcatcttggcaagaatccgctcccctaaccaaggtttcaagattttgtataccttctgcatgatctagtagcctacaaatgaaatacttcataagttatataacattcttttttcattatcagattgatgctgaattgaagaatatcctgtagtcctgaagcatgtttattaactttggtaagtatattttataaatgcaggaccaacggatccagcattgtaggatgtattttaaatatcaaagaatgggaaggagactttaataaatttattcttatctgttcaaactcattttacagatgagaatattaagcaccgagaaaagttaaagagcttacacttatacaagagcagccaatttctgatatatgtaagactagaatccaggtttactggtcccctgccttgtgcttcatccatcataatctcacatgtaacataatgataccataaagaacatttaaaggattctgatgcacttcaataggaagaactctgagtttaaagacagggctcatcaagtcttaaaaataacacagcaaggaccttaggaggaaagggacattcttattcaaatgaaaacaatactgttgaaatattattacttgcttttttcagtcactatattttcacctattaaaaaatgccagatgaagatattaagaacataaaatagtttattccaacgtaagttcacatcttaaactgaagagcacccccgccgaactctgcacatttcaacaacaatattttctctccagattcaattgtatttatgctaaagaaattacacctgagacttttgatgcaaacttgtttggatctcagttcttagctgaactgaggcttttcaataatgtcaacgtttattttgctgacttactgacaactctgcccaaaataatgtggaaacaaaagccttccaatccattcattaataacattaaatcatttcaccatattcagcttttcaactattatttaaatcctctgaagctgtaaaaaagaaaattaacagtctgagaaccagtacaagggggatggtcaagaaaacttatatttgaaatcacccaacctgaattagaatccccactctaactatctgtctgtgaatttgagcaagttatctatcctgtctaaagatgagtttcctttcatgtaaaatgaaaatttccatatctccctcacagtgttgttacaatgattgaggtgatgtatatcaaatatttaaaaagcagtaaaaatgaatattagcagtaatactagcaaagttgttgcactgatgctcctactactactggttgaatctaaactaaaaagttttcctgcccatatatttttgtgctctggtatacaaatatcatgtcccaacgataaagtaagttctctaaataattttccaaggaataaaaatcaaaatgcaagttatttgaagtgtaaatattctagagttaaaatagtttctgatctctgttgctgctaaattattacatcctccccccatttgaatgaatctttcctttatctcaatccccatataataatctccaaagagttaaaatcccaatatgcaacagtgacctcacctctcatccttcaagatttcttaagctttaattaagagtcagggttatttggaaagctatatgataactttgattttgaatatgtttttcactggactgtgttattattcagaactcagagtgcatttccttagtgttgtatgtttttaggctttgggaaaactaattaaaataggagaagatatcctaaggtaagtaaggaggaagtaataatttgatggatttcaagagatttcttttcagaacaaatgtcagaagtatcttttttttttttttttttttttgagatggagtctcgctctgtctcccaggctggagtgcagtggcgcgatctcggctcgctgcaagcaccgcctcctgggttcacgccattctcctgcctcagcctcccgaggagctggggctacaggcgcccgccaccacgcccagctaatttgggtttttttttttttttttgtatttttagtagagatggggtttcactgtgttagccaggatggcctctatctcctgacctcgtgatccgcccgcctcggcctcctgaagtgctgggattacaggcatgagccactgtgcctggcccagaagtatttttgatgctaactcaatcaagagataaacttggtttgtcagtgacaagctaatgaagattctaatatactgattcttctggttcatggtcattatcttcatctgataagatgaagaaatgaaatttcttatcatttctcctgtgttagtctacatttttctctggcctttaattaatcctttgatttctgtaccactaaattgtttggctacccaaatacattttgatcatctggatggattactcacatattcacatattccttcctaaaattattcacatatcccttccatggattttggtaacatgcattgagtgttttgagctcaattttatctactgcttgtttatcaccattgcattctgcaatgatgaaggcctaccaatgttcaattatttcaggaatagttacatggctttgaaaaagcaaattataccttgttcacaaagttataggtctgaggtacttgatatccagaaataatgagaccacaactttaccacttatcttaggtttccagaacacaaccaactcattgcagttcctgggttccagggagaattttgtagttgtattggacaattatgaagtcatccaactatcagcagcattgcccccaaaataacacaatcctagtcatgagttgctctaaatccaggtcttaacgtaatgatttcagagtaagtgctgagtactttccctcagatagatcagtcttttcatcatatattaaattattcaagtagaaaatatccattttcttcaatgatttttcccttgttgtaacaggtgatctgcagaagtggcacattgtttagagtgaagcagttcctaaaaccattaagccaactttggttggctatgtgtttcatttccatttaagcctacccatctctagttagagatttgactcactcatagaagttgaagccttttgtctcaaggtattccgatccctagtaatacctacaattcatgtcttccagtcaacagtttcacgctatttcactctcaattagagtcttattaaaaacttcagttctcatcttgacagttattggtctccttgatcaatctttttcttcaagccttcaagctccaaattgattgtggccacacttgcatgcacttttggagacagaatctctgtctcttaccccccaccctgcccacaccaagacggaatctcactctgtcgcccagtctggagtgcagtggcacaatctgggctcaccgcaagctccgcctcccaggttcacaccattctcctgcctcagccacccgaggagctgggactacagttgcccgccaccacgcctggctaattttttgtatttttagtagagacggggtttcaccatgttagccaggatggtctccatcttctgaccttgtgatccacccacctcggcctcccaaagtgctgggattacaggcgtgagccaccatgcccagcaaatctctgtctcttaattatctcacaaagccaggtattttttattgttagctttggaagcaagtagtagtccctctgggttgccaaaaacataaatgaattggctcacagtgtagaatcagattgggtgaaaatattttagataccagaatcacacccagcacagagagttgctcacactgtgagagaaacataggaactgaggctgtgagggaacagattcgtgtcccttattgcatcctcactccaaagcataaactcgttgaagacaatgaaacatggaattttttacaccatgcaaatagaactgtgacataactatattatattgtcttggaagagggaaaaaattaagggagacgaattggccctaatacaaagtagaagatgacttgataaaaattcacacttatgttttgctaaaactactcaactattgtctcaattccatgatgattgggggcctcattatgccactggttgacagttttgccttggccataattgttattaccatagagcaaaaagtcacattcatcaccagttaaaaatataattaaaaaaacactgcacaatgtacaatgtaccctggtgtatggcatataaagccatcactactggtatttggactgtcttaacatttttttcttattctggacctatgagatgggccatagtggatatatgggtcatcctagacagagtcatttttggcataaatattaaaatagcatgagtttatatgcgtctgttgagcaatattatggttgttgcccattagctctgtttttctaacataaaattcatttcattattctcatagaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaatatgactgagaattatgtggctcttcacaatgttgatcttcagaactattcctgtgtctttcacaaaaatgctacagtaggcaatctcataaggcctgtttttgtctagatctctgctgtttccttctaaaagactcaacattaagcatccactttacaattcccagtatgctaaactccattccctgattgattctcaggcttagtaggtaccattaagaaaaagttaggctgggcacagagtctcacgcctgtaaccccagcactttgggaggccaaggcgggcagatcacaagatcaggagttcgagaccagcctggccaatatggtgaaaccctgtctctactaaaaatacaaaaattagccggatgtggtggcatgtgcctgtagttccagctactcgggaggctgaggcaggataattgcttgaacctgggaggtggaggttatagtgagggagatcacgctactgcacgccagcctaggcaacagagcaagactctgtctcaaaaaaagaaaagaaaagaaaaagttagacagccttccactataaagcctataatatctcactttttaaaaactaacagccaaaaaccaacaacagtaacaaaaatactcctgaaactaccttcttgcttccagccacaagttgcttggaattaattaagtagtatctgtcttgcaaaaagaaaatctttgtagcttggacaagtttacttttacaaaaaattcctgagagaaatttatagagacaaagttctaaaaacatgatttttctgcttaattcaatataccacatataaaaacatatacaacattctatgtgctctctttgcccagggaaaatgaaagtgttctctctattctgctttaaaggaaagttcatatgttcggagtaaatacctctctgaaactactaaaaaccatgcaaccttctatatgtagagttaattgcatcagggaatttgaactcacctcatgttagatgtagagttatacaatagatgaaacaattttatggcatatataatttgagtcaaattaactaacatacctgtcactcctcaaaattctaagtcccatgaaggaggatttcattaagtgagccaaggtcaagtgaccatgcctttagctgccaggaactgggaaataaaatgcctgccgcttgcagcttctacatagaaggtgcagccctgcctttcacaaagatttcaaaatgagaaataaacctcaaacagagaagttctttggatgacagaaagtcaaaaagcaacaaactatctgctaatatttaggcagcattttagatttttaaaaaattctctttcaaaaattaccttactgaagcttcaaacaactctgagaagtaggtatcattgcattgataagacacaaggagactgagactccaaaaatgtgaatcagtggctctaagtcacagagttagcaaataacaaaacaaggccttagttttcaattgcagcattccatggaaggtggatggacatacctgatgaatgtgttacctgatcaaattagttttaccatcagtatagtatatctcttctttgaagagtcccagtgtgctgtatgtaattcagtgcttccagatttatttaagggctaaccccttttcctttttctatttcccagaattattctctataaaattaattttggaaaattcttttcttatttgaaaaattacatttataaatcattcattaactactgcaaactggtccattttggtaaagtattttcatgcttgacctgatggaattgggtgtttttttgtcacaaagtagtcaataaatatacaattcactgaagtagggttttcatagttcccatggatatattttccagcacactctaaacacatttcaccattttttcttatattaagaatcgctgacagaaatattgtaattttagtaaaagagttttaatgttagatctaatatgcataatgatgtcatttgttccatttccta

SEQ ID NO: 11835 - DNA, 100550 bp, Human
tagaacctactatagttgaaacccaataaacagttgtagaccaattttcttactgttatatactcagattatgccttaagttcaccctacaagtaaactttccgtcaatttcatagtgttgtgaaaactctctagtagctcagaacgttcttggtggtctcaatatattaaaagtatgcagtcagatactgatggccctgagtcctgcagacagctaacaaagctgaagcccacaggctagtgagcaccagctgagagcactttctatagagtttgtgggcagtccaagagagacaggatctgagatgtgatgatatgtcctctggcagcagcaatatctgatattgagctctgctaggtggtgctgagcgtggacacctgcttccttcaccggctgcagagaacacagtatccattaaaggagctgaaagaggtgctagaggagtttacatggcaggagtccaggaagctctgcaacagtccaaaatgaggttgggacacatgatacacttgttcatccctattctctatcttcacacatatgcatatcagtccttccgtggctgctatattcttgtggtgagatccaaaccagctgcagtcttgctctcccagtgcatgctcattctgcaaatcagagcttcaatgtattgctatgaaaaattctgactggtcttgaaatccattgacaccatcacaagaaaattcaacatgacatcgtcatgaacagaaatggatgatggcttcatattcttaaatataatttccaactatggtgaaattttgaatggttgtaaaaactgtttttgcatttttatacctcacttattttgttaatggagactatctagagtttgatgtaattctcatcaaaaagtccatcagtaattatttcaaatataaaactgatatcaaaaaattgagttaatgaaaataaactcaaatttttcataaaaatatgaaattatattatacggaactttatgtacatggaaagtgaataatttctattatttttctatttgatatttatcatatttatgtaattaaaaacataattaaattttaaactaaattaaactgcgctccaggaagacatcattttctctgaaccatgactctgaaaatttggaaagcaccgtacaagagggattttcagtgattcacaagagtgcaagattctgcaaagtactttcaaaactaagcgtgagatctttgctactgcctttatggcatgcaaatcactcagcctcaactcagttccttcctccaatgtaaaaatactacaagaacaacatctcacgcttccatcaaatgggaccatgtgtgatattttacactggactacacaataggctggaaaagtgatccgcagagaggctcattgctctaagttcactccctgtaccaactgtcttgcacaaagctgccacccgggtgtcttcttccaacatttcccctagttggacttcaaagtttccttcttgcagcctgtgcggggaccaagaggccggtctagagtagccgcccagcatccagatccgacatccttttccctttcctcaggaagacttggatgcgcgccagcccagcccgggtctccaggttcagctgcggaagcttcccacatggtgcccgtcgcttgggatgcggctatccttgtgccttctctgcaggtgtcccggcaggtagaggaggagaccggtggctggtgttcctgcagggcggggctggggctcctcgatgtccttgcgcttgccctgcaagttctgcgccccaggccccggcagggacggaaacaggccgggaagcagtgacacctggggcagtcagtcatccaggagccgccgccacccgccccacccccagtctccgcgggaggtgtttgtcttcgcctatgctcccggctctttctctttcacttttcttttcgccaggggttgggactccgggtggcaggcgcccgggggaatcccagctgactcgctcactgccttcgaagtccggcgccccccgggagggaactgggtggccgcaccctcccggctgcggtggctgtcgccccccaccctgcagccaggactcgatggaggtacagagctcggcttctttgccttgggaggggagtggtggtggttgaaagggcgatggaattttccccgaaagcctacgcccagggcccctcccagctccagcgttaccctccggtctatcctactggccgagctgccccgccttctcatggggaaaacttagccgcaacttcaatttttggtttttcctttaatgacacttctgaggctctcctagccatcctcccgcttccggaggagcgcagatcgcaggtccctttgcccctggcgtgcgactccctactgcgctgcgctcttacggcgttccaggctgctggctagcgcaaggcgggccgggcaccccgcgctccgctgggagggtgagggacgcgcgtctggcggccccagccaagctgcgggtttctgagaagacgctgtcccgcagccctgagggctgagttctgcacccagtcaagctcaggaaggccaagaaaaggtaccgcagctccccacttcctaactgctcccgtcccaaactcattgtgggccggtgcagatgtctgtgcgtgcgcgtctatccctacctttgcaaaatcaaattatcgccctcttctttgcttgcacacgtcttctgggagagaaatttgcaggaatggtcagtgcttggcagtcaggcctgggtctgtattggttccaactctgcgccagccagttatctcttagagaagcgatagtgtatctagaatgtcgaaggaacttggaaaaaatacgagcgaatttcactgaaataaaatcattattcaaggtggcttttaaatgaaaatccagccaattttttcaagtgttattaagaccgcatgtagcaagggtatacagttcatttgactttatgtaattccatgcattaaaaactatgttgacttcaaagtatgtctaaaccaaactaattcttaaatgatgcttacaacagattcttaaataggatgagtcagcaatttcaaaactggaagtaaagtggtggtcaccagctagtttccattatatatttttaaactactatctaatattatgatactggtggtggccaactaagtggacgtcatccttatcttgtcagtgtggtgaaagaggccatattagctaggctgaatttttgctcaggtattacagaataaactggtgattatgcatcctgccatgtagaggttataaggtgaaccattctactgaaagcatcaagatacaatacacttttggaaggccgaggcgagaggatagcttgagaccaggagttccagtttatagtgagctatatgatctgccactgcactccagcctgtcaaaaaataaataaatgaataaaaaagatataatacaggttaaatttttaaactcctgttgttttcgtgtgaagtaatgtggccaacagagcaaggaaatacatgggaaggaacataaagacatataaagagaagaactgaaaatacagcaaaagccatttagatttaaaaagtgaagaaaaagctagttttgcttaaagttaacaagtatcatagagatcttaaggtttgttatgattgtcttagtttcgggtccttattcgtgtaaaattctcacagaattttagtcaatcagaaaagtctctcctgcagtatcatctgctttgcaacagtgacagagaagggtcagttgaccattggtctggaacttctgataggcagggtgttcccatacttttggtttcactgttccttgctgatttggagtggcaactccagaacctgattggaagctatagttctggttggaattttcctgcagactactggtgattaaaatgatgctcttttgttttaatccatgaaattaatgtagccaatgtcaacagctatattgcaaggcacaatgtttataaatttccttgggggatggagaaaacagtggtttaaggtttatcgaaatagattttggaagtggaaggttttaaagcctacgggatactccatctcagatttgctgcctctgatgaatttcaggacagctagaagagcagccctgaaatgctgggtacatgtggatttttctcaggaaaatatccgtaactttgatcagctttttaaatgggtctctgacccaaaagagttttaaatcttttgaaaatatagactactgtccttttcccctcatctctcctggagtttaatgttgagttctgctcattgtgttaactatttttctgaaggttagctgatcataatacagagttctgtcttcagacctataacttaagttatgagaaacagtatgaataataactaacattgttgagttcttattatgtatcagacattgttctaaggatgtattttttaaaaacatcgtaataaacttatgtggtaggcaatatattttacagctgaggaaattatcaaggtcacagagctagaaagtggtagagttggaattccaactgagacaagtttaagactggtggtatttatggaggatggtattatttgcatacaaatatttcgtacaatttgacagtgataatccctacttattttcaggcagcgttgtaatggtagaatgccggttttaaagtaatgtttgtatggtacttgtgcaattgacattattatatatttaaagattatctttataatcaaataatattcatttgagtgtcaaatatgtgtttggtatattggagaaatttcctttatggtccctgaatgaaaacatttgtctaatctgcatcactttctgctgaaagagcctgacaaatagtaggcaaatgtggattgatctagatatctgtctctgcctatctatgtatcccttcttccatacaactagaagtctgggattcatggagaggtcagagaagaagagtttcccataatatcccaactggagatgatatagttaactatttgggacatcctctcttcagaaggcattatggtagaaggtttggcaagaagccacttcttttgctcgatattagctctttgatttacttacccgttgattacagtaactgcatgagactactgacactgaacattgcttaaatacttgctgctgtcctataggaatgggttggatggaaaaattccatagaggagttgaaggaaaaattgttattttagtgagtactggaatgcactaacacctatttgatggtaaatttcactaattaaatactatcaactatatgtctatatgtgtgcatatatgactatatgtgtatatatactgtgtatgtgcatatatgtgtgtgtatgtatatattgtactgtactatttgttaacagctgtgggcagacaaggtttactttttactcagcttccagactgtattgaatatataaacataagaagctaagaaatcttgacagaaagcctgaaggacaaattattgttattaacagtgccattccagtaggaacctaatgtgaatttgaaagtttcaaagaggaagcctctgctatgtttcagccaccatactggcacttcatctgtatgtcctcattgaatttgaataaccattgcatttttatcctgaatttacaaagaaaaaaaaaaaaagacatgcagagttttgcttgcattaggacacaactaggtaagacagacactccactgagatttatcttgattctaatgttaatgctccttttcggatatcatatgcattctcttctaagaaaactcaggtgttcagtgtactgacaactaaaatgctgctatccttaccttgaaatagaccctggtcaccatttggggtgatttaatgctatttatgaatttgcctatgtcaaagaatattgcccttttttaaacaaacaaaaaaaaaagttgtttagtgctggagtcagaaagaggagaaaaagaggctctttaatctcagtttagttcaataatattatttgtccacatttcacatccagagccagggtatttgtatgcatttattttatagtgtttcatcccactgcaggggcagaagactctatgtagaccgtataaaaatggatttttaaaaagtctgcatgtaatacacagttgtttcttctctaaatgctaatagttcctccaagtgctgacagggtgcagacaaaatcaggaaagtgacaaattattttgtgaaatgagggaattgaaactgaaaatggttgtagaacaggaaaatatgatggttgtaaggttgatggcggtggtggtgggggtaagctctgcttatcattgtgacacacgaaaggagcccagagagggtctttggtcccttatatcactgaatgctacttctccttcctgggtattttgcttatgtgccttctaatagaaatctgacaaagtagtccttgcacactgttagcactgacctctaaaattatcaaatgattttttcttaattgaacattttactgttaaagattttctattttcctgactcatctgcaacaaaaataagtacataaaacttgattttttatttgaaggattttcgttgtgaaaattattctagcttatgttatttaaaacactatcattataaaattaatcaaaggaaccattaatttttgataagtgattattaagcataaaactaaaacatatatacccaaaggattataaatcatgctgctgtaaagacacatgtttattgcagcactattcacaatagcaaagacttggaaccaacccaaatgtccatcaatgttagactgaattaagaaaatgtggcacatatacaccatagaatactatgcagccataaaaaaggatgagttcatgtcctttgtagggacgtggatgaagctggaaaccatcattctcagcaaactattgcaaggacaaaaaaccaaacaccgcatgttctcactcataggtgggaattgaacaatgagaacacctggacacaggaaggggaacatcacacaccggggcctgtcatggggtggggggaggggggagggatagcattaggagatatacctaatgtaaatgacgagttaatgggtgcagcacaccaacatggcgcatgtatacatatgtaacaaacctgcacgttgtgcacatgtaccctagaacttaaagtataatttaaaaaaaaaaaagccgcaatgtggttttcgagcttctagaaacttagaaaggtgctaagtgctaaggaaatttcttgcatcagtgctttgaatgtaaattatttttgttgaaaagtgtgaatatcgctacgttttgtggagttttgaaaacaaaacctgtattggagaataataataataataataaataataacgtgctcttgaaaaaaaaactaaaacaatattggaaatatatatcatacaactagatatgtcaatgctttgattaaagatgtctcttatatcaacttttcaaattgcccctttatttggcaccctggtgaggcaaggcacatgttaagattctggatagggagagataggcatttttttcctaaagtgggagaagggtaattatgaaagaggaagtgaggaaggagaacttgccagaaatctgcctgctttgggcacacatcaggcatatctctggtaaaaggggctcctatggaagtaacggatcttgaaattggttcctttagaaccgtctatgtccacaaagccctgggaaagttgtagggtatgccagaggtgcgtgttgttcagttgggatatatagttcagccttctttcccacaccctccctttggcttctggattaccatgggttactgtgcttaaagcaaagtacagggagtaggatggggagcagtaaagagcctgggctagcttctgtagaggtttcccactggggactagtgcgaaataagctctagtagggcttggatagcctctgcagtgcagtctcctcttctagcctcagctgcagtcaccttgcctcagtgtccagacacacttgccattctttgtcagccttcatgggtcctgctcaaaatgttaaccctctataactttttctgtccccacctactgcccaggcagaattattttctcccttacatgaattcatttggtgctgtctacattcccttataacagctttaatgtctgtaaactcatttttatgtgtctgactctacacttacattttgagtaagggcaatgtgctccatgtgcttagcagagggttggtcagagtctatttgtattgacttcagcatgagtcaatcatctttcaagtgtttgacagctaagcaaacaactgtaaaagaggtaggaaacataagtaatatagcaaaacaatgttggaatactgtaataaaaatagtattttagggaaattagtttgaggtagaatttattgaagaaaagacaattagagataaggaaaccagctagaaattcatcacagttaattcaggagtgtagtttcattctcattatctgctcaaggacataactctagtaattcattctttctctccatcaccatttttttctctgtctcttatgggtctttcccaataccatgtagccatgctataacttctgccatttttaaaaaagactcatgtttttctcctcatgtttctgctcacttctatatctgcttttttctgcccacattttacaggaaaacttacaaccttaactatattctctgtttccagttttcctctctcctttctctcctgaaccagccaggctgtcatctccactgctccactagaaatacacttgtcaaaggtaccacgaacatcccttttattaaatccagtagttagttattgggtcccttcctatgtaccctttcagcaggacctgagagttcttcatgtggcttccaagccactccccttctccttattttccttttaccataccagcaacaatttcagtctccttttaccttaccagcaacaatttcagtctctgtctagttcctaatttccctaacatgtaaatatagctgtctgagggctcagtccttaggcctgttctctatctgtactctctgtcttggtgatctcatctagtgtcatggtttttaatcccttcttacattgatgattcacaaatgtacgggtgaatctagccatgacctctcccctgaactccagactcatttagcagtctatttagctgttattcaaccatctctgattggatgtctaatactcactggattcctgcctttactgccatatctgcttgccccaccttcttcctcatcttacctgatgtcaatttcattctcttagttccatagataatcaatcaatctatcttgggtttgtccttaacgtctctttatgtcatattccacgttgaatctgccaccaaattatttagctaggccttcaaaatataccctacatcctatctcttctcaccctttttttcagtgctgtcacctgggttcaagttgctatcatgtctcacagtattattgcaaaagtgcctgctgcttgtccccttatctccactccagcctgttctcaacatagcagccacagtgttttggttacctgtccctgcatctaaaggatcaacagccataaaacaagaacaaaacaaaacaacacccccagaacttagtgacttgaataacaataatttgttatttatcgtgatcttgtaatctgggctactttcggctgcttgactcctcctaggctgctggagatgagacattcaagaaagcatcttccttcacatgtctagaacatcagcttggatagctggaaagctcatggctggccaagcatccatctctccgtatgtgacccctatacatgactaacttggactttacataacgttggcctcaagtagttgtatcatttaactaattattgactttcaggatcccccatagcttatctcgttatggcatcaaactcagactttaagtctctaaactggatctccagatgaggatgatatttctctgatgtagtttcttgagtgcagcaacctgtagctaaaaagataggttatctgtgaccttccccttgtcccaacatacaatggtaaaacaaaaataggacaattgctttaaaaaaataccatttcaaaacaagacaatagaaggcatataacagttgctagtccatagcaagtctaaatagagccggcatatatcccaagttcttgctctggaagcaatacatgttccggattaaggtttaaatttgttccctaggagtgatcctctgtggctcttaacttcatcttttgcactttgggctccttttctcattctttctttcttttctatgagaaataatttttgctattctttgcagtggcgtagcctgctttctgatgttagagggttaataatttagagaccttttatatactcacttttgtttaactgctttttgtttttaagttcaatgatatttagaattcggggggcttcctatgaattttattgagattcattcactccgttagataaaagacataaccagaaaatccttgagacaagttccactttaattttttgggaagtcaaggtgccatagaaacccttaccatttttagaagccttttgactagttggcaaggtctgtgagacatcattttaaatctttcagagttcttaatgaagggcctccatgccacacacctgatttgatctccaacctgagagcacatgtaatagtagagcctggatttgatctttgccctgaaactacttatttcttggagaatcttttgctgcctggaaaggcaagaatgagaataggtgttattttccaatctagcaagtcttaggttgaactatttcgtcactgcatttctagccttcactaacagggtccttgcctctctccaggtgtcttcccaccactcagtctcatagtagtttcaatgtcaattactaatttccatataatagactaccccaacacttagtggtataaaataagaaccattttattttctcaagcctaagaattaggacaaaacacaaagagaatgacttgtctctacactgcaatgtatgtggcctcagatggtatgactcaatggtcaagggatgtctgagatggctcagacattaagtcacacatatagagcctcagttctggctgttgtctgggctccttggttctcctccacttagtctttccacatggctaaactggactttctcacagcacggtagtttcagggttgtcagactcttcacaacttggccaacttctataagagaggaagttggagctgtaatcacttaaggcttggatatggaatttccagactttaacatttgttttattcttttgggaaaagcaagtcagaaggccacccagattgaaggggagacgacatagattccaccttttgattagtagagtgtcatgcatgttcatggggggaaggcactgactgatggcagctgtctttggagattatccaccacaaagggtaatccggttaaaatattaatcaggttatgctactcctctattccaaaccccacatggttctcccatctcactctaataaaagccaaattctgttacagtggatattaagtctcttaagtgatttgtacccctgatgtctgccatctgctactcttcccttagctcactgagtcagttacactggcaccttttctattcaccaaccatactactatgttcttgtctaagagtcttttaccttgctgttccttcttcctagaatgcttttctctcagatatcacccgcttccccatacctgctttggggtttgtctcaaatatccctgttgcaatgaagtaatccttgactgatgtacttcaaattgcagcctcaccagcactccctgtcccaaccctgtttgggaattcagattatttttcagattttggaaagtaatatagtgtgtttactatatatcatgtaacgaccaagcttattcaggtacttcctcaaaagggaataaatacagcttacacatagtctaatgttagttcagcttgtgttttgttaatcagtgaattaaggagaaactttcagtttttggagcttttttgatttaatattttcatataagggactatggacttgtatgttttattgaattatttgattattaacatctcccttcattagaatatgaaccacaggagaacatgcagttttgttattttattcattgctatattcccatcacctattagtgctaggcatatggtagtctctcaacaaatatttgcttgagtatttaaagcaatatttaaaacaaaaatgaatgagggaatgaatggattaatgaatgctaagtagtagggtactgcaaatagaatggagaatagaaagacaagctaatttcaaggaagatttgatataccagtgttctatttattcattgaattgattttggcacttcagcagttaataattttgagtgcctaatatgggctggggactttcctaaatacttgactggtcttgattgagtgggaggagcagagcacagcgaagagtcagagaatgccgaagattttaaccatgagagtcaggaaagataaacatgttaggaacagatatatattacagctaacacatggggcaaggtaggggaatggatgaacttgattttggaaatatcacgattgagttaaaagtggaataaactacttaaaatgtcctgtaagtgattagaagtactggattgaagattggataagctatttgtacaagatttgggtttgtgaattaagtaaagaattattggttaaaacaaatggtcaggatatttccccaggaggcaaatgtatatatagatggcttagggtcacataagacaactagagggactgtcactgagctaagcaccctgaaagaggagatattcgggaaggccttcgaggaggaattgaccagctcccaggtcttcaaaagagaaggctaggctttttacacctcctagaccttgccttcctgtcatacttgctctgtctgctgctctctagagggattttaatccctcatatgcttattcttacatagggatcatctttaaagactcactttctctgtgacgttttcctggcgagacactatctttacctcctgtcttgcctgacacctttcctttgtgtgttctccacctgatagatacttctctcatagtatctgcagtgtttcactgtatttatctgtgttcatattgcctctccggcaggtaaatgataaaggtcatagatgagaagaattgtgatggtggagttggaagggctgaagtttgagaaacactgcattcttatgtgtctaacaccttgtctggcacatagtagagctataataatgttattcttgttgtcaatgatccaacatatattcctgaggggtcaagttagatcaggttctgagaaaaggagtttgaccatatttgactcatagtatattactggtgatcacatggcttttgggaaactattcacagcatatttcctattatcagggtcaggaagggaaatagaattttctggggatgtactttgggccaggttacaaatagaatctttaacttccttattaggagtatgagttttagagaactgaaaacaaatacgtttgtttaatattttgtgccagttttattatagaggggataattttataaatttgcaaagtaaatgcttcagtaaatgaaaggaaattaaaacaaggcacatcttattctctaaattccttcaaacagaaatcctttcattttctttattttatttgccgagtattttgagaagttatttcagtaggacaaaaaagatgagagaaattgtgtgaaaataatagtattgcggaagtttaatttatttagtgtctcttctcctgagggtttaagagaagaaatatggtttcttctcttgttatgctgttaaaaaaatttgcagttacctcaaatatcagattaaaatctgtatttggtatctttagattctactcctgaaaagcaagatccttgtaaagaacctctaaaactggaaagatgtgattatgctgatggcttatttgacttgatattgaggcattcatcttctaaaccttggcctttcttaagtcaaaccatattactctgagccgctgcaacttataaagcatggcttccaggctaaggtgtttaaaccaaagaggctaacagcacaccaaaagttctaaacaatagtggatatttattgatcactttctctgtacatggctccctgccaagtgctgtgaaggataaaaagacgcagcacatttgattctctttaggaacttattgtctcgtggaacaattattgtttgcatgtaaacagctgagtgtccaggatactgaactactctctgcccctaaacacaacacacttcctttcatagccaaatattttgacatgtttctctcattggaatgcactacttcatccagtatctcttccgtgcccccttctcctgactcgcctggtccagaaatctcagtctgataatgccttctctgggaatattgtcctaaatgtccaaagttgggttaggtgtctttcattcttaacttcattccataaatatttcaatagttaacatttattttcacccatagtcccaagtacattaacatatgtagcattctcaaactcatgagatactttccttcccacttttcagataagtaaactgaagcaccaggaagtgtggtgactggtgcagggactaccagtaggaagtggtggaactggagcttgaactcaggtttctctctcaagcatgcacacttcctatagagggtgctaccttgctggtgcaattaataagaattataaagattaaaagagaggaggtgaaattttcattatttatagatgaaagccatacaaattaacaagctactaaaacaaatgggagagctcagaaaagttgccagaccaaagatttttaaaaatcaataacatttttcaatagtaaataaagcattagctaacataacacaacagtaaaacaaaccagcaacacaaccttccccagtaggagcacgcttgctgcaattaaatatggtttatttgaggattgtctggatggctcaacatcagaaaatctatcaaaataatcttaaggatataggaaaagttagtgtcaagttctgagaagaataaaaatagattggattttccaaaactgactaaagtatatctatgaaaaatctatagtaaacaacaaatttaatacagggctcagaaaaacattttttgttttacattttgggagacgatgaggatgccagtgttggcacaactattcagtaaagtgatgaagacaaaaataataatcaccattcatttgtattgagtgtttacctatgtgccaagcagtataaaagcaaaagtggtggattagccattggtgcaaggagatggtgaaactcccatcttcctactcctccaaggtagaggtgataattgaactacagtgagccaggatgaaatggagttgtcacagaaaattgtaactaggatgcttaatttattgttctgacccagaatgtagctatttggacataatggaatggagcaaattacaatatagtagaatttgggtggtaccaatgatggtgtaggatagttagatctaagctgtgagatgaaaaaatccctcaatgtctactagtaactgcgctttagatatagtcaatacatatggaggtgcaagccccaaacatactgttatcatggattttatggatgaagcagagcccttttgaaattgaagttaatatggagaagcagcacaatgcatagcatatgctttgtgctatggtaactgaatgaacttctggtgaagaattaaaggagggatccaaaacacattgctaaatttcaatttaacctctttatgtaaaattgaacaatacatttaatttctctgcacttattattctcttcttgaaaattaagataattagaccagagaaaatccctttggtgttgaatctggtggttcaggaaaccaacataacatggatggattctatcatatgctgagattttcaacctgtcatctttatagatgttacttaggcactggaagggactttagacacctccagtctaatctccgtattttaaagacaaggtaactgacacttaaagacataaagtaccttgctagtgtcacatagctgtttaaaggcagaatcaagcctagggtccaagtctctagaccccagtccattccatggttctggtaagattaggaaagctccacatttcatcaagaagttctcaatctcaattttacatgaactatagttttggaaattgtaatatgttaatgatgaatagatgggaatgatggtagtctgtatggagtataataaaagaatagatgaacacttccaccattatttacacaacacatccaaagagattccacagtgtgcgtgtgtgtatatatacacaccatatatatatatacacacacaccatctatatatatacatatatataaacacatatatatacacatacacaatgaaatactattcagccataaaaatattaaaatcacgtcttttgcagcaacatgacggaattggaggccattatctcaagtgaaacaaatcaaaacagaaagtcaaatgtggtatattgtcacttagaagtgggggctaagtgatgtgtacacatggacatagaatgtggaataatagtcattggagaatccaaaaggtttggaggatggaaagaggttgagggatgagagattacttaattgtacaatgtacattattctggtgatggttacactaatagcccagactttacctctatgcagtatagccatgtaacaaaactgcctttgtatgccttacattttatttttttaaatgaatgttgtggtcccaccacatggaccacatttaatgttagtttcctagaagtatgttttataactgaatagagataattttctatattgtattccaacccggatgatatacatatatattcggtaagatttttcaattttctttgttctcactctgtatttatcaaaaattaattttatgaataatttggtcatgtaagttaataatgcaggcttagttactcagggattgctctggagcaagaaaaaagttactcacttctaccttctgtaccccttcatctttcactctgccactgccaataaaaccctccaaagaaatccgacatcttagactacaaaaaatgcagccatcttgggaaacctgtagcaagtacacccagcagaaagggtcaaaatcttaaagattgtgacaaatctgtaatcccacagaagggatgaggcatgccaagtgtttgatgtctacaaaaaccattttccttagacaaaagctgaaaggcataggagaagtaatataaagcagaaaaaatgaaaagcaaaaattataaagaagacaagaatggcaatctatttataataatagttttgataacaaccatttagataagaatagttaatgaggccagtgaaagaggagataaagtactaaaacggactattctcctattgtgaggacaggatctctgttagctctgtctcagataatttgtacagcccaagtggagaaggaagaaccagcagtgctataaaagataagttctgctgtccaatctagggagaaaaaagcaaccacattgaccacattagagctcaggagtccaaacactgctagttgccaaataaactttattaatagagacgacctcccccttagcagttttataagcactattgcttttttatatagacttgagaaggttagtttacttgtcagaaagtaggccagaaagcaatgttttagaaacaagacgtttgggactgctacagagatccaatgctcaggctaaatcacgtgatacatttcatgtgaagctaagtatttggaacaagagatgccagaggtctaatcagcaagaataataaacaattagaagaatggcagccaagcctagagaaactgtctggagaaagagtactggaggatttgtggtctaatgtgcatttgtgcttagtaaaagattagctgttcctagatttttaaatttaattttaagtgttattcctgaggattatggtaatcgcatctctttgcttctataagggattggtgagaagcagtagcaatatttgaatccagttatttgtgagtgggagatgtactatatcattaggtgtcattttcaccgaatacgttattatcagcaggtaataagaaatgtgcatcattacaaattctcatctggtattttgtgctcaaacagacaaggtatgtcttctgtggcagcactgagtgatcacatagagactggtgtcaaaaaatggctcttataaattacaggatacattttaatagttaaacaattatctaaagaggcaccactggaaaattgtttagtaacaattggctgatttttatgatgaaggataattcaattaaaaaaattatttacagcctcctttggttcagaaactgtgccatgctttgggcattctaaatgaattttgtcttccaggagttcatcttctaagcagctttatggagaatgtcatagttttttcccaaattttcttcatatatgattagacaaaatatttaaatctgtgctacataatattttgtggtattttgattttaattttatgagtggataatacattaccatggtttaaacttcaaaagtttcaaagcgctttccaattcccttctatagatgcaaccagtgctatcattttctagtgtatgtccttgcaaatgttttgtgcagacacacaaaaatgcacgtatatatttaaccatccccctttctgaaaacaaatacacactgtcgagttacctttttctttttactttaaaaatacaccttggatatatgttcatgctaatattaaaaaaaacttcccattcttttctatggatgtataatattacattgcatgcatgtattataatttacttaagcagtaccctactgatggacatttaggttttttccattcttttgctattacaggaaatattcacatgagtaatttcaacactgatattctaaagtgagctagagtgactgcattcctgtttcccagcccatattccatagaacacaagtctcatgagatgttcaatatccaaaagggttctatagttaaataactttgattaactctgggtatttgttgatgtttatagtgcatactgtcaaattaaaagaaatcttgcaataatctgcttcgatgtaatccaagtgtttcctgacctcacattttctcaaggaatggaatacactattgttttaggtcaggttcttgggaagcagactgagatggaaatatacatgcgagaggcttactggggcatgttctaaagaacaacacctgatggaagtaagggcagatcaaaacagggtgggcagagggagaagttggactgtgatgcagttggaacagtggcctcactggatccaacagggagccctctagaggcaggatggccctttggggatgttacagctctggaagggaagcaggccagattcctggaagggaagcaggccagattcctggaagggagagctttcttccattgaaagcatttatcaggaggggctcagctatgagctgtcagctggaacaatgaatttcattgttcactacaactctgtatagaatcttcaaatttttaaaggaaatgcttatcagttcctagagtgtcttgctggtcagagcaagtcacttggtctccagggactcagtttcttgctgtatgaaatatggatgctgagctgaaagttctttagagtttataacattctttgcatctatttccatttcagtatgtgctaattgaattccaaggtcagacataagttttccccaagacatacttggccatatagaggcctatgatgtggatagataagctctaactttttaatatttctgctgtgcagttatggaaaaaaagtgcattgttataatgctttcaagtatgtgttacttaacttggggcagactcttggggcgaaggtgcataagagctgaattagagctttttattaaaatataaaaatatatttttaaaatattttggttacctcttgttgggtgtttgctggagaagctggcttgctatcttcctaggaacattggcccatattgataaaattgaagaaatatactggcatagggtgtaaaagagagaggagcataactggctttaaagcacattcttaggagctcttatttattctccttttagaagctcaggaagcaaacaggtatagacaaacagctatagcaatttctcagggaccttccatttgggaatcagatgggtctaaatgcccatcctatgtcatttatggtacttgtgaatttcattctcatgctcctgcaggattcatcaattgtggttgttattgatggaagcttgtttcctggtaggagtggggaaagggctcagggaatgggcctctcttaagtgtgcctggtagagttaatgaaggttcataaagaggatggaaaacatatccaagaaaaagaaaatgttctttaagataaggaaatgggaagtgaaatcaaatttaaggcggtattatacaaacatgatgcagagaaaaaagcaaaaagaaaaaaaaaaacaattctaagattggtggctgtatgggtgtaagatcaacttttaaactgaatgtaagtttttctaaaaaaccttaatctttttcttcaacacaaagcttcatgcggattcttggatcatactgaaatttgattaagatgtttcttaatttattttataaaataaaagttatactactttacttttttaaatggcataataagttggattacccttataaaaaaacatagaagttacactgtttttaggttttctaattaaataatctgttgccatatttatacccccgaatcacatataccttaaaatattatactatattatgatgttgtgttttactacttcgtatttgagtggagactttgccacttcacttttagaataaacgtttacaacttattttcaacaccttcttcagacttggtcaataacttaatatcaaacacacaaatacacttgacatcatgtgtgctttgtgatattttgtgataaagagaaagacaatttactagagagctatatgaagcattataggttttaaaaaatgatatatgatttttttctccaaaatgatgtagctttagtcagcaaggacatgagttaaattatggggaactctgaggattgtagaaaagatttccccaagaagttcagtcttgacttatgcagttttctccatatgagtcttcctgtttttttatagcatgatcaggtatgtaggtaaccataaatctgaggaagggaggattactcaatacataattattaatcctcttatccgtacctttgactcttacagaatccattccaatatatggccatgtggctctttggagcaatgttccatcatgttccatgctgctgacgtcacatggagcacagaaatcaatgttagcagatagccagcccatacaagatcgtgtaagtaaagttttaaaagttttatcatgcaatacagatacttttatataatagcataactaataataaggaaaatgtggcaaaacaggtgaagttatatatactcacagcttttaaaatgagcatcttggtttaaaaaatataccctttgttattgcatgcttaaagcatatatttgaaggcacagaatattgcacataattttttttctgaaaagagccacttagtaaatattataggctttgagagtcaaatgctcactgtcacaatgagtcaactctgccctattacctgaaagaagcaataatcgtgtaggtgtatggctatgtcccaccagaagtatttacaaaaacaggcggctgatgagggttggcctctgggtcatagtttgatagtttgtcaattctaggcatataaaatgacagaattgtgcatatcactttctgtatattactgggttaattttgaaagaacttgcgtgcttaaaattaaataataagtgtaatcaaactatctaatttttgaatgagtttatgtaaggatattagaagataatgtagattagattttttaaatgactgagtcttttaaggagtattttagaaaaatgtaaggtcaagttcagtctcgataactaaacaaaatatagtaaggtataacttgatgatggagatatgttctaagaaatgcattgttacacaattctgttgtgggaacatcctaggctgcactgacacaaactgagatggtatagcctatacatgcctagtctatatggtatagccagttggttctaagctacaaacctgtacagcatgttactgtactgaatactgtaggcaattgtaacacaatgataagtatttgtgtatctaaacacagaaaagatacagtaaaaatataatataaaagataaaaaattatatcctgcataggccccttaagatggataaattttacaatactggaagctgctctggttgattcaatgagtgagtggtgggggaatgtgaaagcctaggacattacttcacactactgtaaactgtataaacactgtacacttaggtcctacaaaatttattaaaatatttttcttcttttaataataaattaactttagattattataattttttaaagttaagaaacaaacattttctttaactttttgacttttgtaataacacaacttaaagcacaaacatattatacagctgtacaaaaatgtttctctttacatccttattctgtaagctttttttctgtttttaaaaatttttaatttttactttttaaatttttttattaaaaactaagacataaactcacacattagcctaggtctacacagagtcaggatcatcaacatcactgtctttctcctccacgtcctatctcactggaaggtctccaggggcagtaacacacatggagctgttatctcctatgatgtcaatgccctcttctggaatatctctgaaaggtactacctgaggctgttttacagttaacttttaagaaaatataagtaaaaggagtacaccatacaataatgataaaaagtatagtataataaatacataaaccagcaacatagttataatcaagtattatgtactgcatataattttatgttatacttttatatgactggcagcacagtaagtgtgtttccaccagcatcaccataaattgaacaatgcactgtgttacgacattatgacgtcgatgtggtttggatttgtgtctccattgttggaggagggggcctggtgggaggtaatcagatcatggggcaaacttcccccttgctgttctcatgatagtgagttctcacgagatttggttgtttaaaagtgtgtagcacctccccctgctctcttttcctcctgctctggccatgtaacacatgcctgcttccacttcatcttctgccatgattttgtttcctgaggcctccccagtcatgcttcctgtataacctgcagaactgtgagtcaattaaacatttttttctttataaattacccagtctcaggtagttttttatagcagtgcgagaatggactaatacagacatctttgtcaccagctgctaggaattttcagctccactataatcttatgggaccacctcattgtatatgcagtatgtcattgactgaaacttcattatggggcgtgtgactttaaagccacagaaataaatccaagcatctggcttcttactggtaaagtgaatatatacatttcattttcactttcagttataatttctaattaacactctcagatagaattctgtagcatgtatactagatcaagataaacagtagaataagtaaaggactttaaggaaattgaaacattttataagaactccaagaggaaaaaggcagtttatttttccatcatttttagtatgagaaaataaaataaatataaattcaaagaaaaaacacggaaatcatgctctttgacagtcattatttataaactgaaacttaccccttaacttcataaacttcctagaaattattgtttcttggaatttttttttttttttgagacagagtcttgctgtgttgcccaggctggagtgcagtggtgcgatctcggctcactgcaagctccgcctcccgggttcaagccattctcctgcctcagcctcctgagtagctgggactacaggcgcctgccaccgcgcctggctaattttttttgtatttttagtagagacggggtttcaccatggtctcgatctcctgaccttgtgatccacctgcctcggcctcccaaagtgctgggattacaggcgtgagccactgtccccggcctgttttttggaatttttattaagaattccccaaactcaagaacaagtttcctggtgtctttttttttttttggagacggagtcttgcttgtttgcccaggctggaatgcaatggcgtgatcttggctcactgcaacctttgccccttgggttcaagcaattctgctgcctcagcctcctgagtagctgtgattacaggcacatgccaccatgcccagctaatttttgtatttttagtagagacggagtttcaccatgttggtcaggctggtctcgaactcctgaccttgtgatttgcccacctcggcctcccgaagtgctgagattacaggcatgagccactgcacctggccagtgtcttattgatacacacagattaggtattgctaccattgaggggttaaaaaagaagcagggggaaattttgagtattgagtgataatatttgagacatttttagtaatagcaatgtggttgtgaagtgtcttgtcactgagatattgatggaaatgaataaacattctttttaaaaaaatttattctgatcaattctgtggcaaataagctatggcaggggaattttgcttaaatgaaatcatgcttgaaatatgcaagagatttaaacagggatctcccctagtatatgagtagtaaataagtgttttgaagtcataagaagagtgtcgtgtgccttctgtttttctttttatgaattctgtttgattcctacattttttaggttcagcttcctttgttgggatacttaaaaacaggtacattttgattgcttatttcttggtggccagtgatagttattcatgtcaggatttaggtggaattaaagacctcaagtatctctttcaatttgcacagtaaaacaggcaagtaagtgtaatttgttccttggtgagctctgctcttactgtaacaagaacccagaaaggcactatttgtatcagttaatcccttgaaggtagcttttattttggatagtcaactggggaatgtaatgggctccatgctaaagaaactttcactgtgaaacatttctgccaaccgaatctcacttgtagtctttatcatgatttctttgctataatttttacattctgaaaataaatgcatttataaagcagaatttgggtataaactaagttactaggaacctcaccagtgcatgctttcactcaaggcccctcctcttttattttagctagggatgcagcttacaagcttgggtggccttgagtcaccacttttaactcaatttagttaaagcttttaattttgtttcttattatctctttgattatcagggtattatgcgctcattatagaagagtgaaaactacagaaaagtttaaagtggggaaaatatcaccaggtgccgtaattactagaaggcaactaaacacatgactgttaacacggttattttgtttacgtggttgttataaaaaagattgaaaagttgcgttctggttttgcttgtttaccaggaaattgtgacatttctctgtgacattacataagtaaacattattttaatgtgtatataatactctaaagtaggttccaacccatcattcctttctctaattgttgattattataaatagcacttcagtgattatatttttgaataaattttgtccaaatttatgataattcattaggtacatttcctaggaagggaactaagatgtctaaagtataaatattttaatggtgctcttatcccaaaaatgatgtacaaatttacacttttgtcatccctacaccttcatcatctctatgtgagtcttggtgatactgcatcctcaccagtgctgatgtttcacaatcctttctagttctatgaagaatagggcagcagtttatgccaaatgtaattctcttggaaaccacagagaaaattatgagaatggcattgaagggaatcccacaaactaggtcaagcaaaacccagagacagtgagtaaccataaaatccagaacgtgttactgtagataggcaaaagcaactgaaattagcagaatttgtgcaggaaatactgccaggaagaatgagagtgtggaggagccacagagtgatagcaggtgttgatgactgtcatcaggtaagtattctaagaaggaaagagccctgttttgagtgggagctaaactcaaatagggagtcattcctgggagaataggagaaagatgtttttgttcccataagaggcagatctcagaaagcacatcttttaaaaaggagagaaatgcattggaaggaaggggttgtatcccttggtggcagtatctagtgaggaagctggaggagctcagagatggtgcacgtgccattcctcgtaagatccaatggacttcacaaggtgcatcctgacaggcagagtcggattcctgcctgcactgtgcacttagtgcctgggatttttctccttgtatggagatgcggacaagttaacagcctgtgtggctcatctttgaccaatgggatacaaaagttggcaacacattcttccccttttctctgcctgggtgtgacctcttgaagtacagtttgtgtaccgctgtgcacttagaaatggcgagctctgttgcactcccttatattggctccctccgccctccatttctgttttttgttattgttgttgttgctattatttcttctccttattttcacttctttctgctttcctggaatcatacccctcaataaaatacttttttctgtgtctcatgatgatgtcttacccgtcatacctttattgtttttctgatttctattgggatttctttactgttccatggattatttaaaaatgtattgcttaattttcaagcaattgaagattccctagttgtctttttcgtttttagatttcacagccagatttctttcagagaataaaacattgagtacttttagtccttttagttttgtcatgacttgccttaggcccaacatatggttaattttggcaaatgttccaagaggacctaacaaaagtaagttttgccattgagtacaatgcaccttagagaacaggtaggtcaagtttattgttttttccacatctactctgtccttgttgactttttcttttactgtgtattctatcagcttttgaaagagatgtttttaaattacccgcaatgacggtgaatttgcctataagccttaaagctgtgattttagaagactatagattttggaatgtgagaccttcctggtagtttgaccttttcatagttaagaaatgcacaccatcatctttgtaataaggctacctgcgttaaagtctgctttgttattaatatagctacctcagcttatttcatttaatattgcatgatatatattttctcatccatttactttcagcctgtttttgtctctgtgttatgtatgtgcatctcttgtaaacagcatgtagctgtgttctttgttactgttttgaattcagcctgacaatcttagtcttttacggagtatttagttcatttttatttaatgtaattaccgatgtatttgtgtttgtattcatcaacctattttttttctgtttgactcagtttttatgtagctttttcttcctttgttgttattacttagctatttcaacatgcatcctttgcatattacattctatctaatgacttgttttaagaagagataattgcagtttgatttaaacccttaaagaagaataaaaacttcaaattgtttccatgaagtgagaatgccactgatatctaagtttgataaaaatttcacaaaaaaactatttcccaattttatttatgaatatcagtgcaaaactcttcatattattggcagaaaaaaaatccagcaactcattaaaaaagtaatcattaaaaaagtaactcattaaaaaaataatatcatgatcaagtagggttcattctaggaatgaaagattgtgaactctattaaaataatttatcatattaattggtctaaaaatcatatgttaatttctatagatgctgaatatttatttgacaaaattcaacagccattgtggatattttttaaaaagacaactcaataaaataagagttaaaacattttataaacaaggtgaactgacaaactatttatgctataggggcagaaattgggtgatccctttcttccccattataaaggtcacagcctacacacccttataacgaaagacagattaacaagagaaatgcatagcacatttatttgatcatagttttatgtgacacagaagccttcaaaaatgaagactcaaagactcagggtaaactatccattttcatactggtctttttggaatgtttatggagacttcattagctaggcatgattgaagcataaatggccaatgtagaactgtgcttggcaaaaacggcatgatctaatgttaatagacctggtagggaaatctcaacaaggcctgttcagattcttcttgccctatctatgcagcattccttcctcccaggtatgggatatggcccatctggaatgaagtcttaatttctttttggccaactgttacatggaaaggtcggggaagttgagagtaatatttttaggttttatgcctggctttggtgaaaaggggttctggctcctatgacctgccttgaggaagagggcttctagtttccgcagctctccttggggaagaatgaggctaggggaagaatgaggctgagaggagagagtaggaggtcagagagaaacttgcttctgagactgcttctgaggccttcattttgaaatataattttttgagccctgagaatgcacacaaacaaacagaaacacacagcacacaaacacacaatcttgtctcaaagccattttgtaatgaataacaaaacactagaggcatttctgcttattctgttaaaagtataaatcagataaggatgcacaattctcaaccctgctactgatgctgtaccagagattttagccaacaaagcagatacaagagacaaatgaagtcttaagctctaagacctaagcaggtggaagtaaaacctttatgtttctgtgacttaatatttcaaaaacccccaaataacctgtgagagtttctaaccattactcaattccagcatctaaaataggaaaaacagagataaatctgactcattaaaaaaattctttggtgggcaaaacacacacacacacacacacacacacacacacacacacacacacacacaaaaccaacaacaaaaaaaccctctggggaaattcaaaagaatgataaactgggaaaaatatttacttctccaatcaccaagcattttccccctaatatattaagaacttttagaaactggggcgtgtggggaagtacaagctatagagctgttggcaaagaacataaatgaacagtttatataaaaagaattgcaaatagcatttcagctcataaaaaagatattcagccccacataagacaccagttgttatttgattttatttaagaaatgagagaatataagtatatatttctaaatttgcttgcgttttataaagaaactttcaaggaagcacaagaatgaatagaaatggttgcctacagagaccagagtggagggacaacaaatagggtgaatgggacaggaattgaagcctaattcttacatacatactttctcatattgtttcattttttagccatgtgaatatattacttttatagaaaaatatataaaaatacaaatttgcaattcctttatttaaggtgaaaaatttcacctcttttgattactgtgtaagttgagttctttaaagtgttcatgtgctatttgtattttcatttcttaaaattatctgttcaagttctttatatttagagatatttttgttttgttgtttttttaaccaaactttataattccttaatatgttaaggaaccagtacattttatcatttttatttcaccttttaaaagtctggttatcctatcattttgtttattatacattaacttagagaaattaataattcttattttgtcagatctatcaatcttcctgtgttgactttttaagaaacattactatattttatttttgaaatgacacccaaatgctaaacgtttaataagaatcatatcaattttaaggaaattgattatcactggctgacctttcacttcaaactgccctctttttaataaaagcataaaacatttcaaagggatcatgacagtgtattttattttatgacctagtatttattttaatatatactaggtctagttcctctttattccttttctatttaaaaattattttcaccagtagatgtttttggatgaacttacggatcatagtgtcaagttcgcttcttatgtcaattcttatatgtcaatttcacttccaaatttcttatgaaataatttggaaaaatgatatttctgtaatatatagtttccatctaggaataaagtatgcttctcagattgtataattgttctttttgcctttcaatctagttttattgatttctttatatatttccatacattaccatattcattcctaactatggtataattttgttgctaacgtggattaggtaatttcccctacatattgatgagacatggaatgatgaatataagagttgttgatattatgatgtatatattttggtttctgtccatggtttctgtctcataactcccatagaccttgttatttcctaggtgactaaaacaataagtatatgtcttttgttaaagtatttagtcttttgttcttggtttctgaagcagcttccaaacagcttttaagtaataaaggtgaaagacagccttttgtcataatgttggggctctttagggctcagaagcaggactcagaaaacagaatctctctcagactcatcctttttatttattatttatttatttatttatttatttatttatttatttatttatttattttttgagacggagtctcgctctgtcgcccaggctggagtgcagtggcacgatctcggctcactgcaagctccgcctcccgggttgacgccattctcctgcctcagcctcccgagtagctgggactacaggcgcccaccactaggtccccgggcgtggtggctcacgcctgtaatcccagcactttggaaagccgaggcggtcggatcacgaggtcaggagatcgctccccaccttttaatttaaaattttcaattttataagacagggtctcactctctcagccagcctggagggcggtggcacaatcttggcccagtgcagccttgacctccgggactcaggtgatcctcccatctcaacctcctgagtagctggagctacaggtgcacaccaccctgcctggctaattttttgtgttcttttgtaaagatttagtttcaccatgttacctatgctggtctcaagctatctatctatctcagcctcccaaagtgctgggattacaggcgtgacccaccccacctggcccttctgcttccccccacttttttttttaactttctcctttttctccccaaggaaggccatagaaactaaaaatatactctcatcttcccccctttgtgtcttggagctggccgtgaagaaattgtctgattgtaagtcataagatccccatttctgaaggggtcctgcaccatacccaggaagaaggaatgctgcacagagaggccaagaaaaatctaaacagtccttgctgggttgccccactcagcctattcatattaggtcatactctctttgtccagtcatatttttacatgattgtccatgcttcaatcattcctatccaatgaattttccataagaggcccagaaagatagaatatgggagctcctgaacagctgaacttgtggaagcttgcagaaaggtgaagaagaactcatccacgtgcgggtgggtggcacatcccatttacacaggaatggaagtgcttgtgctcaggaccctttagacctcaccctatgcatctcttcatctgactgtttatttgtatttttaaaaatatcctttataataaagttgtaaatgtatttctctgaattatgtgagccagcctaacaaattaatcaaacccaaggaccgggctgtgggaactctgatttataactgatcggttagaagcccaggcaaaataacctggggcttgtgggaactgagcctccaacctgtgtgatctgatgctgtctccaggtagatagtgtcaggatgctatttccaggtagagagttgggtgtccactgcagaactgattgcttgcttgttggttaggagaaatccccacaaacttggtcacagaagttttctgtattgattgttgtggtgtgagagtagagaaaaaactgtttttccacccagcacctatggtttaattcatacctttttttttcactctgtatgccacttactttaaaaaaataaaaatgtgagtgtcttgtctggccagcaagattaagaaataagtttgtcttctgctttccggggctctgtttattcagttataggaaggaagggtagagttgaatcaaatattaattcttaaaacatcttttggttttttatttcttttataatgtgaggtaatgcggggtgtatttatttttttcttggtatcctaatgtatataatactttgaaagttgtcggaaccctctatggattagacatacatgcatagataaataagcatgaacatcactgtcgtcatctaccattagtgagcttatttatttaattctttctcttattttaattttctggtacaataggttaatattctgtgaaaaccaacctgacattcttaaccttttcatgggacattaaactttgactactgtcacagttagtaaagttccctttacagaaatttaatttgtgcattaaaatgtatgtatacaattatcttttattaacacattttacagttgtgattaaatcactgtataattttattaaaacatatgaaatgattgattttgagatagagataatacatagtgccacatatggcgggaaatacacgcacatccttgttcagaagtattttctttaggatggaaggccctttgagagagacactgcagctctcctgtgcctcagcctacctccctgggccaggtgtctctgatgtggtgggttcagcttcctttatgccacttggccactgcctcttcagtgcaagcctctgactctctcctcagctatcttccatgctccctgtgggttttggcagaaacttctggattccttccagagaagaagcttagatgagtgaactcagtctttctctctgcctacctagttttcacctttgttgtcacatttggtcgtttcttgagtgagactacccttcatgttggtatctgtcaggagtttggctgggttgttggggactaagcatgccaccaaatccactctcaatcccctactggtgtgtcagtactggatgagaatttagctcacataggtcttcctcttccttttttctctttgccttcccacccactagctgatatgccaacttgcatcacatcctttttctcctaagggcaacctcctgtttagcctccattgacaaatcatatttccattctctaccatggtagaaactcaatttagaccaactttcattttcatgattgaagccttaggaaagctagacaatagggatttacaaacaggagattacactggtttattctaagaggagcctaacttcgtgctaaaaacgtgaatgcaagacaggctgcctagtttcttgttctgggctgtcacttactagatgtgtcactttaggtaaataatgtaatttcttttttcctcagatttgtcatcttaatggcaatctgttacaacaactttataagaaagggattattttatcatcattttatgatgataatttaaatgtcatttaaaatgatgacaaaatagtccctttcttaaaaagttgctgtaacaaaaaattagttaagaacctaaaatagtaactgaaaagtaataaatatttggtatctgttagctaataccaaatattaggaggctaaatgaaaaatgtaaagttggaaatgcaggtgcctaattaagtgagactttgaaagtgcctggaatttagacacacaatgtagcaagcaacaagaagccttgaaataatttgagtggttgtgtggtgaaagtagtgttgacttaaattagttcattaggagtatattaagagtgagacagcgattgtatttacaggacttcagcctcaaggtgatgaaggcctagactaagttgttgcaaatagcagtggtgataaaagaaaacagaggagattatcagggatcagagagaggtgtgggcccagggtgtttctgagccaaggataatggctgcatcatgtagaatttagcagaaatagagagttaaaagaagagaatgttgtctgggtagaaaaattttgattttagatttattaagtttgaggcaataataggctattcaagtggaagtatcccaggggacagggattggcaaactttttctgtaaaatgccagatggaaaatatttcggtctttgtggaccagatgtggtctctgtcacatcttattctttgtatttttttttttaactattcttttaatatatatttaaaatgcaaaaatgtaggacaccaaaaaaagctgcaatctaacttggctcatgacagagccttgactgagatattgggtctagaaatctagattaatgttcaccgtgtggataatttgaaaactcttgagtaagcatagatgtacagtattctaattaagatagattattattgtaaattatataaatatttacattgaaagtgttttgcccagaaatagattttaccttattttttctgagccctgtaaagttactaaggacttccgtcaactagatataaaaatagattcaataaaattaataaaatttttcaaatgttgattaggatttaagaaaaatagtttcagaaaatttctaatttcataattctgtggaaattaatgcaaaataatgtttggcttactggatgtcacagaggctaaaagtaatctttagtttatgagagtatcatgatacatgatagaataagacaggctataagaattgtagccagctgtgctggcatcaaggaattagaatatttatgctttaactatgggattaaagggggttatagcctttcaaaattgacttaaataaaggcactatagatagaattaaataaaaacaatatgagttccttacttctgtccaaattaaccaaatgaatggcacaaactgaagaagtctcttaaactaaccataattaatgagtttatttattcccttaattcaagtagatcactagagtttaagtctattttcctaatggaatgttattgattttaagtttaaccaacatgttttgctttttacaacagatttatagaaatattcaatatttttactagtacaacctagaaattattttacttctttatttaagatgatatgtttcagataaacttttgaaatctatagagtattactttcatatatgtaaatgcagagtgcagattacagaaattagttttagattcaacattatgtcgaagttccagtacctttatacttgaagtgtttgagagaaacattggcaaattggagcttacatagaaagacacattcaggaatataacatatctaagtactaattcaagtgaaaaatagctaaaacaactagtatggagaagaaagacgttggagggtctgggctcatgtatgcattgcacaatggggtgagttgtgtatatatcacagttgtcttaaatatttaaaatggcagaagaaggagcagactcatttatctatccattcatccatccgtctaacaattcacccatcatttcatgtagaaatagccttctatatgctagtcttaatgtatatactagagacagaaagatgagtaatataacccctacgtaaagaagctcatagactaatgaggaatctcatattttgtgggaacacttattacttaggtaaaccattagctttcatttcctcctctctaagtccagataataataataatacataactcagagggttatctatgggggaaaatgaaattgtgaaaagtactacaaaaatgctatagaatgttagatgacatattattgactgagggatttctggataagagattactaactcatgttttctgaatctcgtgatttaaaattttgtagtaaattagttatgtgttgtgtgataaaccatataaaatttagtgtcttaaaatcacaacactttattgtttctcattgttttactggttgactgagtgattttctccctggtcttgtttgggctcattcgatatctcctcactcacctgtctggtgcctcggtgatggctgttgtgtgagccgctttcatcatgcagtttcttcattaggtagtccagctggattttcttacatgacagcagaaacagtcaaagatgtaacaacagaatggcaaggcctcttgggacctagagttggaagtcacacattatttttgccatatcctgttggtcataactagttataaagacataggacataaatcgtagctaggacataaatcatagctagcccagatttaaggggagggaagagagactccacctttcaatgggagaagtggcaaattcacactggagaagggtgcatgggatggaagagactgttgtggccatctttgcaaactatctaccacatatacacatggcaggtttttatttcccatttggtaaagtataagtagtctatttttctgtgtacagtggctaacagttgtacttattttgttgtgtgtgtttcaatcatcattactagcaaggaataatagtatgaaaaggcacagtttgagtccttctatatagttcatagtcattgttgtttgtaatcaaagaaatattgcagcaacttctaaccaataggttatgagtgaaggatttgtctgtctgtgaaaaaatctagtagtttgaaggttcttaattcttgttactttattattacactgtcttcatttttttagcaacaagaggtaaatttttactttactgcttaatatctgtcacttttattcctttataacaagaagataaatattttaagtcagttttcctcttatctaagtatataaccaatggttacagagcatggagttggggtgaagtgtgactttgttttctttttattttaatcaagtagtttcaatatcatttctaactagacagccttacttttcaaacaccgcaccgcaaagtattatgttgttgcattgatttatttctgttgttttgaagtctcagtgaatttataatttatatcccacactatcttgagggtatgtgtgctaaagcagaaaacacaaacttgtccattttggtaaaataagggtattctaaacttttgagagttgcaagaatcctactttgaaaaatattcagtctccagatgaactgtagactttaaatacgtaaaagcattataacaaagaaaaacataccagtttatagccaatgacgtatgttgatcgtagactctagctataggaatgcctttcattttcttgaaaatacaagacagtttcttatcttttgacttatagatatgttgccctctcaggttgaagcgcaccctactattcttttgatgagtgtctccctacctgtaagtcccagtttccatgtcacttcctccacaaagtcttctggccaggcacctctcttgcatgtttgcatagcaccctccgctaatgcctcccagtatcatgtagctgctgtgagcttttctttcttcctcactagactatgagctcaataaggagaggcgtgatgctgactttgaccatgtttataccttcacttcttagcacagcagttagaacattgtaatgggcaactgatatttgttaaatgaattaatttggggtagaatgtaataaaatttcccactttagcattttcattcagataaaagtacaatagaaaatctcatttttgaatcaggactcataattgtttggcattgaaatagaaaaaacatacaatgacctatcttttcattgtgtacaacagatcaaacattctgctttgtaagtatctaaatagtctctcattaaatggttctttatatgatcaaggatatgatttttcttgatttacttttattttgtagttccctagcaaattactatgggaattaaggtcacacaaatcaaatatctcaattatgcctttggtatcttactcatcactctcctacctactttgactatatctttctgcttcttaaaattttctacagcttccttttaccctctgaaacaataatgaacatattgccccactgttctcagagcgcttggctatcagatacaaggtattcgactgtatctgcctccggaacacacgtgaaataatgtatttattactatctgaaaatatatttcaactcaccttctgtagtttgccacctttccttaatttttgtccatttatatcatacatataaactactttattcattctgacagcagtagcatagatttcattctttttaatttcattatatggtttgtttcctccaaaaacaaacattctagttttttataccatttctaatattccagcataattaatgatctgctcttttcattcaacccatatttgtactttgatatctatgaattatttggaccagctaaacaatgtaagcaaattgaacattcacagcatttgatcttttttgtctgggtcttgatatttagaaagttcagctaaagttgatattaaagtgttaaatttgcagaagtttcaggtaactcttcagttgatctttactgaaataatgaaccacagcctagagcccttgtgcttttgtatgcttactaggattccataatttttaaggatatatagttggaaattttgggaagtggggatttggtttttggtttttttattctcaactgaagtgtagcatgtatacagatcacagtgtaggatgcaaatacagatcaccagacagaaccttctgtgtgctttgtggagtcatttgattatttgtgtagtatctcacatgagacttaattttaatttaaacaaacctgtaagtctgttcaaagtacagggaaactgaggtagaagtaataccctaacaattttgcagagaatttcagaaatataaaatgtgtcaatacaaaaattagccggatgtggtggcacctgcctgtaatcccagctactcaggaggctgaggcaggagaatcgcttgaaccagggaggcggagattgcagtgagccaagatcacgccactgcactccagcctgagtgacagagaagacttcacctcaaaaaaataaaaaaaaaagaaataaaaaatctctgaagtttcataaaataaaatgtttaaaggtacagtaacagcatattaatttattgctgtatgctaaatagtgtgctaggcatattgcacacaagattatgtatgcaatatgtatgcaatgtgcctcctaaaaattgttgattatttgtattattatctctgtttttcagcagctctggaagttaaataaattaccctatgtattagttttctattgctatgtaacaaatcaccacaaacttagagaattaaaataacaccattacttatatcatagttctgtagatcagaaggccaagcaggctggactgggtgttctacttggggtctctgaaggtagaaatcaaggtgtcagccaggctgggctcttagctggcagctggaaagaattcattatcaagctcattcaggttgttggcagaattaaattccacttgaacctcgaacaacatgggtttcagctgcaggtccacttatacccattttttaaaaataattatattgggattcttttggatatttgagacaatttgaaaaaaaaaaaccagatgaacagtgtagcctagaaatactgaaaaaatcaggaaaaagttaagtgtgacactattctggagatactagtctcttttatcattaactaccataaaatatacacaaatctatcattaaaagttaaaatgtatcagaatttacacatataaacacttagagttgacagaaatgtaaacaaatatatggaggcataaaattaattgtggtacatactaaactactgtaataatgttgtaaccccctcctgttggtaatgaggtgaactccagcactataagtctctgcataaaatgctctgtgatgctaatcaacctgtgtgagcagctcatctccagtaaattgcatactgaagtaaaaagtgatctcttgcagttctcgagtatttgttatagtgtttagtgtactaccataaaccttgaataacaccctacggcccacaggaagtgtcactagtgatgctggaagtgcttccaagaaacagaaaagtcatgacattacaagaaaaagttggattgcttgatatgtaccataaaatgaggactgccactttgattgcccatcatttcaagatacatgaatccagcctaggaaaaggaaatttctgaagctgtagctgcagctacaacagcaggtgcaaaaaccttgcacattttgtgaaatacatttgtatctcatatcgaaaatgtagcttttatgtgggtacaggattgctatgagaaagtcatacctatagaccaagagacagcatactagtttcctagacaccattaaaaatcattaaatagaaaggatatctgcctgaacaggtttttaatacagacaaaagtgtctactctggggaaaaaaagccacagaagacatttattagtaaaaaatagaagccagcaccaggaattaagctggtcttttttgtctgggtcttgatatttagaaagtttttaaggcatatttagaaagtttttaaggcatatttagaaagttttaaggaattaaggcaggaagggataggctaactctactgttttgtacaaatgcagtcaggtttatgatcaacaccgccctcatctataaagctgctaatctaagagccttgaagggaaaagataaacaccagctgccagtcttttgcttttacaagacaacctggacaatgagaagccctattctgcatttgttttatcagtgctttgtcaggaggtaccttgcaagtaaaattcttttgattttggacaatgcccttggccacccagaactccatgaattcaagatcgaaggtgtctaagttgtctacttgatcccaaacacaacttctctaattcagcctctagatcaaggggtcataaggactttaaactcattacacatggtactttatggaagggattgtcagtgacatgaaagagagccctgatagaaaggacatcatgaaagtctggaaggatcacacaattgaaaatgtcgttgttattgaacaagccatgaaggccattagcccaaagcaataaattcctactggagaaaactgtccagatgttgtgcgtgacttcacaggatttatgacagagccaatcaaggaagttatggatgagattgtaggtatggcagaaaaaaaaaaaaaagatggggtaaaggatttcaggatatggatcttggggaaattcaagagctaatagaaaccacaccagaggaattaacagaagacaacttaatggagatgaatgcttttgtgccagtgccacactatgaggaagaagacatattataaaagaagcagtgccagaaaacaaattgacattagacaatctggcagaagggttattgttattcaaggctactttcaacttctttcatgtcatggacccttctatgatacaggcactgaaactaaagtgaacagtggaagaaagatgctaccacatagaaatattttaaagaaataaagaagcaaaagagtcagaagttacaatgtatttcctcaaagttacaccaagtgtgcctgcctctcctttctccccttccacctcctccacttcttctgcctctgccacctgagacagcaagaccaacctctccttttcctcctcagcttactcaatttgaagacaatgaggatgaagacctttatgatgatccacttccacttaatgaataataattatgttttctcttaggattttcttaataacatttttttctccagcttgctttattgtaagaatacagtacctactacatatgaaatacattcaaaatatgtgttaattggctgtgttatcaataaggcttctggtcaacagtaggctattagttttgggggagtcaaaacttacaggtagatttttgtctttgccggggatcagtgccccagcccgagttgttcaaggagctgtacttgcagttgtaggagtgaggtaccagttttcttgctggctgtcaacaggggctgctcaccactcctggaagctacctgtgctccttctcatgtggctcactcacttcaaaccagcaatggcatgttgaaaccttcttatgatttgagtctttctggctttcccttctcctaccagccagataaagttctctgcttttaagggcttgtatgattagattagtcaccccttctatgtaaaatctctctatgttaaggttaactatgccatgtaacatgaaacaatcacaggagtgatacgttgtcacatgcacagttagtgtgagatattctgtgggagaaggggcataattctgcttaccatatcatattgctcaaaacagtaattggcagagttagaggtcaagcctgggtttggttgaactccagagctttgtctctataccacattcatcagagggcctaattttatctgtggtgatatggaaaccagtcttagtcctatatagctaggctatgttggtcccatatgctgctataaatatattgcctcagaggtctccagcacagttttacatgcacactggtcctgtaaaataggagatccagatggtcagaaatgcatacgttaggttttgttatgccccatatatttctgtgatttgcacttgtgtttattagtttattctgccctattttattacaagctttgatttctactttctaccctttctcccttctgcttaccttatgaacgtacttaaaaaacttggttaactaagagtcaggcttattgcagtttcttttggaaattcgtagtcatatttttttttctgcttaattaaatccttttcagaggtaattgagttgagtgaccataatgtgctaagggaactgcaaaagataacaaagtcaatcaagagaaatcccttacttgatcatacaaagctatcatttaactagggaccccatggatttttctgaagcagaatatttgatctggtgcacacaatgaaaaaaaaaaaagcaaatgtgtgatttcgttgattttttttttttttttgacagagtctcactctgtcactaggctagagtgcagtggcatgatctcagctcactgcaacctctgcctcctgggttcaagtgattctcctgcctcagcctcccgagtagctgggactacaggcacgtgccaccacacccggctaatttttgtatttttagtagagacagggtttctccgtgttggccaggatggccttgatctcttgaccttgtgatccgcctgcccaggcctcccaaagtgttgggattacaggtgtgagccaccacgcccggcctcattgattttaaataacataaacaaatatatgccgtatatttcttaggttgttaagtgtaacatattttgagataactattaatttctttgttaacagcttttgaatcttgtttgcttgcctccattaagaaaatgacacagtcttctttttcctcatgactcaccaggccagagacagcctcccagattacaactagctcagtggtattaggagcagtatggattgtgtatgaaacaaagtccaacttttatttactcaatgactaagtaatttgggacaagtcactagatacagctggacctccttattctcaattataaaaataagcaagccgttccacagttctattattttaaatgacatctgctatgatatactttgcttagtatccaagaggctggaaatatttaatttattttagtttgaccactaagaaatttgttctctggatctcataaagacatggaaacattttacaggtgaatatgtgtaaatattatagtaaaattaatttgaatactcatggggcttgtcatacttaatcaagttataagattattttccttctttacacaataaaattatttctttggtttcaattttttgtatactcttgtgatctcaaaggtgttccttttattctctttcttttatttaaccagaaatatcttttattttgaatgctattttgtcataattcatgcatgattgtgcttactttaaatgggacatgattatttctgctgtctaggatacatgaccaaaatattaaaaaacagataattgcagattatggccaacatggctacacaatgtcttagaaaagttagttttgcctttctttgtgaaatatattgcatgaaacactgatgttatcattttgatggattctccccaaaattgatggcctggtttttacaagtcaaagcatctacatattttaaagtgttaaagaaaattaaatgaacagttaaattagaaatggaggatgagctataacttctcttcctagaagggaggacattatgagcaacatgcacatagggagtgatttttctggcaataaagtttggaaaatagcaaccaaaacagaacaaaactattcatgttgtcattcagtacgtagagaacaaaaagtttccactatacaagaacctatactactatatatttgcaatgatgctttaatgcaggggaaaacagctgtttatctgtttttcttttggttttattttctttttaccttgccatcctgtcagtacgtggcttcataaagctgtaggattctgatagggaaactaccgattccatgtgctttggaagccaatgtgctgattatctagcttgatagcagtattttattatagctggagggaaagtgtggctatgtttgtgagaggcaggaaggcaaatgccaccaataacgtgtccagaagtgagctatcccctgtgttttatgcacttcattctactgaatgaatattgtatcactgttttcatttttttgtttgaatatcagagacttttccaatggttctgtttctgtcgaacacttgatggaaagccctgttgtaaagcttccttcatggagatggctttatgtcttggctataaagtaaagttccataaatttgatcagaaattgtctttatgggttgccaccctgtgtgctattaaaagctcagaacctgggtgttagttttcactcagagctgtgcttgccttttgtatttggcaagtgcagctctgagttaaaacaaacactttcctttattttaccactttcttcctacagaacatctctcccaccagcctcccttttggggctcaatagtcttgttcaacccatctttactgtacactagagccaagttctttgggtgttttcctaggatatttgcaacatcaaggtcaaaatgttctttatattcaacaattcacctctttcattaccctaggtagagctcctcagaagtacttcccaccaaggagtcctcaataaatattaattatacattttggagagatttgtattgcaatgaacatgcttcagtgccagttcttccttactaaaactttttgttctccacttacattttgtggccatgtcatcctggctttgtatccttacctgctgacgtctatatattcagcccagccaatatgcatttatattctctctgtagttctgagactcattaatggtcctcttttaccttaattgagtacagtctgagagagtgcctgtcttccattattgtacatttttcttctcacagaacaccttttgattcttgctctgatctcttatataagatgcgctgtgaaacataatttccttccttcctcttttttttctaataagttggcatgtttaattaacctgtgtaaaaaaaaaaaaagagagaagacttttttaaagggtaatagaagtcatagtaatattttgctttgcctgaaaacagctttctcagtgtccaaagggattctaaactatacatgtatttcttcacatgcattatttatttaaaaataaataaataaaagggtaagtggcagtccagacaggctgcttcactgtgtcttgatgcctcatgatagcacaggttctagaatgccatgagtgggaaaacaatttctttcatcttttctgataatgttgtttgcatgatgtaaatattcagttctagcatgacagtgggtacctgagggaatttaaagtgaaataacaggattgttaacaaattttcattcccatataatttatgtttcatatatttctactggaaaactaagaaaaaattttttcccaaaggcaattattttgcaaggcctttttaccctattataagactttcttttcagttaataacccaaagtgtctcttcagatgcttaagtcaagtcgttaattggcttgactaagtggttgttggtgcagaaagcttattctctccgttggttgtatataactcacagacattaaatgacccactttgttgttcctaaggcaaagaatcattattttctttcggcagtatactgtggacttttaattcacaaacttatagctcaggttgaagtaatttctgctgagaagtgatttttctaaacaattgtttaatggttttgatttggagtaaacattagatgcaacttttgagctagtatactctactgtagagatcattaatgtaaccttttgtttttgtagcgtgcctgtctcccttcaaaaattgtttattctaaactgtgatcttttttctaaagatttgtttaaagttaacaaggtaagtataaccattaagttcacatataaatgattaatacacaaatattcagctttgttctctgcataaatatctacctctccttaaattaaaatttgtaattgttgaaagaaaatttgaatagtaggaaaattttacttaatgatgtctaactgtgaatttgctttgctgagtgggaaatagtgatcattgaatctcataaataactttacctagagttacataaaccttttgaccaaaattatttaaagaataaagtactagctagaatatatctgtcagaaagtcactactacttacttctgcatgtccataacacacataagtaatatatacagtcacattaaaaaatgtgccaactctataagaacggagacttttttctctttagttctctcagtggcacatgaacacatgtacatacatgtgtacacatacacacacaatggaaagccaacactgaaaccttctctggggagttggggaacgatgagagacaatgtggtataataaaaacaatagggggaggccgaggcgggtggttcacgaggtcaggagttggagaccgtcctggctaacacagtgaaacccggtctctactaaaaatacaaaaaaaattagccgggtgtggtggcgggcgcctgtagtcccagctacttggaaggcccgggaatggcatgaacccgggaggcagagtctgcagtgagccgagatcacgccactgcactccaacctgggcgacaaagcgagattccatctcaaaagaaaaaacaaacaaacaaacaaaaaacaataggggctgggtgcggtggctcacgcctgtaatctcaacactttgggaggctgaggcaggcggatcacgaggtcaagtgatcaagaccatcctagccaacatggtgaaaccccgtttctactaaaaatacaaaaattagcccggcgtggtggcaggtgcctgtagtcccagctactcgggaggctgaggcaggagaatcacttgaaccgggtaggtggaagttacagtgagccaagatcatgccactgcactccagcctggcgacagagcgagactccatttcaaaaacaaacaaaaaacaataggctgggcgcggtggctcatgcctgtaatcctagcactttggaagggcaaggtgggtggattgcctgaactcaggagtttgagacccgcctgcgcaacacggtgaaaccctgtctctactaaaatacaaaaaattagcctggcatggcggtgtgcacctgtagtcccagatactcggaaggctgaggcaggaaaattgcttgaccctgggaggcgggggttgcagtgagccgagatcgcgccactgcactccagcctgggtgacagagtgagattccgtctctaaaaaaaaaaaaaagaaaaaagaaaaaaaaacaatagtggactgtttctcctcttgtttgttatagtaactgcactgtgcgaacctggaacaagtcatgtaataacttttggctcacttttatcttgtccatatattaggaaaacattctcaagtgtaatttcacattattattagaataacagttatttgaagatggagatgatgttaaagatacagaaaagagctttaggtcggggagagagcagtacagatgttctggggaaaaatggcattgctcacatctacttttatctacagcaaggattctaaagggatttataacccaaacatattgcgaatggatttgtagagagattaataactagctttagtagacaggctgaaatgtagacacaatatgaatacttgatacatagcagggttttcttcgccaaaaatacacttatggaagcaacagtaacagagagtgctacaatgcaggtgaaagaccctgttggggatatgtgttggagaagctgggagatttcatgctatgacctcaactaattacgacccagcctgtacccagacagctaaaaattaacacagaagtttagcatgtaatcaactataaattctcactcttcagtactcagtagtcttttttttctgttaaaagattgaccactgatgaccaggaattgtaaatgaatttattcaagtagaagggctatttatcagattaggatcttagtttatctaataggtaaacgactggtctgagtttttatactagctgatgttaaaaagtgatgtgtaaattttttttctcttcagttatgtatttaattactgactaatccctgtcaagtataattgttaggcagcatcactgtctaagaatctaaagtgatatcccattgccgagcaaatcatatcagattcctccgtttggctttgaaggacacatgcaatctggcttcaacctgcctatccacatgtatttcctttgacttccttcaatacttttcattcagtggcacctcttaggttttctcatacttgctattattatttatgctaggtctatattagcttggaatatcctccttctttctattcaaactttatccactcttcaaaactaacctcaattaccacccattccaaggccttctccatttgcagcagtgttgattcagtattatttattatttattttttcatttattcacaataactcaacaaatattgagtgtcttctatgttacagatgctgtcctcacctaaacatgaatttttattgcatgtagagtcataaccaagtagtatactgagtttgtagtttaatatttattgtatctcctctataaaactgagcttacagtggcagtgattatgtcttttttttttttctttaacaaagaggtcatgaaatagtgtaagtcaaaaccaagtagggaattacaaggctgatttgtatttcctcttggctactacttagtcattcgatgattcaaatcaatggacatttattaaacttctgtcatgtacgttgcgatgttatacactataggagatacatagacaatcacttaatagagtcagtattccaaaagagagagtctctatttgaggtcctaggacccccctagagaattcaatgttttaacttcagaggattttatctaaagtttggatatgtgcttatatgcatttttctgaggagagggtgcatagtttttagatgttaaagatgtaattgataattttttgaaaaggttgaaaagctcatgatctcagtatgtatgaaacaagtacacaactaaagaacaagagtcataaaagagcaacaaaccctaagctgtgtttagaaagaggtaaaatgatatctgactgtggtcatttaaggaaaaacttcctgaaagagatgacttttggaatatatgccatgcattttttggcctcagctccctcatggaaaaaaaggtagattataaaatctctgctattttttccgagatacaaatttatttcttgattcaatcaccaagtgctcttcagaatgccagtgacatcataggtactcagaaaacatctgttaattggtaaatctgaaattaaacttcagaaatttatagctacaaatatatctattgagttgaaattttagaatattattgcattagcttcctaatgttccatgaatgaaaagatttatcagatgtttatataccattaatcacaatcttccacttggcagatcagaatgtttaattcattatttctccttcatttcttcataacatttaaaaatatctttgtattttgttattcttactgttacagccattggggtcgcctcattagtctttatgatttgtaggggcaggaactctcttaaacctgtttgatattatttagaacctagcacatccccctaatcaaaaaggggcacagtaggctgggcgcagtggctcacgtctataatcccagcattttgagaggtcgagacgggcagattacaaggtcaggtgttcgagaccagcctggccaacatggcgaaaccccgtctctgctaaaaataaaaaaattagccaggcatggtggtggtcacctataatcccagctactcaggaggctgagggaggagaatcgcttgagccccataggcagtggttgcagtaagccgagatcatgccattgcactccagcctgggcaacaagagcaagagttcatctcaaaaataaataaataaataaataaataaataaataaataaataaaaaggtgggagggacacagtaaatattgaatcataaatgaaaggctgcatatcaaggtgcatcaaaataataaatttcctatttcattatcgtccagaatttaaagagcatgagcccagaagtgagaccacatgttcaaatcctgacactgcctactcctctgtgagtcacctttgacgagttccttaaattcgtcattctcagctttcttgtctgtggagtgtggtaatgacagtgcctacctcatacggttattgtgagcgtcaaatttagtgcttggcaaagtgcctaacacatcataggcaagagagaatccaggttcgtagggcctcaagcttttacagtgtctgagctctctttaagaaaatgaatttcaaactatgaattcaaaattagctaattagaacattttaaaggtatgtctgtagagtgggaaattataggcaacaaaggtctgaaaaataccccagttatcatcaaatattattgttactagtaatttcctggttcattataatactttattttctacacatttttagatgcatacactcagatttcctttttcaaataataattttaaatattttctataaagagaatagaaagaaaattcattctttagcaaaggggattgaaatttattaattttttattgttgctggtttaggaagtatttatttacttaattcataacatattactggaaatgccacattctgacttcctccctggctttttgcccaggaagttcattgtttggaaggaagccttagagaagttcaggttttgggtctcacttggcatggtctcagacaggccagtgccttggcagtggctccatcctggcagcctcctcttgattccccatcttcatccttgtaagcagggcaggtctttctgtgagagatgaggggaggaagtagaaagtagccaagagcctgggagatagtggtgacaaagctttgcttttacattattagggtcacaggtaaggtccaaaatctccctgaagtccactggggttaggttgtcattgaagtgtagatagatttaaggaaatgctggcagcctgcctgctgacagcatctgctgcaaactcaggatgatttttaggaggtagaaggtgaggacaggctaggaccactctccacacctccactaaaggcctgaggctattacttcctcaatataggcagtgcaggtgaggagctctgaagcctcaactccattaattccatggtaaagctgcttctgacttgtaagtgctcagtaaattagcacttacccgaattgttttactctttcattggcaaattatttttcattaaaaccctaggaattttgcagtgaatgcctttttaaattttattttatttttaaaaaatttttgcaataattgtgtttctcctctttattccaaacaggacagaattctaaataacccagccttttactaaagtgaatttgaaatgagttgtgatagagcaagtttgtttaatacctcatgatcatgttaagatctaatcatattgagaaaaaaatgccatattcatttcattcttaaatatcatttctagtggataccgttctgtgtccctagatcctttcagagatgaagaatttgttatcccagttgttgggagtgctgcttgctacttgtcaagacgacagttctctctgggacaagttctttttgtgcaagatcacagccactccctaagggcagcttacacccagcgtttctttaataggagtggagtagggttgtttacaaaggccctggtctagtgcaccccctgaaggatcatcctagcttcagagttccacaaagtctgcctagtgacagaatagtgaccttacttctccaccctctgaccaatttacgtatcctcccttccctgacatgtagtgaccctgaaaactttttccagtataccttgtgtacataaaccagtctcagagtctcattcttagagaccactacctgaagcattttcaaaattttcaagaggcaataatgtgttaaataacagcttctctggggatgagggaggagatcgctttaaaaacgtgatccaattccagaaatgttcaagttgaaaaaaatcttacattcaagaaagtgtgctatcagagtatacaagagtgctataattgctgtatgttagctgtgaccaataacctgaagcaattagaagcctttcactgaagccactatctatagaaaggttaaagattgttgttctttccttttctcagtggaattttctctttatatgctcttttggcttgatctctttggaactcatggttttagaccattgcattatatatctctagttctgccatctcttgagcttctaatttacatattcatctgtctgccagagtccttttgttgatatcccaccagcctcccaaacttaacatgtacaacactgagttaactttccctcagatcagtcctgtcttgtttacagtttcaactagtggccccactgtgtccggaattgatgggttcttggtctcactgacttcaagaatgaagccgcggaccctcgcggtgagtgttacagctcttaaggtggcgcatctggagtttgttccttctgatgttcggatgtgttcggagtttcttccttctggtgggttcgtggtctcgctggctcaggagtgaagctacagaccttcgcggtgagtgttacagctcttaaggtggcgcatctggagttgttcgttcctcccggtgggctcatgggctcactggcttcaggagtgaagctgcagaccttcgcggtgagtgttacagctcataaaagcagtgtggacccaaagagtgagcagtaacaagattaattgcaaagagcaaaagaacaaagcttccacagtgtggaaggggacctgagcaggttgccactgctggctccggcagcctgcttttattctcttatctggccccacccacatcctgctgattggtagagctgagtggtctgttttgacagggcgctgattggtgcgtttacaatccctgagctagagacaaaggttctccacgtccccaccagattagctagatgcagtgtccacacaaaggttctccaaggccccaccagaatagctagatacagtgttgattggtgcattcacaaaccctgagctaggcacagggtgctgattggtgtatttacaaaccttgagctagatacagagtgccgattggtgtatttacaatccctgagctagacataaaggttctccaaggccccaccagagtagctagatagtgtcgattggtgcattcacaaacactgagctagacacagggtgctgattggtgtgtttacaaaccttgagctagatacagagtgccgattggtgtatttacaatccctgagctagacataaagcttctccaaggccccaccagactcaggagctcagctggcttcacccagtggatcccacactggggctgcaggtggagctgcctgccagtcctgctccgtgcgcctacactcctcagcccttgggtggtcgatgggactgggcgccgtggagcagggggcggtgctcatcggggaggctcgggcctcacaggagcccatggagggggtgggaggctcaggcatggcaggctgcaggtcccgagccctgccctgcaggaaggcagctaaggcccggcgagaaatcgagcacagcgctggtgggctggcactgctgggggatccagtacaccctctgcagccgctggccccggtgctaagtccctcattgcccggggccagcacggccagccgtctgctccgactgcgtggcccaccaagcccatgcccacacggaactccagctggcccgcaagcgccgcacgcaggcccggttcccgctcgcacctctccctccacacctccctgcaagctgagggagctggctctggccttggccagcgcagaaaggggctcccacagtgcatcggtgggctgaagggctcctcaagtgccgccaaagtgggagcccaggcagaggagtcgccgagagcgagcgagggctgtgaggactgacagcaggctgtcacctctcaccactaccctgacatttcaaataataaaacctattagtcatcctagattctttcttctcccttgtcctgcatatccagacagccaacaagacctgataattttcctatgaagtattattccaatcagtttcctctttgcaactcctattgctactttctcgatttaggttcttatgcggactactacaataataattgacttgttttcctaccctaagccttgcttcctttaagccctctgcatagtggtccagatactctacatcaaatacaaattcgatcatgccattacatgcatgaacacaatgaacagcaacttctcctgtcaagaaagactctccatgacatactcctatttttttcattttccatattaccgccactccctttatccaactttatgtgctagtaaaattgaactgcttggagtttactggtgtgcttcatgtttcatgcctctgtgccattgcccattatttccactctgccaggaaagcgcttttcttctgtattagattaactttaatcattcctttaagatgatttatttttatcatctctaggatgtttcttgcatctaaaaatcctataatactgtattaatcaattttcatactgatataaagatactacctgagactgggtaatttataaacataagaggtttagttgacttgcagttctggggaagcaggcaccttcttcacaaagtggcaggagcgatagaacatgcaggagaaactgccaattttaaaccatcatatctcatgagaattccatcactatcatgagaacagcatgggggaaattgcccctatgatccaatcacctcacaccagattcctccctcaacatgtggggattacaattcaagatgagatttgagtggggacacaaagccaaacattatcattctgcccatagcactgcccaaatctcatgtccttttccattttgaaaccaatcacaccttcccaacactcccccaatgtgtgaactcattctggaattaacccaaaagtccaagtccaaagtctcatctgagacaagataagtcccttctgcctatgagcctgtaaaatcaaaaacaagttagttatttccaagataaaatgggggttcaggcattgggtaaatgttcccattccaaatgggagaatttggacaaaacgaaggggccacaggttccatgcaagtccaaaatccaacagggcaatcattaactcttaaagctccaaaatgatctcctttgactccatgtctcatatcctgggcaggctaatgcaaagggtgggctcccaaggccttgggcatccctactgggtctgcagcatacagtccctttagctgctttcatgggctggcattcagtacccatgggttttccaggatcatattgcaagctgtcagtggatctatctttctaggtctggaggtcagtggctgtcttctgacagctccattaggcagtgcctcagtgaagactctgtgtgggggctccaaccccacaattcccctccaccctgctccagcagaggttctccaggggctttgcccctgcagcagacttctgtgttgatgtctaggcatttccatacatcctctaaaatctaggcagatgctcccaaagctcaattcttgtcttctgtgcacctgcaggccaaacaccatgtggaaaccaccaaggcttgggacttgcaccctctaaagcacggcccaagctgtgccttggtcccttttagccacagctggagctggagtggctggaacacagggtgccatgtcccgaggctgcacaaaggagttgggccctgggcctggcccacaaaactgtttttattttcctaggcctccaggcctgtaatgggtgtggctgccttgaagatctctgaaatgcctggagacatttcctgcattgtcttggcaattaacttttggctgtttgttacttaggcaaatttctgcaggcttgaatttctccacagaaagtgggtttttcttttctaccaaatggtcaggctgcagattttccaaacttttatgctttgtttcccctttaaacataagttcaatttcaaactatctctgtgagagcacataaatacactttcaggaaaagccaggtcacctcttaatgctttgctgtttagaaatttcttctgccggataccctaaatcaactctctcaagttcaaagttgcacagatctttaggtccggggaaaaatgccaccagtgtctaaagtgacctttactccagttcccaacaagttcttcatctccatcgaagatcatctcagcttggacttcattgtccatatcactatcagcattttggtcaaaattatacaacaagtctctaggaagttccaaactttttcacatctgcctgtcttcttctgagcctccaaactgttccaacgtctgcctattacccagttcaaaagtcacttccacattttcaaattatctttgtagcagtacccccatctgccaattatctgtattagtccattttcacacttctacaaaggtactacctgagcgccactgcacttcagcctcagccaggggaacagagcaagactccgtctcaaaaaaaaaaaaaaaaaaaaaaaaaggatcctacctgtggctgggtagtttataaatcaaagaggtttaactgactcacatttctacgtggctggggaggcctcaggaaacttacaatcatggcagaaggcaaaggggaagcaggcaccctcttcgcaaggtggcaatagagacaatgcaggagaaactgccacttttaaactatcagatcttgtgagagctccctcactatcccgagaacagcatgagggatactgccttcatggtccaatcaccccccactgggtccctccctcgacacatgggcattacagttcgagatgaaatttgggtgggaacacagagccaaatcatatcaaatactatgtgttgcttatctataaattcctaaaggacaggaaccatgctcattcacttttgtaaccatagtgcctgacacatacgggatattcagtaaatatctgctgaacagaactgaataattaacactaataggtccctaaatctctttgcacttactgacttatttcttatttggtatattatcaatttttccatgattgtttctttaaaaattaatgaatttatgatttatttatacagtaaatatttattgagtggtaattgtatgaaagatacttctagatagtgggaaaacaagaataacaaatcagtattaaatgatttagatacacatttgttggataaataagacaatttcattagtcatttgaaacaaaaaaaattagtgagcccatactctgttccaggcactactctggaaggaagaaaattctgggaggagaggaaggaggtagcacatatagactatttttaagagttttttgattgtactgaagacagaaagcttaggcagtagttggaagaattggtgaggtcaagagtttttctatatgagagaaataattgtatataggtattactgatatgaatgatccagcagtgtcagaaaaactggtgatgtgggagacagtgggttcaattaatggaacaatggtgttgagaaagtttaaaaaggcaagtatttactgcaccaatggatggttttaccttaggtagtggcacagtttatctatggttgtaaagggaaaacagagcagatggacacagatacaaggagatggaagatgtggaagtcctctggtgagtcctgttttctaggtgaaataagcaagtgatcatccacacgtgaacgtggagagtattggtttaaggaaaaaagagaagcagagcgatagtcacctgagaaaattactggactattaaatgtaataaaatagctgggcattattaagggttggttctcttgaggttagagatcatgaattgaaagtgagcttcaccattcaatatatggtatttctccaggtacagtctgatgcaggggtaaggtcacagcaggcagagaggtgagcttaaccaggtcagatactttatcaagtaatttcaatgaaggaaaaaagaggcagtgctgttgaatctggttgcaagggaggtggtacatgcttatatttaagatcatggaaggcctgcaatagaaataactggagaagcccagggctcaattcttagaccgtctttttcctccttcctttgctaggtgatctcatccagccttgaggccctgcaaatcatcaataggcaggtgtatttcaaatttataactccagcctggacctctatcctgaaatacagcccccttctcaacatcttgataaaattggatatctaagaggcatgagactttcaaaaaactctggacttttcccacagacctggtacttccatggtttcacccatcttaatagatggcagccctgctcttttggtatctcaagccaaaaccttcagagccatcctttaggcttccatttcaaatgtaatatctaattaatcagcaaatcctacaccatcagaatatacccctctctccatgtccattactatttactttggattactgtagcaccttccaatttgtctccctgtgcccatgcttgtccacacaaatagttcctcaatatggtagccctggtgtgctttttaaaatttaacccaatttattttctccccactctcaacatgctttaaatgggtttcccaattaagtcccaggttcttacctgatggcagccacccctatctaattttaactttatactctttggccaacttctcccaatccttctaagcctcttctccctagtctctcttctgctctgcttctatgaaaccctttttttttttttttttttttttttttaagattccacatatgagtgagattatgtagtacttgtctttctgtgtctggcttatttcacttaacatgatgtcctacaagttcacatgttctcataaatgacaacacttcattctttttatgactaaatagcattccattgtgaatatatatcacattgtatttatccattcatttagttggagacttaaggttgtttccacattttgggtcttggaaatagtgctgcgataaacatgggatttcagatatctctttgatatatttatttcattttctttggatgtatacccattagttggattgctggatcctatggtagttctgtttttaattgtttgaggaacctctatactgttttctctaatggctgtgctagttaacaatctaaccaacagtgcataagttgtggcctctcttcacacccttactaacacttgttttgtctttttgataattagagacttttgcccatttttcaagttgtattgtttcttcaaatttgagttgtttaaattcactatatattcaggatatatacactatatattcagatgggtagtttgtaaatattaatattttctccttttctgtatgttatctcttcactctgttaatagtttcctttgctgttcaaaagctttttcatttgatataatctcattttcctatttttgcttttgctgcctatgattttgaagttatttaaaaattatctttgccaagccaaatgtcatgaaacatttcccctatattttcttctggtagtttcacagttttaggctttacatttaagtatttaattcattttgatttgacttttgcatatagtctagtcttatttttctgcatgtgatgatgcaattttccagcaccatttattgaaagactgtcttttacccaatatatattcttggcacccttgttgaatatccgctgtaggcatgtgaacttatttctgggttttctacgctgttaaattggtctatgagtctgttttttatgccagtatcatgctgttttggttactagagctttgtagcatatttcaggtagtatgaagaacctcctacaatattctttttgctctgaattcctttggctatttggggtgtttagtagttccacatgaattttagaatttcttttatatttatgtgaaaaatatcattggtattttgatacgtattccattaaatctgtaggttgctttggatagtatggtcattttaacaatatgaattcttctacttcatgaacactggatagctttccattttttcagtgtcttcacattcgttcagaaaaggtttataggtcttagtgtatggaattttattactttctatttttatttcaatagatttttggtaactggtttttggttacaatgataagttcattagtaaggtgtaaggtggtatctcattgtggttttaatttgcatttccctgatgattagtgatgttgagcattttttcatatgtttgctggccatttgtatatcttcttttgggaattatttatttttgtcctttgcccactttttgatgtgattatttgtttttttcttgctgatttatttgaggtccttgtacgttatgaatattagtcttttgtcagtacatagtttgcaaatattttctcccaatttgtgggttgtccatttactctgctgattatttctcttgctgtgcagaagctttttagtttaatgaggttccatttatttatttttgtttttgtcgcatttgcttttggggtcttagtcataaattctttgcctaagccaatgtctagaagttttcccaatgttgtcttccagaatttgtatgctttcagctcttagatttaagtctttgatccatcttgagttgatttttgtataaggcgagagatgaggatccagtttcatccctctatatgtggtttgtcagttttcccagcactatttattgagtaggatgttctttccccaatttatgtttttgtaaactttgacaaagatcagattgctgtaactatttggctttatttctgggttctctagtctgttccattggtctacatgcctattttcattccagtactatgctgttttggtaactatatcctcgaagtgtgatttgaagtcagataatgtgatgcctccagatttgttctttttgcttagtcttgcttttgctatgtgggttcctttttggttccatatgaattttaggattgttttttctagttccgtgaagaataatgatggtattttgatgggaattgcattgaatgaccagattgcttttggcaatatggtcattttcacaatattgattctacccatccatgagcatgggacctgtttccgtttgtttgtgtcatctatatttctttcagcagtgttttgtagttttccttgtagaggtctttcacctccttagttaggtatattcctttatttttttttcagctattataaaaggggtcgaatgacaattcaatcgatgtcttctttaccaatttggatgccctttatttctttctcttgtctgattgctctggtcaggacttccagtactatgttaaatagaaatggtgaaagtgagcatccttgtcttgttccagttctcagggggaatgctctcaatgcttttccattcagtattatgttgcctgtgggtttgtcatatatagcttttattactttgaagtaagtcctttttatgcctattttgttcagggttttaattataaagggatgctggattatatcaaatgctttttctgtgtctattgagatgatcatatggtttttgttttcaactatgtttatgtgatgtatcatatttattgacttgcatgtgttaaaccatccctgcaactctggtatgaaattcacttgatcatgatgtattatctttttgatatgctgttcaatttggttagctagtattttatgaaggatttttgtatctatgtttaacagggatattgttctgtggttttctttttttgttttgttctttctgggttttggtattagggtgatactggcgttatagaatgatttagggaggattctctctttatcttttggaatagttttagtaggattggtaccaattcttctttgaatgtctgatagaattcagctgtgaatccatctggtcctggacttttttttttgttggcagctttttttattactgattcaacctggctgttagttattggtctgctcagggtttctatttctccctgatttaatctaggagggttgtatattttcaggaatttatcaatttcctgtaggttttcttgtttgtatgcataaagttgtccatagtagccctgaatgatcttttgtatttctgtggtattggttgtaatatctcttgtttcatttctaattgagcttaattgaatcgtctctcttcttggttaatcgtactaatggtctatccattttgtttattttttcaaagaaccagctttttgtttcatttatcttttgtatttttttctttcattttcatttagttctgctcggatctttgttattttttttcttctgctatgtttgggtttagtttgttcctgtctcttaagttccttgaggtgtgatattaggttgtttatttgtgctttttcactttttcatgtaggcatttaatgctattaactttcttcttagcactgcttttgctgtatcccagaggttttgataagttgtgccactattatcattcctttcaaaggattttaaaatttccatcttgattttattgttaagccaaaaatcattcaagagcagattattaaatttccatgtatttataaagtcctgagggttccttttggaattgatttccagttttattctactgtggtctgagaagatacttgatatgattttgattttcttaaatttaatgagaatgattttgtggtttatcatatggtctatcttgtagaatgctccatgtgctgatgagaagaatgtatattctgtggttgttgggaagaactttctgtaaatatctgctaagtccatttgttctatggtatagcttaagtccattatttctttgttgactttctaacttcatgatcgacctagcgctgtcagaggagtattgaagtcccccactattattatattgctgtatatctcatttcttaggtttagtaggtattgttttataaatttgggagctccattgttaggtgcatataaatttaggattgtagcatctttctgttggactaatcttttatcagtatataatgtccttctttgtcttgttttactgttgttgctttaaagtctgttttgtctgatgtaaaaatagctactcttgttttttgtttccacttgcatggaatatctttttccacctgtttcccttaagtttatttgagtccttatgtgttaggtgcatctcttgaagacaacagatatttggttagtggctgttttatccattctgctattctgtatgttttaagtggagccatttacattcatcattaatattgagatgtgaagtactgttctattcatcatgttagttgtttcctagatactttcttttttattgtgttattgttttatataccctatgagatttatttatttattttgagatggagttaccctcttgtcgcacaggctgaggtgcaatggtgtggtctcggctcactgcaatccccatctcccgggttcaggcgattctcctgcctcagtctcctgagtagctgggattacaagcacccaccaccatgcctggctaatttttgtatttttagtacagatagggtgtcaccatgttggccaggccagtctcgagctcctgacctcaggtgatccatctgcctcagcccctcaaagtgctgggattataggagtgagccactgtgcctggctgagatttattctttaaggaggttctattttggtgtatattgaacttttgttttaagatttagaacttcttttaggatttcttgtagtgctgggttggtaggggcaaattccctcagtgtttgtttgtctgaaaaatactttccctctccttcatttatgaagcttagttttgctggataaaaaaagtcttagctgacaacttttttgtttaagaaggtttaaatatagggccccaatcccttctggcttgcaaggtttctgatgagagatctgctgttaatctgataggtttgactttataggttgcctgatgcttttttctcacagttcttaagattctttcctttgtcttgactttagatagcttgatgatgatgtgccttagtgatggtctttgtgcaattaatttcccaggagtttttaaagcttcttgtatttgcaggtctagatctctaacaaggccaagaaagttttcctcaattattccctcacataagtttttcaaacttttatacttctgttctccatccagagcacgatttattcttaggtttgaccattttacataatcccatatttcttggagactttgttcattaaagaaaaattgtttttgtctttgtctgattgggttaatttgaaagccttgtctttgagctctgaaattcattcttctatttgttctagtctattgttgaaactttccactgcattttgtatttccatggcatgtctttcatttcgagaagttctgatttttttaatgatatctatttctctagaaaaattttcatccatattctggattatttttgaaatttctttaagttgcttttcaccttctctggtatctccttgactagctgaatagtcaaccttctgaattctttatctggcatttcagagatttcttggtttggatccattgctgggagctaatgtgatcttttgggggtgttatagaaccttgttttgtcatattaccagaattactttcctagttccttctcatttgggtagactatttctttaaattgttcttgaatttatttttgatgggactgaggttttttttttttattttttccctcttaaggatctgactttaatgtttatattttattttagcctaatttaattcttggtgcttttagggtgaagactttgtatgagttccttagttatagagagacgttgtgtgttggtttttccaaatgttgtttgtagtagttatgtacttgttgtgtgggcaagttcactgtctcctatggagttggaatggcagggatctcttgaagtttgtctcattctcttgtgatgtatactttatttatttaactttactccagtattttatttactgagttgatgattcaggcttcagtccaataggagaggtagcccttggtagtcactggttgtagctaaggcaggtgggtacatgtaatcctcagtggtgggcagggatcccagccttgatgaaggtggctaagggagttctcaattagatgtcctgaggttgtaccaggatgaagggtgtgagctacctcagttcccctgccaggccaacagaaaagttatccacctcatagcctcactcctgtaccagtgttctggctattcagatcatacgggcacctcttttcatgtgtaggaatgttgatgctccaagtagcggggaattgtgaccttgcctcttatgcaggcctgaatatggagagtactccccctgttgggctgcaatcaccatgaatggttccaggaaggctgtctatagacgcatatacactgcattcttgtgatagaaactccagttgtgtccgcagtgatgtaccagggttgaacaaggatctcttctccaagacccttcatgatcacagaggctgcctgcctgttggggtagaggtgctgactttctctattgtgcccagctctgcacttgggtcactgctgaaagaaacattccaccagtggaaagatctgggactcaagcctgctgttcacactcttttgttccatggggtgttctcttgatatggtgttctctcccttcccctaaaaatgggacttcttgagagctgtactgcagtgattactattgatcttctgggtctagccacccagtagggctaccagactctgggctggtgatggagaatgtctgcaaaggatccagtgatgtgaccttttttcaagtctcccagcaatggataccagcacctgctttgaatggaggtggcaggggagtgacgtagactgagattccttggttgtcaataggcttagtgtgctggctttcttgaatgctggttatactaatagtgaacttgtcatgtggacagactcaggacccctggatagccagggtattgcaggcagtggtgtaagctgagatcccacagctgttttctccttcctgagagcagtgatattctgctgagaggtattgtgatggcctgagttggctggcctccagccaggaggtggcgcttgcaagacagcatcagctgcagtagcagcagtgggatttgagcttgctttaagttgcccaggggaattattctggtttcttaggtgatggacagggctgtagagctcccaaaagtttatgttatttgtgttcatctactaggatgagtggagaaatatcaccaggtgagggcagggttaggtgggtctgagctcagactccccttgggtggggcctgccgcagccactgtaagaggcatggggtggtttgcaggccactagggtaatgatccagaggtgagtataactgcctctgctatgcagaagatttcacaaagggagtggggagtagccggcagcagtaagcctcatccagctccttgcagttggcaaggccaatctcgctcctgaagtgtcctgctatcagcaccaggtttaggtccacataacgtatgcacagaactcagacctgcctgaggccataagcttccctgcagaaatagcaagcatgacttttgggtcacatccctcctcctctcgtctgccctcaaggctggtcagcagtgctcttcccactcgccaccaagttctgttgatgggtgtacatccctactcaaaattatatcacaaattcagctgggagcttcttttaccctgtgacccctccctgagctcattggctaactttcttgagggctcctgtgagatatagtcaggaatggctttccttggttcatactagagactcagaatacctgcaaggcacttcctgcgactgcttctacttttattttcacgaggctccctaaatttgttccagctcttggtagcattaaggccttctcctgtggcctggattttcagattccttagtggggatatgtgctcaaaggtagaatctccccgtctcatactctgggaacttttattttttttcctatctcatggagtaggctgcagcctatcacttctttcaaaaggtctgtggatttttccagttttcccagtgggagaggcatgctaacactgcctcctatctgctatcttgaaaaaaaaaaaaaaaaaaggtgtatagatcattcacttccttggttaagtttatttctaggtattcgatttttttaattttttgtagccattgtaaataggatccctttttgatttccattttagctaattcattattggtgtatagaaatgctggtgatttttaaatgttgtttttctgtcctgcaactttactgaatttgttaattttaaaagttttttgatgaattctttagggtttttaatatataaagttttatcatctgcaaactgggacaatttgacttcctcctttccaatttggatgccttttatttatctggcctaattgtcctgggtaagatttccagtactatgttgaatagaagtcatggataggcatccttgtcttgtctttaatcttagaagaaaagctttcagcaattcccccttcagtatgatgttagctgttgttttgtcatatatgacctactgagatacattccttctatgtctaattttttgagagttcttcacatgaaggaatgttgaagtttttcaaatgcttttctgcatattatcatctggattttgtttttcttcctgttaatgtgttgtaccatatttattgattagcttgttataccatgcttaccatgcttgcatctctgggatgaatcccacttaatcatactaaatgatttttttaatatgctgttggattcagtttgctactgtcttgttaagaatcttgtgtctatattcctcatcaatattgacctatagttttatgtttttgttgtatccttgtctggttttggaatcggattaatgcaggcattataaaataagtttaaaagtattctcccatcttcaattttcttcagtagtttgaggagaattggtgttagtactttatatatttggtggaattcagcagtgaagctttcaggtcctggtcttttctttgatgatggaagacttattagtgataataataaataataatttatattaattgttattaatttctttactcattatcagtctgttcagattttctatttcttggtggattttctattttaattttgataggtcatatgtgtccagaaatttattcatttcttccatgtcatcaattattttggtgtatacttattcataatagtctctcatgatcctttgtatttttgtagtatcagttgttatgtctcatttttcatctcttattttatttatttgaatctctcacttgttttttaccataggtaaaggtttgttgatttttatctttttaaaaagccaaatctttgttttggtttttatatgaattcatttttttgtctgtattttatttgtttatgttttgaattgtattatttctgtccttccttctaccaattttgggtttagtttgttcttattatttttagttccttgaggtgaatcattggattgtctactagaaatctttcttcttttttggtgtaggcatttactattttaaacttccctctcagagtttctttcactatgtcgcataggttttgatatgatgtgtttccattcttgtttgtctgagggaaattttttttcacttttacttccctcattgacccattggttatttaagaaaaagttgtttaatttctatgtatttttaaattttctgaagtttttattttagtattgatttctagttttattgcattatggttaggaaagatacttgatatgatctctatcttcttaaaaattttaagacttgttttgtggcctaacatgtgatctatcctaaaaaatgttccatatgcaggtgagaagaatgtgtactctgtcggatgcagtgttctataaatgtctgttagggccatttggtctatggtataatttaagtccaatgtttctttgttgattttttgtctagatgatctgttcattgttgaaagtggtatattgaagccctctactattattgtattgccctctgtttctcctgttaggtctaataatatttgctttagatatctgggtgctctggtgttgggtgcataaatatttataattgttacatcctcttattgaattgatttctttatttttatataatgaccttctttacctctttttacagtttttgacttgatgcctattttatctgatataagtatggctatttctgcttgctttttgtttctgtttgcatggaatatcttcttctatccctccactttcagtctgtgttatgcttgttggcagcatatagttggttccttttaaaaattcattcagccactctctatcttttaactggagaatttagtccacttatattcaaggttattattgatagataataacttactcctaacattaaaaaaattactttctggttatggttatttcgtaaatgttttgttcctttcttcctcttttattgtttatctctgtggtttggtggttttatgtgttactaagcttggtttcttttctccttcttgtttgtatatgtgttatatctttctttgtggttattataaggataaagggtactgatggtttatttaaatctgatagcaacttaattttgttcacataaaaatactccagatgttttctcttttctttactatttatatatttgtttccttaatttacttctttacccattatgtagctgttgtaatttttgaccgttttgatttaaaccttcatactagaggattaaaagatttgcataacattacagcgctaggatattctgagtttgatttatgaatttacctatactggtgagctttatattttcacacgtttttattatagtaataatgagcctttcatttccaattgtaccactcctttaagcatttcttgtaagatcagttaagtggtgatgaatcccgtcagtgtttgtttgtctgggaatgtcttcatttctccttcatttttgaaggatagctttgctgaatatagtgttcttggctgatttttttttttttaattttcagcactttgaatatgtcatgccattctctcctagtctgctgaaaaatctgatagtctaatagagatccttttgtatgtgagttaatacatttgtcttgcagcttttagaattctttgtctttgactgctgacagtttgataatcatgtgcctcagaaaggatcttttggggttcaatttaattagggacttttcagcttcctgaatctagatgtttgtatctctgaatacttgggaagcctaaagctattatttcttaaatacatttcctatgcctttaaaaaaatttcttcttcctctggcattcctataatgtgaatatttgtttgcctaattgtatcccatgtattctgtaggctttcttcattctcttttgttcttatttctgtgtttttcctctgactgggttatttcaaacgcctgttttctagttcagaaattccttcatgaaagatctagtctattgttaaaaatttcacttgtattttttaaattttcatttatcaaatttttcagctcccagatttctgtttggttcttttaaaattatatttatatattatgcatttctcattccaattattgattgtttgtctgtgttctattgtatctcactgagctttttaaagatcataatttttaattattttttaggcatttcataagtatcattttacttggggtcttctactaggatttattgtgttcctttgggggtatcatgttttcttgcttttattatatttcctttgtctctgcattgatacttgttcatatagtagaatagtttttgtttccaattttatggagtagctttttcagggagagacatttcctgtagataagtcctagggtataagttcagcatggtgaatggctttgattctgggtggactcagtagcacggtatctgtgcagtttctttggctgtaatactcatcagtggtgtctgtgattgactcagtggtctacgctgtgagagcttttgaggtagtggcatagttttcttggggtgggagcactgggttggttttcaggttgggcatgtgggggcacagagagctgacaagctgtctggctacctctccagagagtcagtggctactgctgtgctggctgttgggccaggcttgagcttacagagatgctgccagcaaggtggctgtgtggctttcttttcagtgaggcagggcagccaccaaactagatgagcacagcaatgccaagcatccctgtggcagtctgttggagaggcagagctgctgcaggactggatgtcgggctgcatgtgaatgtttgtgggtgcagcaaggccatgcagctctgcagtggcctttcatgggagtaggttgccacatgaccacttgccaggctgggtgcaggcacatacatgctcagagtgcttgctggctgtgaagcacaggtatgtgttggtaacatggctagtggctgtttggaagcttccctgctgtgcatatctgcctgttccctgagatagtggtgtgccatgtgagtttggacactggggtcttggtcattatgacatgcctatgctctaggtagctgagtttgtggtggtgcaagcattcatgtgaacatagtggaatgagagcagggcctcagggatggagacagtcagttgctattggctcctactagtgggtctggttttaagaagccattgagctctatcatcttaggccttaagggtgggaggtgttcaaggtgggctcctactgtgaggcagtgcagctgtacaaacttctggctaatctccaaactggattcaaaacctataaggaccaggagactctcctgcagcaaggatttctggcatgtgtggtaataattgggactgctggggatttagagcttacctttaccccataagaagaagtctccctgactctgagctaattctggtgaagatgacattgtggcagaagtggattacttgctctcctctctatggtgctattctcgccttctgtgcttcacagggatgttgccactgccagggtgctctccagcatacttcctcagtcactccagtcaaattatagatgtttattcactgttttgatcccttttagttgggggaacaagcaccaggtaactatagtcagtcatctttctaacttcacttggacaggtattttaattatgtgcaatttccagattgacttcctcttttattcaggattactttaaatgataattttatgtttataagtggatgggattttttatttgctattcttttattattaatttgtaattcaatattattcaatattgaaaattttcaatattgaaaaatttcaatattattgaaattttcagaattcaatattcaatttaatagttcaatactattaattttttggttttgtgatcatataatgtaacaagtatgaattcagatttgtgtaatgtttgagactttattttagatctaggacataaacactttaggtctaggtcatagatgaccttttacaaatattctgtatgtttatttttaatgcgctatcactgtggtgtaggatgtcatgtatctaatctgtttaatcaaatgtacatatatactacataaaaaggttgttcattgtgtttttaaaatttgccctaggcattggtttgctggagccagctctaattggctcattagggccaatggttaaatagttaggaattttatgagccagcttttaagccattggtattttgaagtcagtatagtgaggtttttatacaacaaaaattgggaaatgctacaaaacaacgattttttttttgagagctagtttactggcatatcaatgctagccttactgatttctgtatatgtttaaatttctaaaaactatgttaaaatatttgataacttatttttcatattcatttttctctatataatttgaagctatactgttaggtacataaacattcataactattatatcttctgagagggttttatttatttattttctcaacttttattttaggttcagggtgtatatgtgcaggttggttacatgggtgaattgtgtgttgctgaggtttggtgtatgaatgatgccatcacccaggtagtgagcacagtaatcaatgagtagtttttcaacccttgttctcctcccaccctccccccacactaactcagtgtccagtttctatttaccccaacttataagtgagaagatgcagtatttgattttcaacagaaaatcactaaaaatcattattttgcctatgataatggcttccagctgcatccaagctgctgcaaaggatatgatttccttctttttatgactgcatagtattccaaggtgtatatataccacattttaaaaaattcagtctactgttaatgtggaattactgcagggcctcagcaatggagacagttattggcccctggggcaggataccctctattagtgggtctggtatcaagaaaccattgagctgtataatcttaggtcttaggggtgggaggtgttcaagagccagtgttaatggacattctcagagagttttaacttttatccatgtgcattatccattatattgtttagtacttctcatttgagttctactttttctctattcttgttactacagtcatatttacttggcatatcttttttttgtaatttttaagcatttcgtatcattttatttttgtttcatttcttataaactcattttaaaatttatctctgtgtctactttttaactaatgttagtatccatctcttagtaaggaaatatagtttatttacatctttgcttgcatgagtgaatgattactggtatgtttagacttactactgccacattgttttttctgtatatttttactgcactttcttttttttcttctctctttctgcctgtccccactacctctactactattacaaccttctgttagattctttgagttttgtttgttcattttattttattttggtttggaaattatacatgtctggcttgggtttttttttcatagttaaattttctcttgactttttgcaattaattagcataagtgtatttcaaattatcacaaataaaataatcatcagagtatgagtttacttcctcctcttccttttcctacaccatttcccccagggagagtatccatgattttccttgcacattgctacttgtaaaagtacatggctaaatcactagtttcctagcattgcgactgatgatacagtgactgaaaaggaggatgagataattttttataattacaaatattttctatatcatggttgtggtagtaatttcatgagtgtatagtgtcatcagaactgtatactgtatgcttaaaacaagtgtatattttattatcttaaaattgtatctcaataaagtttatttaaaagtatggtacagaatgtcagacagagcaagaaataattagcaggatgtagagaaagcccattgcaagttacatcttatgaaattatactggcatggtttttccagaaatacttagcagtttggaacttgaaattggcgagatgaatgtagcagaaagatgaaatgtggggtaaaattagtgtgctatttaggatagtatttattacagtgactggctgggccaccttctggttagggaagctagtgcagctaagatgctgatagttgtgagaataaggacaatctgtttataatataaacaaattaaaaatcaaatccagtaattatgtcatatgtgctttttatatgcttagcatgcttataggtgttgtaggtacagtaactagtaagatacacaaggtttctgaccacaagaatttcacatttttgcaaaatgaatgatgtcaaaaatgtactttaatgaattgccattagttatttagactcaaatataaatgttactaattctgcatacttatatcccacatcttttttgaataactttttaatttatctggaatgcattttttacttaattatttcatagacattctgtgggtcttatattttctaagatgtgctatgaaagaatgtttttgccctccttttcaaatactaatagctttctaggttcaaactcattctcacttagaaccttgaagatgaattctcttgtcttgtaagtaccatgatcagattcattctgatttttgtccttaaatagctttctattagcatgtgtttcattatcctggaattaggaaattcaatttaaaattgctgtgtttttcaattatcccttttatgccctgtcaatgtgaaagcttgtgttctacttcagctctgtaaacttttcttttatgactgttttgattgtttcattctgtctgttgtctctttgctgtctgtttatggaactccttttggatactatgttggaatttctacacctatctatctgataatttccaactttttcttcttctgtactatggtttgggataatttcttcaccttagtgagtgtttgaatgaagtgcttttgaaaactgactagaggaacagatatcattgattgtttccggacagtaggttaaatatatttttgctgccctgaggaagctgtccattgttcctgccctggagaattatactagctgggatttttcaaaaacatttataccaaacattttcaaaaacatttgcaccaagtgacaatagcccatgaacatagtgctacagaaaactatgatcagagagtggtaagagatctaccatatatcccctccagctacataaatgaatatcccttgtttaccttaaacaataagctacctgaggtgtttctatatttattttatatatttctataaataaatatattgtttaaatatatattaaatattgtttaaatatatatttctatatataaatatattgtttaaatatagtgtttctatatttacccactatctgtttaattaatgctttttgatagtgattgaaactaagatgtccaaatcttactgctacctctgtccctggcagctcaaaaaatatttatatagattattgtttgctttggaaacatttcaatataattaaccaatttgtcttattttaagcattccaaagaacttaaaggtgtttcattaaaaaagatacatatatttatatacctttgtatgaagtagttacctaatcatttttttttgttttgataagctgaaatttataggccttataaacatattgtgtagccttataagagaattaataccaacctcaggtcttatatttgtatgaatgaatttttaaaaatcattatagtaacccaagttattatagtttgtattggggcttatttagccttgatattgaatacagattaagtttgaggacatttcttatttgaaaatctcatattggtgtcaatttaaaacagtttgaaagcaattgctgaaaatgtcttagtgcgattaatgataggaagattggagatgtttaaagatatcactttctcagctgtacttaaattaggactgaagagatctgtagcggtcaaaagctggcaaaccaactgtttatttatcaaaaccgactagttatttatcaaagcaggtggttggtgattcaaatccatcaaccacctgtttttataaataaagttgtattggaacacagccatacccatttgtttatgtgttgtctatagctgctcttacactacagtggatgagttaatcactggcaacaaagtctacaagacttgcaaagcataaaacattatctggccctctacacaaagtgttaaccagttgctgctttaaacaacggtgacagttttgtggagtcttactgaccactactttcatactgttaggaaaatggctcacagtcatctgaaaacacactatacttggttgcatatggccttgcttgggttctgccttctgcctcaatgctgtttttctcctttcactcatgcctagaatatatccaaccttcaaggtatgattcacgtaacactacctttatgaagtcctatcataaagaaatgaagtaaaatttcctggacaaatctcccaatcgctcccttacatatagtttgaaatcccttgcccctctcttccttgtacttgcttggtatacacataacatgtttaaatccagttctgtacctattccaggctttctttccctttcagcttactgtggctggagaaaacacataccaccctaatgactaatctcactccacaaccattcacaacattgatccttcaaaaggtcaggctctcatactattctcccagttacctaaatggctattttgtgtgtcctcttccctctcctcctcctcctgtccccatcctcctcctgtccccatcctcctccaatcttcactttctgctcatgtctttttattttaattcactgagaaaatggaagtaatagtagaaaacttacacctacctaccagccccatcccccttataactcagcattccttcccgtgacagtagatgactcagccctcgccccctcttggaggtgagctaacatcctcatcttcacttgcttattagagaacattactctggcacttcccaccccctccaaaatccttaattccccctctctaataagtcagtcccatcagcatgcaaacatgttgttatttccaccacttaccacctgcaacaaccccctttccttcctcccttttggagcaggattcttaaaaacattgcctgcactagcatcttaaaaaccttttcttgctactttcttgtcagccatcccaggcaggcttctgcctccatctaacccctaaaagtgctattgtcagagtcatctgacatgacctccgggttgccaagcccactggtcagtgctgaaactgtgtcttgcttggcctgtcagtgcatttgatgtgtccatcattcccttttgctggatatacttcccttgactgacttctagaatatgatactcttcattttccccttattcagtagtcattccttttgatttttctttcctggtccttcttttataatccttgacctaattaatactgaagtatcccatgctcaggttttggtccttttctctacctacatcactccctcatgagcactctgatgagttgcatatctatttccagttcagacacattcctgaactcgagatttatgtatccaatggcatatttgatatttccttgtgcatatctaatgagcctttcaaactcagcatgtccagaactgaaactcctgacctgtcccctctcctcaaggcatcagctgtgtccaaggcttgcttttttcagttgatgtcagctccatcttctcaggtgttcagaggaaaagactcagagtcattctcattctctttttcctcctgtaccctgcaatctgtctggaaattatattagtcctatcataaaaaatgattccagactctaaccacatgtatctatctccactgctaccccaagcagattcaggtcctcctctcctccacctttctgacctcatctcagactactcttgcccttgctcattccactggcttcttttctgtcccttagactcatagccacacagttgcctctgccctagctattccctctgcttcaaatagtcttcactgagataccaccggggctcacaccctttctatctttaccctgactacccaaaatttcaacctcacccttcttaccttgtttcctttttcctagataatttttcactctctaataaaatacataattataataacttatttgtgcattttctatatggttcatctttctttctgaaatcaagattgtgttctgccatcattgatgtattccaaggtcataaaaaatgcctagcccataataaatattcagtgaatatttactaaatgaatcaaggaaagtgatgttgtcttatagtctctatattctattcagtctcggcttgtcttttctagtggtttgaatgaatggatgatgcatttaacccagaaaaccaatacttgtaaatcttttattcttgtatgtttaattaattttaaatgtgtgattagacaagttaataagcagaacaaaacatcaagtatgttagatcatctttcctcactgggaagaactataatattggtatagaatgtaagatgtttacagttattttcacaagcaatgatttgcttgggaaatagcaatggtgtgagccccgacagtatctgggtgaagaatatttgaagcagaaggaaaatctagagcagaggcaactgtgtgactacgagtctaagggacagttttcactccagaatgaaaactatagagatgcctgcctgcgttaacttgctcacctcactatgtattttccctgggcagtaccatcctgctaggatttcagtgctgccatgagtcagcagtcaccttgcagtgagatccaatcacaagattccaaacaattcctaccctgtgagctccttgaggacagggctgggatttagtctcttttatttcacaggcccagagttctaggatggcagaatggtttcgggtgccaggccccacctggttgctctccatgggcatactgcccagggctgccttgggacttggctccctacattttggtgcagcagtcttcagccaccccaactatggcttaagtggccccagctgcagcttgacccactgcttcacaagatacaggtggtaagccttggtgaaattcatgtagtgttaagcctgcagtctcacagaatacaagagctgagggggcatggcttcctccactttgatttcaaaagatgatgctgacttatttggggcacaggcagagactttgcacaggggtagaaccaccacagagagcccccaacagggcggtgcctcatggagccaaggaaatggggttgccaccaaaatcctagaattatggttaacagtgtagagctgcagtctggaaaagcttcaggcatgagactccaacccatgacagctgaagaataggctgagcctaggaaagctatgggagctgagctgcctgaggccttaggggtccaacccccacccagtgtgcccaggatgcagaatatggagtgaaaggaaattattctccaactttaagatttaatattgttctccctgttgggttttggacttgtttcagatgagttatccctcttttcttgcctatttccccattttagaatgggaatgtctcttctataccttcgcacattgtattttggaagcagatagcttattttgatttcacaggctcgtggttgcagaacatttgccttcaggatgaagtcacacccatatttgatttagataagtattacctagataactcgattaactagatttagataagtattaactaacagtattaagagttaatactggagtgacttttgagcctactaggatggaatgaatatattttgcattgtatgaaggatgtgaatttggcagagaggggagggtaggtgcagaatgctatggtttgaatgcctccaccaaaactcatgttgacatttaattgtgaatgtgacagttttaagaagtgggatctttaacaggtaattaggtatctctttaggcactttcattagacagggccctcatgaatggattaatgcagttatggagggagtgagtttgttattgcatgagtgggctccttattaaagggtgattttggctcagtttcctctctgtctcatgtgcttgctttcacttctacccttctgccacaggatgacccttagcagatgtcagtgccatgcacttgtacttcccagcctccagaactgtgagccaaatgagcttgtgtcccttgtaaattaagtttgtggtgttctcttatagcagcagaaaatggattcaggcagcaagcagagctataaaatacttctttttttttttttttgagatggagtttcacttttgttgcccaggctgtagtgcaaaggcatgatctcggctcaccacaacctctttctcccgggttcaagcaattgtctggcctcagcctcccgagtagctgggattacaggcatgcactatcacacccggctgattttgtatttttttgtaaagacggggtttcaccatgttggtcaggctgatctcaaactcccgacatcaggtgatcctcctgcctcggcctcccaaactgctgggattacaggcacgagccaccacgcccggccaatacttcttttcatctacactggcttccattatcatgattttgttagatacttttgaggacattttctattgcattcctccatgtttggcaaccacactctatggtggagtcttctggctaagcacttagtcttcttttacttataccagcaggatgtagttgagcagggtagtgaaaatccattgtgacattgtaaagcctcactgctataagaggccaggaatgaaattttcattgtttacaaaagtagcttcgtaaggcctaattaagaattatatcacccatggcattgctcaatcccaagtcaatattttttttttttgaaaaatgtggattcaaggataccacaactaaaagggatgtagggaatttaagaggctttggatgaaatgatgaagattacggtaaagttttataaaaaatttgaagcactgagataatatagacaaagggaataattataaaatgagagtgataaggaaggtttgctttaaataaaccaatcaatgagtgatttagatcatatgtaacaggaatattagatttgatatgttcttgtggacaaaaaggtatttctattggatacacctttgtatcttgcttaatacctaaataagtgttagctttttctttctatgagttatagacaatacattttaaagcagccattttttatatttcagaaacatttgaaaagtataataatttaattctttgtgtttatggaacttaattcagtgaatatttatgtcatgggttgtggcagattttggttttttgtggaagaggtcaccatgtatatactattttgaagggcagaaaatagttgtttctatttttgtatattttggttataaactgcttttaatggcatggagttgaatttagggatgtttaatcttcatattcttcacttgatttgagtgagaaaaaataaaattttcttggttataaaattctcaaatgattaacaatggtttctttaaaagactgaagatacatattcagtggctgtagaaatggctactgctattgtaaactggattaacaatcagtacttctacaaatctaagtatttgtttgtttttactttttactagtatgactctggaatttttcaattcagggaaataatagaatagaaaagctttgctaaggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctttctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcggtaagaaaaaaaatagatgaaaatatcctatggaatttcccttaaaggtcgtctgaatctcagagtctttgcaataagttacatggttattctccaaagatcttgagatatcacagatgtctgttcacatttggattgttcttattttgaaaataaataggtttttaaaaactctattgaccatcttgataggctcttcttgtcattataaatgtgttatttcacttatcccactcttttgtgttctctaaatgtctttgtactcactaaattgtgtagtcttagagggcagggtgtgggtatcattcatctttttgaaaggaagcatgaacaattagtggttaaggtggcagttaacactgctttctgaaactttaaaagcttcgacaacacaaaagaggcaggtgaaagtaccaaaactctggtaagttgtaggataaatgattttcctaaatcaccaagaaagattattagtcactctcaagatggaatacagtatctgtaattggttccattttatccaatttttcaccaaataatattaatataattcattttcataatttacatgaagttaatataactattgcatctctgttagtaatgcatgttattaacctgtgctgtataaaatattttgacctattaaaaaagaaagaaggatgaggaggaggtcaaagataatataaaaactttaagtggtgacattggtatgtatgtaaattaacaaatatgtcaactttgttaaattatctttgacatgcatctgcagaaatatctgttaaggaactttgtgcataagagacagagttggaggtgggagagaaagtgaaaaaagataaattatagttttattatttttgataaggggcattaattatgaaattatgacaaacttacatctttagacctaaaaatatgttgacatgttattttaaacctcactttttaactaaaaaatttaaccatttgtctatgattatatttttcagaaaccacatttgagaagtatttccatccagtgctacttgtgtttacttctaaacagtcattttctaactgaagctggcattcatgtcttcattttggggtaattttatctttaggcataaataacattatgttcatggtcatgatgattgtccttggatatattttccattaaattagtttacgttcagtttgcttatatctctaggtactcagtatctgggggatagaaggcagactacagagatttagagaggtttggtaaacacctaactgagcatttttctacattgtggtaatagtccaaacaagcattatagccctcaaataaattgggccttttgatatttaactgaacttggaagtataccacttattgatagactacatatttttcatggcaattaaaagtagatatttagaatttgcttatgttacttttttatctgtccctgacactgactcctcctatcccttgatctttatcctagttcagtttaaaacatttctttctttatttaagccttttgttgtttccttctaataaaattcatatgtttccatgactattaacttttttcttctctcttagatgcagctaatatacccagttggcccaaagcacctaacctatagttatataatctgactctcagttcagttttactctactaatgccttcatggtattgggaaccatagatttgtgcaggtaattcttcatcataagacagattagtgttgactatcatgcttctgtgtaagatccatcaggaagtgagtgattatttttcctcaagctctaagcatcattccaatgttacttggtcagtataagtgtattttgtctggatattaaattttaatttttatgaaatttgtgaaagtgagtaagtatatgatcattcagcctacactggaatgaagtctgtactgtttatggagaaagctgctgcaagcatagtaagagtgtgagcaacatgaaaggggcatgtttaatgtagtgtaaaaaaaatttactatcaaaatcattacatgaaaatgattattactcattttaagaattttacctatttattagacttcaaagtctctgtaaatctctacttaaaggaaactagtaattcattcaaaatcatttattgagcattgccacacatctggcactgcttctatttcattgtgataaattgagccagtttatttataaagtatgcctacagttaggcttttctctaatccgggttggtgaagcctcaagttatcataaaatgccaaaattgtactatatgctcaatgtttatgttcagttacaaggctgttgaatgcacagaagcaaggataacactgattttttcactggtcagaataaaaattattgattgctcttttgcttatagtattcatcaagatgaataggctccttcaaaatgctttgctctatggtttttctttcagctgtttcagtgcagggcttcctaaaacagaagccaactgggtgaatgtaataagtgatttgaaaaaaattgaagatcttattcaagtgagtactcatttttccataaaatgcctggtataactgctatggagtttgtctctctctgtgtttttctgtctgtcttaaggaaaccacacttgaaacaataatatttttgtagaaatttatgatcttataaagctcaaaaagaagtcttttccttactgttttagaatctaattatctttaaaacgtaatttataagcggcccagacggatgagttctagtctgcacaggtgaggtattctcttcctctatctggagaagccagatatcttggtggcacctgcagggagaatggcttgacccagggaacagctgttgttgcttgtggactaaaggccctcttctcccacctcaagaaaacaggtggcctgacctaaggaagtgatttttgccatagcaggtaataccagcttcagtggaagtctcgatggcaccaagcataccaaaatagcaccacaaagttctgaaaactaaattgtcattggaatcacagcattaaaaaataggttagaacttgcatgctaaatccaaacaacctgactgcatgttaaaatagaagatttaaataggaccagagtgtcctaacataatagacatgaagccaagatacaattggaaatcacccattgtaacaagaaataggaaagttacaacttaaatgagaaaatatagtcaacagattacaaaattgaagtggatcagatgttggaattctctgacatagatttgaaagcagacattataaaaagtgcttgaaaaagcaattacaaatgcccttgaagcaaatgaaaaactaaatgccttaacaaagaaatagaagatatgaaaggaaccatatagaaattatataactgaaaatataactgaaatataaagcaaactgtaaaggctcattagcagaatgaatgacagaggaatgatagttaatttgacaacagaatactagagagacagttgacttaagaaaaaaaaagcatcactgatcttgacgacagtaacaaaagattcagcattcctatggttagtatcacaggagagtatgagaatacaccaagtaaaagagagagattggttgaattcataacaaaacaccacccatctatactatctataagcagttcacttctagtacaatgacatacataggttgaaatttaaaaagacagaaaaagatatagcatactataatgggttgaatagtgtccccccaaatttcacatcctcttggaaccttaaaatgtgatcttattttgaaataatatctttgcaaatataattaatgaaattaagatgagatcatactagagtagggggggccctaaatccaatgacaagtgtctttattagaaaaggaaaggacacagagtaactcactgggaagaaagccatgtgaagacagaggaagagatcagagtgatgcggctataagccaaggaaggccagagattgccaggatccaccagaaccttggggaagtcaagaaagcattcttctctagacccctcagaaggaacatggccctaccaacaccttgactttggacttccagtctccagaactgtaaatgaatagatttctgttgttttaaaccacccaccttgtggtagtttattacagcagctctagactgatacacatgcatacattaattataaaaagcagaagtggctatattaacatcaaagttaatgttattaacataaagtagacttcacagaaaataaagttgctataatccagagggatattacaaaatgataaaaaataaatctgtgaggaaaacataatgttcttaaatgtatacacatcaaacaacgaagactcaaaatttgtgaaacaaaaaataatagggataaaagagaaatagacaaatccacaattattcttgaggacttcactgcctcctcctcagtaactaatggaagtactagacagaaaatcagaaagggcataaaaatacaatataaccaaccaacaggatctaatttaatacatagagcactacacccaacaacagcagaatatactttcttttatcaagactaaatatatactgagccataaaagaaactttaaaaattttttcagaacttaaatcatgcagaatttgttctcaaaccacaatggaatcaaaccagaaatcaagaaattaaatacaacgggcaaatctccaaatgcttggaaattaaatactatacctctatataatccatgggtcaaagagtaaatctcaaaggatattcataatacatagaatgaaaaaaaatgaaatacagcatatcaagatatatgtgatgtggctaaagcaatactgacaggacattttttaaaatcaaatgaatacattagaaaaaaaggagaattatcaaatcaaaaatctaagttactgcttcaagaaactagaagaagtagagcaaaacaaattcaatacaagcagaacaaagaaaatatttaaatataagagccaaaattaatgaagttgaaatcaagaaaacaatagaaaaaattaatgaaacataaaactggttatttggaaaatcaatacaattgatctttaattgacagaaataagagagaagacacaaatctcaggaatgaaatttggggctgtcactacagaatctgcagtcattagaaggataataagaaaaactatgaacaattttatgctcacaaatctgataacttagaggaaatggaccaattcttcagaaaccacaaactaccaaaacataatgaagatgaaatagacaatccaaacactcatataatcactaaatacattgaattcatcatacacaagctcccaaaaagggaccttcaagcctgctggttacactgaatcattctatcaaatatttacagaagcattaacaacaattgtacagtctcttctagaaaatagaagaggaaggaacattttccagttgattttaggaggccagtattactgtgatgctaaaaccaaataaagatattactaaaaaagacaactacaaaaatatctcccattaacttagatattaaaatgctctataaaatattaacaaatcaaattcagcaatgtataaaaagaattatacaccatgaccgagtgagatttatttcaggtacacaagtcttgctcaattatttgaaagtcaagcaatgtaatctaccctatcaacaggctaaagaagaaaatcatatgtagaaaaggtatctgataaaatgcaacacctctcatggcctgtgtccctccctatgcctcctggatttatatgttgaagtactaattgccagtatatcaaaatgtgactgtattttgagatagggtcagttaaaatgaggtcatgagggcaggtcctactgcaatatgactggtatctttagaaaaacagataagggtatagatacacagagatagaaaaccatgtgaagacactgggagaaaatggccacctataagccaaggagggaggactccaaagaaaccaacactgctggtaccctgatttcagacctctagcctcctgaattgtgagaaaataaagttctattatttaagtcaccaagtctgtggtactttttatagcagccctagcagactgatataaacacctattgaagataaaatttcttagaaagtaggtgtggagaactgcctcaacttggtacaaaacatgttcaaaaagtctagagctaccatacttaatggtgagtacaagactgaatgtttttctgctaggactggaaactaagcagggatatcttctctcaccacttttactcaacataattgtctgagttttctgttgcttataacagagtacttgaaatgcataatttataaagaaaggaatttatgtcttatggttatgagactgaaaagttcaaggttgaggagccacatctggtgagggccttcctgctggtgggggctctctggagtccagaggtgacaaaaagcatcacatggcgaggggctgaatgtactcatgtgctagctcaggtctctcttcctcttcttataaaactaccggttccctttccgtaataacacattgatactctaatccattcatgagggcagagccattgtgatccaattacctcttaaagccccacctctcaatactgccacattggggattaagtttcaatctgaattttggaggggacattcaaaccacagcaataatattggaagtttagccaaattatgaagcaggagagaaaaaatgtatgagaaaaaaataaataaaaggcacacagattggaaaggaaaattatacatcaccccaagttttttggagagaaagtagtaaaaatgggtatattttgtttagaaagtaatgcaaattaaaaccacaatgacatattattacatgcagctataagcgtatacagaataaaaaatagtgatgatgctaagtaaatataaatgaacaagggtgataatgctggcaaggatgtggagaaactggatcattcatacattgctggtgatgatgtaaaatgatacaggcactgtataaaatagtttggcagcatcctatgaaacaaaacatgcatttgccttacaatccaacaattgtgctcttagacattcatccttgataaatgaaaactacgtgcacacaaaaatatgtacatgaatgttcacagagattttttcatgactgccaaaaactggaaacagatgtgcttcagttggtaaaatctgtgatatatcatgtcagggaatactacagagcaataaaaaggaacaaactagtgatacccacaagttaggtggatctccagggtattatgatgagtgaaaaaagccagtcttcataaagaaactgtggtacatttataaaatagaatattatccagtgataaaaagaaataagctatcaagccatgaaaagaaatggagaaaccttcaaagtcatattgttgagtgaaagatggggacgccaatctgaaaaggcttcacactgtatgatcccaactatgacattttgaaaaaggcaaagctatggagacaataaaaagatcagtggttgctaggggtttggagggaaggagaaatggctaggcagagcacaggctacttttaaagcagtgaaaatattaatatatgatgatgggtggcattatacatttgtcaaaacctgtaaaacatacaacacaaataatgagccctaatattctgtacacttaagatcataatagtgattcaccaactataacaaacacaccacactaatgcaagatattaacaatagggaaactggggtggagaacaaaggggtgtataagtctctgtactttctgctagtttttctgtaaacctaaatggctcataaaaatgtctatcaattcttttaaaagctaatttcagaaggttacatatgatatgagtccgtttacataatattcttgaaatgacaaaattataggcatggagagcagagaagtggttgccagaatttagagagattgggtgatgatgaggtatgtatggggagaaaggtgactttggttatgaaagaatagcagcagaatccttgtggtgatgaaactattttgtgtcttaactgtggtggtggtgatgtgaatctatgcaaatgataaaattgcataaaacttcacacatatgcaagcacacacactgtggcacataaaacttgtgaaatctgaacaaggtgagtgcattgtattaatgtcaattttctgattgtaatactgtactgtggttatggaagacattaccactgggagaagcttgttgaagggtacacaggatctctctgtatttactcttacagtttcatatgaattttaaattatctcaaaataaaaaaagaattaaaaacaatttaatgttttcagtaggttgttctcataatatttaaagcagggcatagtttttaatattgtctaattttgtttcctttcagtctatgcatattgatgctactttatatacggaaagtgatgttcacgtgagtatactttttttcaaaattgctatttgtcttgttattaaagtttttaaaagtatatttttgtaacaactaaaatatggtagttttaaaatctaacttttggtgtgtttctataatatatggtcaatgagttttattagtgattattgagatgggacttggggacagatagctacatcaatgctatttttgtaatggtgccaaatcaaaatattaaaagagtcttttccatcaatgtcaaacaagatacattatacgtttttgtgatgcagttgcatcatggtgcaattagatgcaaaaatcagattaactgattcaatttaagagtagccaatatatcagttatttccaatgctgtaatgtatcaccatctgcaatcatattttccataaattgcttaaaatcattcatgttctgcattttacatgattctctacatttgtcagaaaaagattctaattattctctatgtgagaaaggaaacataacccatgaaacttattagaactgaaaaatggtcttgaacttgtttcattaataccctgacatttcctaaggaatgtaggatttgtcatgttggtggtggttcttcccttcagtattgttactaaaaccaagaaatgaatccccaacttcacgtcagggaaaacaaactctatgtcctctctccattattcctcaattagaacttctcttacatagatgactttctaagcattggaaagaaaccatagtcagaaactagaaaaaagagatattcactaaccaattgggtcatgctgctgcacaaagaaattgtctccctcctctggcttcagcatggattctgtttttctttgcattttttgtaaaatggaaagtagtcaattagccaccaaattcagcatcctgaaattgcttttttgcaagaagataactttgcaacccatgggttagagaaacaaccttagattttagattttagattttagaagtttagattttaaaactgactccaccactttttacttgtgttaccttggagattgctaaacatttctgaagctcatttttattattgctgatatggtgacagtatttgtctttcaatcctaagcagtgactgttgggtttaaggaatattaccagtgctgggcacatgggtgtattccttcattttttttatccattcagtaagcatttgtgaagtgtctgcaggctcccaggtactgtgcaaggtatcgaggacacaaagtcaaataatggtcaaatccctagatattccttgtttcctttctttaagttattgttaaagtaaatgttgtggaaaacatatttttgtggcacctaagagagccttttctgatttgatctgcctgtaagtggacactagtcctgctttgatttttctaataaatttcttggaattacttctctccctctggaactttggaacttgaaagaacagtataattagcagctaccactatttaaaatgttaacaacacaatttgattctaaaaattcttacaaataaactgtctatattgatgttttcagactctaaggccagtattattaccctttccacaggggaaatgtgctcggtgagaaaaactggccactatttctgcattttctagtttcatgttcttctgtacaatattgccatccttcttgattgtgttttgttggtttgttttggtttttattttaaagccaaaagaaaaaaaattaagctgcctcctatgtaaaatttcttaaggatattgtgtatctttataaaatatttggattgactttttgaaaatcaaaattacatcagtatgaaaattaataatcagaaaaaagtaattgttctttataacttttatttttagcccagttgcaaagtaacagcaatgaagtgctttctcttggagttacaagttatttcacttgagtccggagatgcaagtattcatgatacagtagaaaatctgatcatcctagcaaacaacagtttgtcttctaatggggtgagttttccaacagttgcttagagttgcatcttatgttttgggcctgatttggagaagtcattcatggacaagcagatcctcctaaggggcaatcaggagaaggagtcctgttccagtggagtggtgtgcaaaagtggcaccatctccagcatgcacacaatgctaaactgttcaatgattgattcagtagacaaacatttacagaataatgccaggtagtgtgcttcagtgctagaattatagttgcaaaccagacagacaggtcactgacctcaaggtgtttattgtcaggtgcagtggatagacattaatctaattacatactcaaatgtctaacatcaataatagtaactcacatttattgagttattactgtatgccagacactattctttgagctttaaattgataattcatttaatcctcatgataaatctgtgagatagttatctttatttctgtttgaatgttgaagaaattgtagcactgagagcctggatcactcgcttcagttcatacagctagtaaaatggggagccacaactcttacccgagcagtctgtctgcagagtctgttatctcatgagaagataaatgctttaaaaagataacaatgaaaatattaatgattcgagtataatctgggacatcccaggcaacttgagcagtagagggttccaggagagcaaattctaggtactcgtatgataggctggggaatcagctgtgcaatggccctgaagtgcaaagaattagggctttcatggcaaaacaccagtggccaaagcaaggtagagagaaagcagttttgcaacaaagaggcataatcaaattagttcatttcataaatactttttagccctcaggagacagtatgaaaaaatacccataatccctgctgttaaagagggaggaaacagaaataaaccaagcactcagcaaatgagtaataagttagttatttatgaagtccagtggtgaaaaaggacacagggtaggggcactggggctccagttagggtaggctgagctaataagctgccatttgacaaagatgtgagagaatgagccttaagggtatctagggacatatgtttaggcagagacaactgaaagtgcaaaggccctaagcttgtgtgggtggacaccttgacttttctctaaaaatacaagactgctttaggtctttgcttcagtgtcaccttctcagtgatttacctatttacagttgcaatcccttccctatctgagcactccctgtccccttctctgcgtgtcccatatctggaatatgatatattttatgtaatgggtattgtctgtttttccctactagaatgtcagcttaaaatggacaagtgtttttgttttttattagtactatatccaaattcccagaacagtgtctcatatatattaaatactttacatatgtatgaaatgaatttattaaggtttataatactcttatgatgttatctccatcttattggtggaaagagtgagccacgcaacaggtaactcatggcaaaataaatgatgagctctttaatgtgaatgttgatagtcatcctcatcatgacagagtgtgacatacgtgctggaatgcgtgggcaggactgcacagtcagaagacctggatgggaagaatttcagttgattatgtcagttgagatgagtcaatatctctgtcttcctatctgacatgattattttcaggatcaaataggacagcattatatgaaatatgacagtgcttggcatagaggatgtgcttgataaatgtcgctgattctgaattccaaatagttaatggatataaaatctaatttttatttttgctggcacagccttcatggttcagatgatctctaaaaagtttattcttaattgctacatttggaacattctagttatccatgagactgtgtttgaagtacaacaatttgtggtattcacctaaatggctcagttcaaccaatgggtgattacagtgtgtcaggccctgtgctaaatgctagggaaacaaacatactggctctgaccttctggcagagagcttagagaatagtattacagtataaaaagagtaaaacttcataatatgaatagaatacatgacatattgtgagagaggtctaaataaggggttctgagatgtaaagatgggacattgagtccagccctaggagcccaggggttcagagaagcctccctaaaagagtacctgaataatcttaagtgcgagtagcagcagctaaaataggaatgaatgtaacagagagaaaagcaaaggcagagaggcatctaatagtatgctgtgcatggcaaggaaagccagatgctcactcagtgtttctagggcataacattgaggcaagggggatatgtgaaataaataggtaaggaacagctcatgaagagcctgtgtgctatgcagggaggcatggtctttatgctagaagcagatgataggaaaccattgaagggctcaaagcaggaactccgtggtctgatagacacagcttatttttctcaatgtccttaacccattattggaaaaataaacatatatcaaatctccctgttctctttcctcgtagttcttcctaatatgctatttatttgctaaagctttcatatctcaagacctcaccatatggttcaaacgatatgatattcccattcccatgaatgtatatttaatttaattataaattgccaatttaatctctctctatattttgcagaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttacactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaattctggtaatactcactgagtgactgtggggtgggaaatgatctcttaagaatttgatttctttctattccatagtacaaactcgttctctgttgaaacattcttctatcaccccagtgccctatccatgtacatgtgttcttattgctctagtcaaacggtgcttataaatatctttcagaaagtttaggagaaatctgtatcctatttgacttccaataatcatgtattggctgtcagcttcttacctactctcagtccagagaaatagtatttggcagccactctttaaagtttatgggttgtggattgtggcggttgatttattttttttatttcaattgggatagaattttttaatatacctgtatttttgttttgttttatgtagcttttctattagggagagtaggaaaagtgcaccattttcttctctaaatttccagtccagtctttaggggaatgttagtcttcctgagatgggggaaggaaaatcataatgccagtcactttgcaaataatattttatagtgataaatggttcattttggttacataggcatacaagtgggcttaaaacttggaatttaccagggctcaaaattaaaattcttacattagttactcgatatggatcgcttcagttgatcttagaaaactcaaggcatagatctgcaaccactttaaaatactattagttaactgaagaaacaaaataatagtgtaaaacaatctaaattttatttttcatgcttatactctttacaaaatcagtctttcagattttggattcaaaatctgcctgtttgaactatcttccttaattaacccactcagtgtcatttgcctagaggatactgtgtttatgtctcatttactgccttaattgctgaaaatatcgtccatgtagaacatataataaagaaagcacagaaacgtatacttagaaactcaaatagtaaaggtaagcgtaacaatatgatatacagttcaaagttatattgatgaattttgtttttatcttttcttaatttcaggaaagtaaaagacatatgaaagaatattatctctacattctccctggcgatgaacaaaaagggctagaaggcagaggacatggaaatgtaaacagaaccaatatataattgttgagcccaggccgggcacggtggctcacgcctgtgatcccagcactttgggaggccgaggcgggcggatcacgaggtcaggagatcgagaccatcctggctaacacggt

SEQ ID NO: 11836 - DNA, 7584 bp, Human
ctgcaaagagcagggatggaagtcagagatgtgggatggcttaagggaatttagcaaaacacctgtttctctttaccttgtttaccaccaagacactcccttccccatagtgcagtggaacactgacgagccatcatcactcctaagaaacaatacaaaatgaaaaaaaacagtattgccatactcttacagtggaggcgaggaaatcttatgagtttgtccccactggctattatagttcagagtgctaagctaaagaacccctcaccttttcaatctactgtgtagaagctatatttacttacctgcacatacctccaaatatgtatcctagaaatcagatttgaaatcttataaatcccagaagtaggaagttcgtatttcaagaactacttttcaaattagtgttttaattcaacaagcatttagtgagtgcccacagttccccaggcacctccttaagtgctgagaatataggggtgaactggacccataaagccctggagtatatatcctggtgggagaggcagataaaagatctgcagaaaaacaggagttcaggaggattaagagctgaaatcaggaggcagacttctgggcttgaatacaaattctgcggcttcctggctttgtggttttgggcaaattacctgcctctctatgcctcagtttctccatctgtaagataataagaataattatagtacttcatagagttacactgagattgcttttttgactcatagtgattaaacacagccatactgaagggccaggaagctaagatgtagacagtgttttaaagggtaaaaaatggtgatgacaaattactccccacctcatttggcagccgagtgtattacatggcttaatgcatgtaaagtacttagaaatgttgctagtatggtcaggcccagtggctcatgcctgtaatcccagaactttgggaggccaaggcgggcggatcacgaggtcaggagttcaagaccagcctggccaacatagtgaaacctcgtctctactaaaaatacaaaaaattagccgggcgtggtggagggtgcctgtaattctagctactcgggaggctgaggcaggagaatcgcttgaacccgggaggcagaggttgcagcgaacctggattgtgccaccgcactccagcctggtgacagagggagactctgtctcaaaaaaaaaaaaaaaaaaaaaagaaatgttactagtatgtagtaagttctcagtaaatgttagctactatactctttcaagtgctgggtttttacttgatgtcatacagtgttatataagatctccaaagatactgaggagtcctcaaggccaattttaacaagcatggttgccgcattcttgtgcttatagttgaacatttcttctttcagacacttgcacaaagggatacttctaagatgcatttgcattaggtggcaaacttcatcctgggtatgaaaaacattgagatttgggaataaagcatagtaagactgaggttgcaattactaaaggaaaaccccaacagagataagtgaagttctgcaatatcatgcaccctcccccaacccgctctgtctccccaggccccccttcgttagaacacccatgactggctatattatatcagcatttcccataatgtaaaaagggaaaatacagacctgggcgttcatggaaagtattctaactctcacaaccagaatccctgtctttgaattttttttcttggtttttagatctttaacttttccttcagcatttcagtactcaactttttgaaaatcatcttttctgaggaatgatatttcctggcacagcatcatctctgtcaagtgactcagtttgatttttttgtttgttagtataaagtggccccaacttacagagaaaaagtgggctcttggtatcagtttgatgtcagggtttttccgtgtttgagagggagctttaaataccactcgatttgaaggtgtctgcaagcgagctccagtccgctgtcaagatgcttctggccatggtccttacctctgccctgctcctgtgctccgtggcaggccaggggtgtccaaccttggcggggatcctggacatcaacttcctcatcaacaagatgcaggtaggctgcagggggagcccatgggaaagacagctactgacaaagtgaaatatgtatgaggatgaaaaaactcggggctgactaaaggttcttatctctctatctactttaggaagatccagcttccaagtgccactgcagtgctaatgtgagtgaatgctctttaagaactttccaaattaattttaattttcacatctggaatcttcactctgaaatttcccttgcaggtgaccagttgtctctgtttgggcattccctctgtaagtatagtgaaataacataatgttgaccttggatttttttggtttgtttttaagtaaaaataagttgctttatttaatatttaatgttatacattgttgcttaatttaattgttacagattagtattccctgttaaaaccacattgttacaaattattcccttttaaaactacgatcttgaaatcctatattatgaacatttctttgtatttaattaactttatgcctcttgagaagtttgaacacttttcaacattaaaaaaagaatcctgaatatctttttagataggtggccatgtgcacaattaaataaaactggaactaaggatataataattgctgtagctcatatcatattgctttctaactcatttactgataactctagagttgtgaaacaatgtaaataaaatgacaactccttatctttcatctgtcatgaatgatctatgcgctatacctccccctccctgcctcctcccttcctccccaccaccctgttgtctgtctagctgattagagtgactgttggtttgaatgctgccctctgggcaggtagaggatctgaggttgtgagtggaaggagggcttccagagggccactgcccactacggcaggaaggatgggtggcaggaaagttctgattcctaattcaaactcctggttagggtgaggaggaggcacttctccaaggtgcagtgctttattctttctcatgcaaggcctgggagaatctgaagaatctgagcttcttgccctggctagggtaagacatcgcacccatcgcggtccatccattagatgagaagaggatagagtgccttctgggcaggaaccaggcagacagcacagcccctgtcccttggagtaccgtccatgtttttagctgctgctgaaataccagctgcattcaattgtcacatcccattagctggtgtgaaaaggcttttcctcactctgcactttcagacttacaagccttgaagccgggaagcacccgttgaaaagaacattcagagccgactatttcagggcccagagccctcatgtttcctggatgtaacatacaggaagtctcctccaggggatgtcactgtggaaaaatggcatcccctttaaatacgggagatcacttcctacattggcaagggacctgtctaaaaataatgcaagtttgagtaatggtgattaaataaaaatcatctctattatattgctctttgtgatatatttccaaagctgtcctcagaatatttctttgaataaatccttactatttaccaggacaactgcaccagaccatgcttcagtgagagactgtctcagatgaccaataccaccatgcaaacaagatacccactgattttcagtcgggtgaaaaaatcagttgaagtactaaagaacaacaagtgtccagtaagtttgttttcatatgtgatatgttcctgttggtgatttctatgtgaatggtgatgccaaccctgtttgaacacaaaaggatgataaagttggaattggtagttcaaggttgataaaagacatctaagaattttaatcagaagtaatataattaaagtgagatccactgaaacaatagaattaaagtgagatagatcattgttcctgacgaggccatttacttctctctactatggaataatgaaagaatcctttctgagtgtaattagaagctacaatctagagaatcagggatgtagctcacataatactaaattatcctagagattcaatgtactaactgaatggatgttgttaacagggatttttttttcctgttggttaaggaggttttgttttgttttggagacagagtcttgctctgttgcccaggctggagtgcagtggtgccatctgagctcactgcagcctctgcctcccgggttcaagtgattatcctgcctcagcctcccgagtagctggcattacaggtgcgtgccaccatgcctggctaatttttgtatttttaatagagatggggtttcaccatgttggccaggttgctctccaactcctgaactcaagtgatttgcccgccttgacctcccaaagtgctgggatgacaggtgtgagccaccatgcctggcctgcattaaggaggtatttaaagggcaatgcacccaggtcaaggtggaagcttgctactcatcctgaatgcccatccacacattcttttcttcagcatataccctagtccctgacagcagactgggatggcaagttgggtagaggtgacctccctctgttttttgggtattagcatctccacacaagatcctagaaggctgaaagccctgagctcagctgtttagctgcatgcgtttctaccatcaatggcatctagttctaagtgcttaatatatgctgtctcactgaataaatacataccttagggacaattattcaatttattactctcagtgaggttaactaatttgcctaaggctgcatatttgataagtggcagagctgagatttgaactcaggcctatatgacctcagagccccactcttagccattgtactgtcaaatgaccttggaaagacaacctaaaaggataatgatacaattttaggcctcaaagagtccccagaaaaggctttctctaatgcagagatttagggccacttaataggggtgtgtgtgtgtgtgtgtgtgtgtgtgtgtgtgtgtgtgtgtgtgtgtaaagacccctgaaatccaatttgaggtcaaccacctatgctgtctttacaccacatgagctagcctggacctgcccacctatttgctctgtgtctcaagccacttcccttcccatccccacaatcctcaccaccgactctggctcttggcaggtaggcttctggggctgcttggctctacatcatttgagtcactctgtccttatcaactttcatccccacagtatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaatacatatgtggaaaaaacaacatgagctggtctcttggcaattattcatttcttgctgctcagaacaaagaaagctacaagtgttgttaaggggaagaatagatcagagactcctgtaggagtctctgtgataagactcctgatgctgaatacagaccctcaggctcataggctgtggctggagctgcaggagggctgcagggagcagttacaaagaatgtctatgaggaccatctgagggttgccactaggggaggctgaaggcatgtctgacactgctaagagggctagggtcctgagaaactggccttgtgcctgaaagaggagaaggcagcagcttggaagtgggagactgctcaagaatgtgggcatgcagaataaatgcttaataattaagtgcttaacccactagttatggtaggaagtagatattattattatgcatttctgttttatatatactgaaaccaaagcttagaaagtctgcatggcattcccaagatcccacaggtggtgagatttagaagaaggattcacccctcgtgctctctgcttccaaaccctttgctgtttgcattctgcccctttcttattctctttataccaagggtgtgcattgtgcttcttccaaccacagcctgagggtaaaatagacccatcataattccagtccacactctcatatccagaaacctagggagtcaggtttcagaattcaagctttttagccttttagaaagttaaaacaatccacgtgccatatattacataacacccacagcagggcctggggcaagtttccataattaaacatatcaattctgcaacagtcactgaaatggtcaggttttgcagccaaatgagtcctaacaaatcttgagttttcgcagctgtttggatttcagaataatgataagaaattagtaagctgcattaacaaaacagcctttctctagctcatgccctatttaacaagggaggtgggggtggggggcactcttacgaagacattttatgtggggctgggctgggtgtctccaggagggataaaggtttctgtagcttcctggacagccagccacatggagttccagatcacagctgaagggccttctcttctcctctcctccatgtgggttttctgaatgactggcgccagacatagttgaatcatgtgacactatgtggtttaccacctgtggcatggggagacaccagcccaagcaggatcccagcagggacagatactgatggttggtgatggtttcagaatataactcggaaatgcaatgtcttgccagaggagacgggcagagacgagcttccactcactgatgcagattaatcaccagcatagcttggtgctttccctaggcttttctgcaaaagtcacataacctgcagtgttcattcctgcaggcaagctccaaggagggttcacttacagtaaagtgtgctataattaccatcttctctgtgccaggagagttgagattcatcaagaagccaccctggagaaaggagaactaatatttattgtttactctgtaccaggcagtcctctaagcctattttgtagaatatctggttggatcctcacaacaaccccatgagatatttatataattgttgtatgtaatttttcccactgcacaaatgagataagtaggcccaacgaggttgcataacttggccagaagcacgttgctcacaagcagtgaagttgctaccctctccaggttgccaggccccaggcagagttgtttccagcagattccagatcaaagcacacactgcaggccaagatgtggccagccataaagctagcttgcccatctatccatccatccctccctctttacatccacccagtttgaagcaggaagatgctgtgatgttcaaacctcacaattcctctcctcccattgtcacattgtcactctgcttcattgaccccagaccaagacctccctttctctgcaaaggaaggcctcagcagaa

SEQ ID NO: 11837 - DNA, 5143 bp, Human
attattagagccaaagagagagatagacagacccccatacaataataactggagacttcaacaccccactttcagcattggacagatcatccagacagaaaattaacaaacatcaaatttcatctgcaccataggccaaatggacctagtagatatttacagaacatttgatccaacagctgtagaatacacattcttctcctcagcacatggataattctcaaggatataccaaatgctaggtcacaaaacaaatcttaaaatttagaaaaaaagtgaaataatatcaaacgttttctctcaccacagactaagaaaaaaagaagtcccaaataaatacaatctgagataaaaaaggagacatgacaaccaataccacaaaaaattaaaggatcattagaagatactatgaaactatatgctaataaattggaaaacctgaacaaaatagataattcctagaaacatacaacatactggtctgttcaggttttgtattttttcatagtaccatgaagaaatacaagaattgtttctagaaccattcttgtatttcttcatggtttttgtatttcttcatggaaccatgaagaaatacaaaatgtgaacaggccaataacaagtaatgagacagaagccatactaaaaagtatcccagaaaagaactcaggatctgatggcttcactgatgaattttgccaaatatttaaaaaactaataccaatccaactcaaattattaaaaaaatagaggtggacagaatctttccaaatgtattctatgaggccagtgttttttctgattgaatctcccattatattttaatcacatataaaaccagagaaagacacattaaaaagaaagaaaactgtaggccaatatctctgatgaacattgatgcagaaatcctcaacaacaaattagcaaactgaattcaagaacacattaaaacaatcattcatcatgaccaagtggaatttgtcctagagattcaagtgtggttaggtatgtgcagatcaatgggtttaatgttgtccaatgaacataatgtcctccagctccatccatgttcttgcaaatgacaggatctcattcttttttatggctaagtagtactccattgtgtataagtgccatattttctttatccattcatctgttagacacctaagttgcttccaaatcttagctattgtgaatagtgctgcaataaacatgggagtgtaaatattttgttgacatactgatttcatttcctttggataaatacccagtagtgggattgctggatcatatgggggaaaatggagatggctaacgggcacaaaaatatagttagaaaaaatgaatatgatttagtattcgatagcacaataggatgactactgttaatgataatttattatatattataaaataactaaaatagtataaatgggatgtatgtagcagagagaaatgataaatgtttgaagcattggatactccattcaccctgctgtgattattatgaattgtctgcctatataaaaatatttcacttattccataaacacagacgcctcttatgtacccacaaaaatctattttcaaaaaagttgctctaagaatatagttatcaagttaagtaaaatgtcaatagccttttaatttaatttttaattgttttatcattctttgcaataataaaacattaactttatactttttaatttaatgtatagaatagagatatacataggatatgtaaatagatacacagtgtatatgtgattaaaatataatgggagattcaatcagaaaaaagtttctaaaaaggctctggggtaaaagaggaaggaaacaataatgaaaaaaatgtggtgagaaaaacagctgaaaacccatgtaaagagtgcataaagaaagcaaaaagagaagtagaaagtaacacaggggcatttggaaaatgtaaacgagtatgttccctatttaaggctaggcacaaagcaaggtcttcagagaacctggagcctaaggtttaggctcacccatttcaaccagtctagcagcatctgcaacatctacaatggccttgacctttgctttactggtggccctcctggtgctcagctgcaagtcaagctgctctgtgggctgtgatctgcctcaaacccacagcctgggtagcaggaggaccttgatgctcctggcacagatgaggagaatctctcttttctcctgcttgaaggacagacatgactttggatttccccaggaggagtttggcaaccagttccaaaaggctgaaaccatccctgtcctccatgagatgatccagcagatcttcaatctcttcagcacaaaggactcatctgctgcttgggatgagaccctcctagacaaattctacactgaactctaccagcagctgaatgacctggaagcctgtgtgatacagggggtgggggtgacagagactcccctgatgaaggaggactccattctggctgtgaggaaatacttccaaagaatcactctctatctgaaagagaagaaatacagcccttgtgcctgggaggttgtcagagcagaaatcatgagatctttttctttgtcaacaaacttgcaagaaagtttaagaagtaaggaatgaaaactggttcaacatggaaatgattttcattgattcgtatgccagctcacctttttatgatctgccatttcaaagactcatgtttctgctatgaccatgacacgatttaaatcttttcaaatgtttttaggagtattaatcaacattgtattcagctcttaaggcactagtcccttacagaggaccatgctgactgatccattatctatttaaatatttttaaaatattatttatttaactatttataaaacaacttatttttgttcatattatgtcatgtgcacctttgcacagtggttaatgtaataaaatatgttctttgtatttggtaaatttattttgtgttgttcattgaacttttgctatggaaacttttgtacttgtttattctttaaaatgaaattccaagcctaattgtgcaacctgattacagaataactggtacacttcatttatccatcaatattatattcaagatataagtaaaaataaactttctgtaaaccaggttgtatgttgtactcaagataacaaggtgaacctaacaaatacaattctgctctcttgtgtatttgatttttgtatgaaaaaaactaaaaatggtaatcatacttaattatcagttatggtaaatggtatgaagagaagaaggaacaaccgatgatttctctctgcagaaggtagattgaggcatgtgaggaaataaaaataagacagagacattctctttaaattgactagtatacatctattagaaaatgtccattgccagttagatatataagtttgcaatttgcaaggaatgcgattgctgggggtttatatgtgataagagaaagccaagaaatgaaggtcatggtgttgggagagagtgtagagagagaaaaagttttaaacatgattctgaggacctttcgcttttaaagggaggggagagaaaagccgcaaaggaaacatccacagccacaaaggaatggctgtacattagaaggcaacagcagagaaagataatgaaagtgtatttaggaagataaatgcttcagcccaggagttcaaggctgcagtgagccatgatcacaatactgcactcgagcctgggagacagagggagagtgaccccatctcaaaataacaaacaaacaaaaggaaataaatgtgccgagaagaggattcagtcgatttgcccaaggtgtggcttgaaactgcctactaattgggaaatagatggcattggcacccttagtgagaactgattgggtaaagttaatacacagaagccatattggaggaagtttaaataagataagttagtgaactgaagtggagaaagaaataaaatgggattaggaaaggatgtgggttatgttttctgggcatagtttttccttttttgcaatgtatatttttctcaatagatttcatgtaattgaggtactggcaaatgacattaatatatttcatatatttattttaagtcacggcatatttaattacaatagtaatttatcagttttaattaatactactgtgactatcagtaagatgcctagttttgttaattatttaggcaggaatagataactaattcaatctttcatcaaaatattcaattaatattgataatataatggttactgcaattactggctttaattaagttacttaacttgcgccattgtcatgctagtttactacaacttgactgcatttctccggtagagccagatatgataagaaatcttttataatactccttggtaatttttccggattttatgaatattacaatcttacatgaatacaaaaataactaaattaccataaacatataaactgacaaacttccttcacaaattaaattaggaaactggatcagagaatctcttcctccatacttaagggaaagaaaaaaattagtcaaaccagctaaaaatacaacccgaaccatggaaattcagaaagtaccaaagagttgtgtataattcacgagtacaaggagatttagcaattgtaatagaaatccagaaaaccaaactgacaaaatcactcataatttgcattaaagactttaacgttgaaatttcattctgcttggatgtatgtgtggtgttgatcaacccacttattctcactgagcctcacttttctcataaaaattgggtttaaaatatttatgtagttgtgaatattagaaaaaacatgcattttaaagcacctaccactgtgtctcctatctagtaagaagttaaaatatgataggtatttccctattttcttcatacagctgtagatgaggataatatttatctttctataaaattcttaggacctgtgtcctgcatttcagtaagtgactgccaatggcagcagcctaaaaaaactagattctgtcagcaactgtagagtggttgaaaaacagtcactcctcatttcaaagaagtgtcctatttatatgcagtcggggaatggtggcttgtataaatacctgagacaggagaataaacata

SEQ ID NO: 11838 - DNA, 18926 bp, Human
cctgcgggaggggcagcggccaggcctgaatccctggttcgccctcgactcagcccacgcgggcctttcaggcttctgggacagatcctaggtccagctgcccacctgattttgtggcaaagaaaaaaagaagaagaagaagcgagaggcgatggcgtttgctttggccagatttaagggcaagcgaggctgcgcgcggctcccgcagggtcggatctccgagctccagggcgcccctccacccgggtgtagatttcccgcggaccccttcgccctcccgggtttcatcagctgcgcaggaatggagctggccagagctctgggagcggggagggaggcgccgccaccagagggcgccggagccccagcgctgcggccggtgagcggccaggctccccggcccagcccagcaaaggcctggggacgcccgacggctgccttcttcactggacctcactgccttcagttctttaagagcagggccaagtcagtggggttcccggctccaagcccagtgcccagggtgggtgggtgggtgggtgggtgggtggatggatggatggatggatggatggagtgccggcccacagccatctaacggccaaagtggttttggaaaaaaaatgcacagaagacacctactcccaccagcggagttccggagccctcgcagcctcctgttgaccgctcccgcctaatgcagccgctgaccgcccactccccgacggccaggactccccagggacagggacgtgtccccagggcaggcccctggatggacgcggcgactgaccccacttcgctggacgctgtgctgggaaggacacagagaggtggctggggcagcctgcggtcacaaagcgaggcccaaaggggcgctctcctcacccccacgcctcctgggtgccgacctgcaccctcccttcgccaccggactggggccatctgggatgtctcgggggtatccggagggctaagcaccgccgagggacggctccgtgggaagagttttctggacccagaaggcagacgccagtagtactgtcctaggagtcggaggtcggggtgggggagttctcagctctttgggtcgcacggagcttttcttgggtaaggcagtaagtacttaggtttaaaggacttacttacagctaccatttattgagtactgtctgcttgtcagacacgatgcagagaatttcgcggcgtggggcgggtctcattgaatctcccgtcccactccgcggggtgggcctgtgattagctcatttcaccattgagaggtcggaagtacaaaggctacattcgcttttactgagagccgccggcgccttctgctttgtttgtacaggcgaggaaactgaggctcggctggtggcgccgtgggcttggagtccgagccacgctgactgcaaagacgggtctcattcccgcagatcgagctctgccggcggctgcgccgcaagccgggcaggtggcgagcttgagcccccacgcacagaaagcaggaccccctcggctgccttgggccgccaccgccagcaggccctccgcccgggactaacttgtttgcttttcattggttctcattcagttcccgccatcgaaaggccccgtcccgcagctttccacgcgcgccccactttacgcctaaggtcctcagtctctccagtggggccctgtcacagggacaataagcggccctccagccggcgtcgctcaggctgcggacctcactgcagaccgggccagcggtgcggggcccagcggagcctgagaaggtcaaaggccggagcgcactgcgcctcgggagcacagagggagcggaggaggggcgaaggggatgggtggggggtgccgccgagggagtcgcgcgtcagagaccccggccacggccagcactcggctccgggcccgcccctcaccgcgcgccccgccccgccccgcctggctctcccctctaaagcgcccggcgcgcgcctcccaccgccgcactttcactctccgtcagccgcattgcccgctcggcgtccggcccccgacccgcgctcgtccgcccgcccgcccgcccgcccgcgccatgaacgccaaggtcgtggtcgtgctggtcctcgtgctgaccgcgctctgcctcagcgacggtaagtgcgctcggcggggaggccctggcgaggctctgggcttcggctcccgcccggcgcagagccgcggctcctctgcctgcgcccgcagtttgcgccgcccgacacagtgggggtggaggcagctcgcttagctgggcgctctggtgcggtgtcgcgttcaaagccctacttttgcgccgagggtttgtgacctgcagagagcgaccgcctgacctcaagctggctgcagagcgaggtcagccgggacaactgggcaggaacgccccaagagagcgttcgggactggcgcgggaaggcgcgagggtggggagccgcggaccccagacccctgcctgcccaccctccacccactgccttcccgctgcgggctcggtttccacaggcgaatgggctccgaggtcctgctgcgcacagtgctggaggtcgggcggtgcatggcgagagcgcgctttgcaaagttcgcctcatgccgcgacttgaggctgtgaggtccgatgcagccgcgcagcctccgctccctgcgaagccgatcctctccccacaccctcgcggggctcttggccaggcgcgggcgggctgcgcggcgcagctgtcgggcttgtgccacccgccaggccgcgcttctgcacagctccgcggtccgcagcgacgcggacctgggcgcgcgtccagccgctgtcttcctgtctcttctcgggttcacctgagagaggcccagggaccctccgagcctcacacgccccctccccagctccccaaacacacctgcagacaggctcttttgtcaccagctggccaagcgctttgccccagaatgagagctgcagcaaagttcaatctccaaggccctgggccactgggaaccgtggtgtcccgtttcactgggagagggcttttttcttttctttcgctgaagagaaactcgctgcgctgtcacaggacaccgatgcaaaccaaaataaactgttgcctctgaacacacaaaacaaaaccctgtggctcaggccgctgagcttccttggctgtgaagtttcctgcaaagagttgaaggacactctgagtgctcttgcagccgcgggctgtgcaggcccagcgcgcctcgagcccttggctgggttggtgcagacgtggccccggcgtcctagctggcttggactgtgcgctggtgtgagcaggaccagcgcagctgagtcgggctggagaagctgggcagcctggggtcgtggcggactgcctaagtgttaaggacacagactgaaggcaattgggaatgttcgtcgttgatgaaaagtccctgaggctgtgtctgcacactgaccccccccccccccccgcaagtcatggggcatgtttctagtttttattgctggatattcttctgttcctgtaaggtctctggtttgggcagttattgactgattggtgggatgagcgcggaggtgtcacagtgcgccgctctgggaaatggtgctgccccctccccggagggctggagagaggattggaatgaggaacctcggtctttgagttatgggtgcaactgacctgggggaagcacagagacgtggggttcatcccagactcctcctggcctgggaagggtgacatggccctcagagttgccccattggcagccaagtaaccagggcaggagcctgggctccaggcagatctgctccttacacacatcgccagaatgttttgttttgttttgttttcccctcacctcacagtgcctatgtgccccctatccccacacttagtcctcaagctgcactacagagagagcttggccaggggtcctgcccctcccccattggctgacttccgtcaggcagctgggcccttgggtttcccgggcttaaactcagggtgggcccccttcccaagcctgcttggaggggccagctgggctcctgtctctgcattagactggagggctttctgaaaactcctggagccaagctcacccggtcccaaatccggggtaccatcagagccagtcaggactcttgccggtacacggatttacatccagaacggttgggaaagttagtcttactgacaaaaagctggaggaaggagcacatgaggtacacacgagaccatgttcttttggtaagcacacctgggggctctgtcactttaaaaagacctgttgaaattcgctgcttgacaggcgggccttaggtcctgggagtagaagcaagaattgcttttgaaggaaatggataatcccagggggtggagggggagaggagagagagcctgtgtgttgagctctgaataggctctgatttctggcctcatcaccactgcttggttggggggccagaggagcttctctcctctgggcgctggagagtcacagccccacccatcccagcgggggcggctgcagcacttgcccttggctgcatatcttcaagctcactgttgccgggagggggcttgtgcctcactaccggcctcctattctcctgctccacccccaacccaccccctgcctcagcttggaagggcccaaaagaaatccagggaaacctggaggcacaacactcaggagcgtttagctcctcagttacccaggctgcaggccccggccctgggggtggctttcccaggtgatctggttacagtgcagtgctgacttcccctgcagggtcccagtgcagctgctggaagctggccccagaggtgcctttctggagttagatcaggtgtaactgtgaaggctgctttaggtctctccagtgccatgagtcaccagcaccctgatgcttggctttttcctggttttcagggagttgcatttggtcctggggacaaggaagtggggggacaagtggtccacttttcctgcaacttggtggctgaatacacaatgcaattcctagtccacatcatccctcaattgattgcagtctgtagaaaaaataaaataaaatgagccccttactcaagatttcctcctacttccccagcattctttcccaaaggtgcagaatttcagaaccacagaggtctctcagaactttgtaaacaggcaaacttaaaaaaaaagaaaaaagaaaaaaaatctctggaccaaatattcttagacatatatttaatctctgatgaaaggatccacaagttcaaataatttggggtattaagtggggcttggataaaatcttcaaggaaaaaagaaaaacaaaaagcacacacaaatcccagccctccagggcttgcaatcctatatttaaagggtgagcagtgggttctgcaggagccccttgctaatttacactaatgagtgtcaattatggcattttgtaaattggtgattttgcaaagatcttaatacaattcctgaggctacagcatccctgcctaggcaatgaaaaccacatttaactccagctccactaatctctaagccttggggaaagtgctgggcagaaggtgggtccttggcctgctctcaggggactcacaggtaggaagccagccaggattcttttgtgccttccagagctttaggtgaatgtgaggaggggtctctggggtgggggagggcagcattcctgagtactactgtgcttcctggctagaggcctgtgccagaggagagaggccagggagcctggagcctcttgtccccctttcttttccctgagtagggagatctttctcagttgtcccttgaggaattttttttacaaagagtaactggaaatttcagtaccttggactgaaaccgttatctactataattactacctttatcttgagacactgagcaggtggcttctaatttaatctcccccctcatctaggctccggctctccccaggcctgttgggctccttgccctgtagaagctgagcctgagctcagccagcactcactgtgttgcctgaggagatggcctttcccaacatacaccagtaacctggaacttaccccagtgatgccgtctcttgatccttaatcgctgcaccaactgctgcagcccagacacacattaccaaaatctggcagggtagtaaagtgccttgttgtccttacctcttctagggaagcccgtcagcctgagctacagatgcccatgccgattcttcgaaagccatgttgccagagccaacgtcaagcatctcaaaattctcaacactccaaactgtgcccttcagattgtgtaagtcttgaaattgaacatcatctaacgaacatagttgcatctaacgaacatagtaacatctaacccgagtcttattaaaggtgtagaggtgacaagccaagtgtccaaccttgaacttggcataattagtggcagctattcttatcatgaggacctttagtatgccaccaggcattaattttaaaagccgctcttggcctgggcaccctgctgtgctcgtagtagttctctcttctttccaaacctgtgttcttcagcacagcacagctggatgctggagaaactatgggcttcaccaaggttttggctgaagcctagtaaattagccagcccttagctaataacagtgataactggcctgccagtttcggggatctgatgccctacattaactcacaagacccaaatgcagtttaagtcctctttaaccattgggtgaaacttcaacattttcagctcacttgcctgtattttctcaagtacaacatatgaggttttggtgttatttggtgtggatggcagccactaacatttgattttattcatttgggaaacaaagaccaaaatcacacatccacaagacaggaagatctcagctgggtacagaagaccgggagaaatgcgggaagaaagccatgtgcttgaaagccctctcatgctcaagaggtcctgtgtctgaacacggggaagcgagggctcagggagtctcctggagaggatttgattgctcagaagttctagtgctaaaaatggggtggggagacagcagttggaaccaaagctacaactttcccaagacttttccacccaacaccaaatgtttttacttttgattttagaaaactgtttttagttttgagttaaccctttactgccttgaatgtgtttgttatttacagtatgttttagggccctagaaaatgaatgttttttcagtactttgcctacaacatgatactttatctcttgtgaagagtattttaaagatgctcaatttagctagcttggacctgctttacagcactgatcatgctggtttactggcctggaaatgcaccttgaagttgaagatgccaaatacaattctcaggtctgagcagacactaaattaacaaagaataggccccagatttggaccccaatgtgggttgctccgagccacacccatctctgcacccctcttcacctaatggacaggctgcttgaagactccctgggtgcccctgaaccactgttctggggcttagctgtcctcaagacccttaagtacttgggctgcatgagattacctggcaccaaagggctttctggcaagagatccagagagatgaaatcaggccttccccaggagtttgcatgtagggaagcttttaagagtgtgaacttttaaaaaacaaatgagaccaagaaacattcagtgaacttgtaaaatctttctagaaactattttctggtaagccacctgcactgcccctcccctccctggctggtcaccctcccggtcagaccgcggtgacttctggcaggcctccttcctccaggcttcctcatgcccatccttaagtcggccctatatctatcaagatgacccatccaaataaacctctgctctgttgctctccattctcccctccccaggtgcctagagcatcctgtcgtccccttcctcagtttcctctgtatgctttgatgacccccctggcgtatttgctcctgattttcccttcccgtttatttactctccaagctcctacttatccttcaaaggcagctcaaatgctcccttacatgaattcccctgcactgccccggaaagacttctgttcacatttccatgtctctgcaatggaacttcctgcactgccagcgctgagctttccccagcacaccgcgagcacctctggagcctgagcgtaccaagtggagcacggggtgccagcgagggccctagatgagtgttgggggagcggatgcacacgttgcagccgcgccttcctcctgtgcagccgcacactgttgccattctgttttcacagagcccggctgaagaacaacaacagacaagtgtgcattgacccgaagctaaagtggattcaggagtacctggagaaagctttaaacaagtaagcacaacagccaaaaaggactttccgctagacccactcgaggaaaactaaaaccttgtgagagatgaaagggcaaagacgtgggggagggggccttaaccatgaggaccaggtgtgtgtgtggggtgggcacattgatctgggatcgggcctgaggtttgccagcatttagaccctgcatttatagcatacggtatgatattgcagcttatattcatccatgccctgtacctgtgcacgttggaacttttattactggggtttttctaagaaagaaattgtattatcaacagcattttcaagcagttagttccttcatgatcatcacaatcatcatcattctcattctcattttttaaatcaacgagtacttcaagatctgaatttggcttgtttggagcatctcctctgctcccctggggagtctgggcacagtcaggtggtggcttaacagggagctggaaaaagtgtcctttcttcagacactgaggctcccgcagcagcgcccctcccaagaggaaggcctctgtggcactcagataccgactggggctgggcgccgccactgccttcacctcctctttcaacctcagtgattggctctgtgggctccatgtagaagccactattactgggactgtgctcagagacccctctcccagctattcctactctctccccgactccgagagcatgcttaatcttgcttctgcttctcatttctgtagcctgatcagcgccgcaccagccgggaagagggtgattgctggggctcgtgccctgcatccctctcctcccagggcctgccccacagctcgggccctctgtgagatccgtctttggcctcctccagaatggagctggccctctcctggggatgtgtaatggtccccctgcttacccgcaaaagacaagtctttacagaatcaaatgcaattttaaatctgagagctcgctttgagtgactgggttttgtgattgcctctgaagcctatgtatgccatggaggcactaacaaactctgaggtttccgaaatcagaagcgaaaaaatcagtgaataaaccatcatcttgccactaccccctcctgaagccacagcagggtttcaggttccaatcagaactgttggcaaggtgacatttccatgcataaatgcgatccacagaaggtcctggtggtatttgtaactttttgcaaggcatttttttatatatatttttgtgcacatttttttttacgtttctttagaaaacaaatgtatttcaaaatatatttatagtcgaacaattcatatatttgaagtggagccatatgaatgtcagtagtttatacttctctattatctcaaactactggcaatttgtaaagaaatatatatgatatataaatgtgattgcagcttttcaatgttagccacagtgtattttttcacttgtactaaaattgtatcaaatgtgacattatatgcactagcaataaaatgctaattgtttcatggtataaacgtcctactgtatgtgggaatttatttacctgaaataaaattcattagttgttagtgatggagcttatagacgtttctggtttatatagttaagcctgcctgcagtcaggtgtctgagaccccttctcacagcccatgtgtgacagtgtatgggcttttctcacgagcagattagatctgcagctcaagtttttggatcttttttttttttttttaacccgattgaaatagcagtgctggttttctgaagaataatatttgactcactaattcgtcttccctccctcctcctccttggttctcctaacttccccatgtaatccccagagactcaaccctagtaatatcaaccttttacattttcccatgtaaaaatcccatgactccaggccatggttaatatgaagctttcacagggacaggtggcctcaccccataaatcattaaataccattcagcttgaatcattttaatgtgacagtcacgagccagttgctctaataaaattctgctaaccagctctctcccttgctctccagaacaatcgcattcattcccaggagtgttcacaggcgtctagaaaggggaaggtgggaccactgccttttttctcctcttctgaatggcagtctgaacctggggcctgcagcctccaaaacgttattcaatttgaaatgcagacatttcttagagaaagctaagagttcagccctgcattgagaagaagaaaaagtcccatgagagcagggcagggtggggtgacaaggaccacgatggccagcctggccctgggtgtaccctgagatgtggattccttgtccccagtgggaatcaggttcaggttggcagattggcagtcgctgtaacccattcacaaaggtgttctaggagcccattgaacatttgtttgaatggaaggaaatgtccaatttattttaatgaattactgataaacagtgctttgaccaggggcctccaggcctgagactgaaggcacagtttaaccagtacacgggccagtgttaaatcttatgcagactgagacgaacttttgtttatttccacattattaatggttctactaattttatctaagggggcgcagagaagaaaaagtggggaaaaaagaaaagataggaaaaaagaagcgacagaagaagagaaaggctgcccagaaaaggaaaaactagttatctgccacctcgagatggaccacagttcacttgctctcggcgctttgtaaatttgctcgatcctcctccaggacagacccccatgcagactgggcaggggctcagacttccgtgggggagcagtgctttgctgccctgccagccacaccggcttctgtatttatgtgctttttaaggcccttgttggtctgctaagttatgaagaaagtagttgtgcagagactggggcgggggtctgtgacgcggagcctgtgtgctcaggactctgtccagaatagcctgggagctccaggaatgcccaggttgctgagccccccagcctgccctccacttcctctcttagaaggcctgcgctcactggggagctcaccagctccacacacttgcagtctgcattcctgtggagaccaggctgtggccacctggccagtgtgcagggcaacctgctagcccagcagaggtggcctcgccaggaagggggtgtgccacccctctgtggccctcaggaaaggtgaaaactgactgacccttaggaatgggccctggctttttccaaatacccattgcctttccctccagcactctgccacctgggaaggggcttcttcagcccctccttcctgggttgtgggagtggctttatccccaagcccgggtgggtttctgcaaactgtgtggggtgagcccgagggaatgctgcattctcagagagcagatgtggaaacacttctcagggagctcctctttgggcaattctctttagagtctttaaacgggtcccccacgtggaggacagatgtgctatggaactttgcaagggtcctgaatccctggggatcccagcctgtcccctcccgcctcctgcgtgatggcgtgtgctccagctgcagggcacagctgcctctgtcctcattcatgggaaataccttatctgcctaaagcaaataccacttaagctctaggaactttcctgcaccctccttccctgcccatgtagatgtatgtgtgagattttttggcaagtttctctaatctggaccgggaggatggaagagcaaggaccccatttcagtagtgctcggaaaaaggatgcgttgaatttctcagcccttctccacctcacataaacacccgcccaccctgcacccggatcctgggtcataattttaataaatgcagaaagagaaagtggttggaggatggagcacatggaattcaggagaaaacccacaaagacccctgcatgtcagacacaccctgtcccggagcgtggtgtccccttgagctttaatgagctccctgtgatcacagccatgccttctcctcgttggggaggtgtcctaggatgcttcagccaaagacctttgtttcccgctgctatctcttttacctggacaactctcctggcccacgttcctcttgccagcactgggggtcacaggcctgagccctgggtacaggggtgccctagtcttctgccctccccacctcttaaggcacagagctgttgggtgggctgcctggggctgccatccttcccgtggaagccagtagccactctagtccatgggactcttgacaaaagcgccccgagagggcaaacctgtgcccccatactcgcctgcattcttcggactccacatgcagcagggctttgtgcctggggaggggtggccagtctgtcctggtcagtatgaaaagctgttggccccctagggacagagggcccagctaaggctgcctgaggatacaaactgcttgctatcccactcctggggagcagggtctgcagggactgagagtgggtcccaccttgagaacgcatgcaaggtccgtcctgtcttgatgtcttgatgtgactgtatgtgccctgggggctcactgtggtttacaagtggcttgtgaagctcctgggagcaggtggtacacccagtgctgaagacagggtcgccgtggaagagcgaagagcctgaccgggattcctggtgggttgaaactaggaagtgctcacaccagtcagagccaaatgaggggtgcgctatggtcactgctctgtccagcatgcgttcctcctgggaggtcctggccacctgtgcacccacccctgtgccacctccagcagtcccacctggggccacctacggtggcatggcccctggctgagaggccccgagggcgaagggttactggaagccacgaaagtgcctcttgggacagccgaggccaggatgcagggcagcagcatcctgagcctcagccccacgccggtgccgggtaagcagtgtgccctgtccccgtcgtatgaccactctgatgggcctctctgtgccttcgtgcgtctgccacgcccagtgcttgccacgtgtctgtcctctgctttctgccatccatgggtccctccgcttcagcctggctgcgtctcgcactcccctcccgtctgttgtcgcagggcctctgaagggagatgcatggccaaggtggcaacttggaagtagggattggccccagggcctccgcgcaggccgctgtcctgctggagctggctgggtgtggggggaacctgccttaatggtgtttccctctgttcttgtcaacaggaggttcaagatgtgagagggtcagacgcctgaggaacccttacagtaggagcccagctctgaaaccagtgttagggaagggcctgccacagcctcccctgccagggcagggccccaggcattgccaagggctttgttttgcacactttgccatattttcaccatttgattatgtagcaaaatacatgacatttatttttcatttagtttgattattcagtgtcactggcgacacgtagcagcttagactaaggccattattgtacttgccttattagagtgtctttccacggagccactcctctgactcagggctcctgggttttgtattctctgagctgtgcaggtggggagactgggctgagggagcctggccccatggtcagccctagggtggagagccaccaagagggacgcctgggggtgccaggaccagtcaacctgggcaaagcctagtgaaggcttctctctgtgggatgggatggtggagggccacatgggaggctcacccccttctccatccacatgggagccgggtctgcctcttctgggagggcagcagggctaccctgagctgaggcagcagtgtgaggccagggcagagtgagacccagccctcatcccgagcacctccacatcctccacgttctgctcatcattctctgtctcatccatcatcatgtgtgtccacgactgtctccatggccccgcaaaaggactctcaggaccaaagctttcatgtaaactgtgcaccaagcaggaaatgaaaatgtcttgtgttacctgaaaacactgtgcacatctgtgtcttgtttggaatattgtccattgtccaatcctatgtttttgttcaaagccagcgtcctcctctgtgaccaatgtcttgatgcatgcactgttccccctgtgcagccgctgagcgaggagatgctccttgggccctttgagtgcagtcctgatcagagccgtggtcctttggggtgaactaccttggttcccccactgatcacaaaaacatggtgggtccatgggcagagcccaagggaattcggtgtgcaccagggttgaccccagaggattgctgccccatcagtgctccctcacatgtcagtaccttcaaactagggccaagcccagcactgcttgaggaaaacaagcattcacaacttgtttttggtttttaaaacccagtccacaaaataaccaatcctggacatgaagattctttcccaattcacatctaacctcatcttcttcaccatttggcaatgccatcatctcctgccttcctcctgggccctctctgctctgcgtgtcacctgtgcttcgggcccttcccacaggacatttctctaagagaacaatgtgctatgtgaagagtaagtcaacctgcctgacatttggagtgttccccttccactgagggcagtcgatagagctgtattaagccacttaaaatgttcacttttgacaaaggcaagcacttgtgggtttttgttttgtttttcattcagtcttacgaatacttttgccctttgattaaagactccagttaaaaaaaattttaatgaagaaagtggaaaacaaggaagtcaaagcaaggaaactatgtaacatgtaggaagtaggaagtaaattatagtgatgtaatcttgaattgtaactgttcttgaatttaataatctgtagggtaattagtaacatgtgttaagtattttcataagtatttcaaattggagcttcatggcagaaggcaaacccatcaacaaaaattgtcccttaaacaaaaattaaaatcctcaatccagctatgttatattgaaaaaatagagcctgagggatctttactagttataaagatacagaactctttcaaaaccttttgaaattaacctctcactataccagtataattgagttttcagtggggcagtcattatccaggtaatccaagatattttaaaatctgtcacgtagaacttggatgtacctgcccccaatccatgaaccaagaccattgaattcttggttgaggaaacaaacatgaccctaaatcttgactacagtcaggaaaggaatcatttctatttctcctccatgggagaaaatagataagagtagaaactgcagggaaaattatttgcataacaattcctctactaacaatcagctccttcctggagactgcccagctaaagcaatatgcatttaaatacagtcttccatttgcaagggaaaagtctcttgtaatccgaatctctttttgctttcgaactgctagtcaagtgcgtccacgagctgtttactagggatccctcatctgtccctccgggacctggtgctgcctctacctgacactcccttgggctccctgtaacctcttcagaggccctcgctgccagctctgtatcaggacccagaggaaggggccagaggctcgttgactggctgtgtgttgggattgagtctgtgccacgtgtttgtgctgtggtgtgtccccctctgtccaggcactgagataccagcgaggaggctccagagggcactctgcttgttattagagattacctcctgagaaaaaagcttccgcttggagcagaggggctgaatagcagaaggttgcacctcccccaaccttagatgttctaagtctttccattggatctcattggacccttccatggtgtgatcgtctgactggtgttatcaccgtgggctccctgactgggagttgatcgcctttcccaggtgctacacccttttccagctggatgagaatttgagtgctctgatccctctacagagcttccctgactcattctgaaggagccccattcctgggaaatattccctagaaacttccaaatcccctaagcagaccactgataaaaccatgtagaaaatttgttattttgcaacctcgctggactctcagtctctgagcagtgaatgattcagtgttaaatgtgatgaatactgtattttgtattgtttcaattgcatctcccagataatgtgaaaatggtccaggagaaggccaattcctatacgcagcgtgctttaaaaaataaataagaaacaactctttgagaaacaacaatttctactttgaagtcataccaatgaaaaaatgtatatgcacttataattttcctaataaagttctgtactcaaatgtagccaccaacagtttgaaattagtgttactacttggaattttctggacgtgctttttttccccacaaacccaaaactgagggttgtgtaatcctggctacagtggttcatggaaaacagggcattgtaatcatgctaatcacagctgagaattctggaggcatacttgcctcttctggacagctgatccttagcagggaaaggtgctcccttttctctgagtgtctttgattttgctagaattgcttctgaaaggccagcctgtcctccactccacaagggatggttttgtgcaagggtctcaggtatttcttgacagctgtgaggagggaagcttccactctgcccttctcagtcctgggagaatgcaacagaggtctggccctgatggtaattgctgaggaccagcactctgtgtgtttcctgcactgcacagagaccttgctggaagccagacacgattctctcacctagcaatggctagccagcactgtcctggacatggggcataggagatgagcccagcagacaggttctggtcctcacagaggtcagcccttaacactctctagcacattctctgtcatccacagtcaactttgttagaaaggagagtcagcacaaaagttccgaatgtctgagtcagattgtccggtcctccaagccctcttccccattggtccagatgtgatcacatcatcccatgccaaatcttcccatgacttaatgggatggccgtcatgtgggtgctaagctgcagatggactggggaaggaagaagggttagagcaggccgggaagggcagcgtggtgtcaggggacctgtgcaggtgtgaagatcagtagactggggcttgcgtcccattcactctctgctccctctgtgatttgagatgcatcccttgatctctctgagttccagtctcccagctgcaacactgaagcttattactgccaacggtcaagaggattagactgggagagtgtgtggaagaagctagcttttgagggacaggacaaagcccgcccctccaccctgaaagttccccattttgctccctctctccacctcctgtttcctgaggtccacagagctagaataagacccacatctgcctctgctgagccccttaacaaagctcagagaccaagggagcaggaagtgacctggaagctgagcctgcccctcagctaaaggatggggagaagtcactgggtcgcatcccctgtatctccggcacaccacactgctatcctagcactgggaatcgacaatgggccaacccttcaaaatgacctggcatcagaaagaaagcctgagccctggcatgcttgcattctcccctcatttacttggccaacaacagctgtgatgcctctcctgcaccgcaggagtgtggggagcaagacacactcactctaattccatgaagcctgcagtctggcggctgccgtgtgagaagtgggtattttcatagattgtggtgcattcaggcatcagggaagcgtaaaacagaaaagacccctaacttaggcatcagtaaggatttgcttaaaaagcgctggtgaaggtgagacctgagaaaagtggattctttggggaggtggtctactgagcccatgagggctggcatggagagcccaggtggtatcctcctgtgaattggaaagggggcttattctagaagccggaggtgtagctcacacagggagtctggcatggggggcacagggcactgggtttcagcttccttattcccatcacttgtgggaggcacaaacacagctgagaaagctggacccccacggtgatggggtcccctcagcacggctgattgcatggagtggacactggatgcatattgcaggccgatctgattttctgtcacaggagtacaaggctgtgattcaacagcatcgggctttgctccctttctctgtgcctgcagctgaggactcggcactctggagtgtgggctgccgggagacagaagcagaggg

SEQ ID NO: 11839 - DNA, 94755 bp, Human
gtgttctagctcctgaatccatgctgttcgtcactacactgtactgcctgtggatgacttacttgtccctgtagtttcatctgaagaattcctcctccttttcctttgaggcctgcctcaaatatcacttcccctgtgaagactgcctggtgttctccaggagagagtgtgactcccttctctaggaatggtagcaccccaaacacacacattttgcagcatatttcaccttgcatggtaatggcctgcttgtgagttttattccgtaccagagggtgagggctctgaagatagcgccaggtcttatttacctcgataccccacaacactcattacatgtctgatgaatgaatgcatagggggatggctgggtgcatttctctcaacttttcaatttcttgaaataaataacaaaatcttaccttccctcagaagtcctggcatggttcctttcatcttgccacagccactgataatcactttcattttctgtgtaactcaccaggcaagaagtccatgcagatttacttttagtagttcacatgacaaataaatactgcgtttgatttccaaacattaaaccatagtatattatagatagatatagagttatcattcaaagtatgatatttcaatctcaaaaggcttcccctgaagaatattacaaactcttcctctctttaagatctgctgggtaggaaagatgggagaaaatgaattaatgtttacacagaaaggaggataatgggggcaaaaataatagatgaacgtatgggtggatgagagaatggataaaatgataggtggatatgttgatcttggacagatgggaaatgagtggatatatcaataaacagatatgtgggtggatgggtggagaagaggatggtggatggttgtggttttatgaagagatgtgaaaaaggaagtgtggaatgatggatgagaagttgtatgggaagatgaatagaagaataggtggttgaataaattaaaaggtgtgtggttggatgaatgaatgagtgggatgatagatggacctaagtggttagtggatggacaggaggatggatggatgtgagagccccagaaggacataaggaaagatgggtggatagatggatgggcggatggaaggatatttaggaggatgaatgagcatgtgtgtggagagaggtgcccattcacactggcttgaacacatgggttagctgagccaaatgccagccctatgacaggccatcagtagctttccctgagctgttctgccaagaagctaaaattcattcaagccatgtggacttgttattgaggggaaaaagaatgagctctccctctttccacttggaagattcaccaactccccacccctcactccccactgtgggcacggaggcactgcgccacccagggcaagacctcgccctctctccagctcctctcccaggatatccaacatcctgtgaaacccagagatcttgctccagccggattcagagaaatttagcgggaaaggagaggccaaaggctgaacccaatggtgcaaggttttacggttcggtcatcctctgtcctgacgccgcggggccagcgggagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcggtgagtgcccgccgcagcctgggcagcaagatgggtgcggggtgctcagcgcggacccggcggcagcccctccggctgagtcggccctgggggactggagtcaagtgagctgtctgcgaagtgcattgggctccggaaagcagggctgggatttgcgctaaaccgttggagaatgtgtctgtggaagcaccatttggttgaaagaaaaagagaaagagaagaaagtttgttgggcaggctgccggcgcgcagttttgggcgaggtcgctagagctgcagcacatggcagaaagtaaccgttctcccggatgcgcacagtcgttgtctggactaacaggctcctgtgcccaagggctcgccaagccccaccgggctgtgtctaggcagggcagagctgggcggggcagagactggggctggaacagggcgagtggctgttatcaaggtggtcacagaagggatcacaattccaagtgtgagactagctggcaatgggttttccagaaaggggtcctgggttctcccagctccccactgagccttgttccaaagcttacagtccgcagtgtcactgccaccttagcgctgtggaagcttgaaccagctctgcggtgaggtcttgggtctccatgagattccagcctgggatagggagcatgaatatgagaggcaaccactggaccagctgcttggtcctcaccacctcctgcttctgccaatcagtgtggggaaatctcaacagtaaggtggcttatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacacagtctcacccaggtagtttagattgagtacccagtataaagtatcttgaattactttctgctttctctatcttcctactttctgcagtaggaagaaagtgaccctaggtggaggctaggcaggatgagttctctgtgcatatgcatctccctttctgtgtgagtgagaggtctttgctaggtggggatttggggatctaggatttatactactgaagctgaaataataataataatgatagcaacaacacagcctgtcatggtggcccatgcctgtaatcctaggactttgggaggctgaggcagcaaattacccaaggtcaggagtttgagaccagccttggccaacatggtgaaaccccatctttacaaaaaatacaaaaattagcagggtgtggtggtgcacacctgtagtcccagctgcttgggacgctgaggcaggagaattgcttgaacctaggaggtgaaggttgcagtgaaccaagattatgccattgcactccagcctgggtgacaaagcgtgactctgttaaaaaaaaaaaaatgaatacagtgctagctaccatttactgtatattttcactgtgccaggcattatgttaaatattttccatgtgttatctcattctaccctcacaatggcctagtaagaagcttcctgttatcaggcctgtttgacaggaggaaaactgatgcttagagacgttaagtgacttgctggcattcacatagccaggagcagtgctggatggaaacccagctccactgagctccaaagcctaggcttagaatatgttagactgtataagatggacgaacttggaaggatttcagggagggaaggattttggtggactctaggccttagggaaagttccaaaagggactggagctcaaataagcccttgaaaagtggaaacattcaggatgggagagaagagtcaagctggagatcagggagagccctgggcctggcctgaaagaagagggccctggtggtttccctatagtctctagggaagtttatttgtatgttacctaccagtgccatcttctgctttgtctttgggcattctgactcctgactccttccaacctgtctccccgttccttctaaaaggccccacttccaaatatttggcactgtcctaacccttgaggttctcccagagacccgcagtctccctcctgccccgtgtttccacggcccctttgcgcagcatcatttagaggaagtacaatgaagtgccagtagcaataactgccccggccctcgctttcatgtgcttgtaaagttgtttggcaggaactgggacttggaaaggagacatgactttgtcagagggcttggggctgggcatggtgtgggtggcgaaggggagaaggaggaaaggggaaggaaaggagctcttgttgccccattctggggagtggtggactctggacaaccacgaggaaactttggaaaggagcaaggctttgaggaggagtccagtctttgtatgggaaagcaaaaagtggagaaatggccaaatgtagttaagtgacattggacccagaaactctgagttggggaacagatatcttgaattcggggtcttgtgcaggaggaagaaagtggcccttggtggaggccaggggggatgagtccttcatgcacatgcatctccttgtctctgtgggtgaggggatctttttttttaattattattatactttaagttttagggttcaaccattgtggaagtcagtgtggcgattcctcagggatctagaactagaaataccatttgacccagccatcccattactgggtatatacccaaaggactacaaatcatgctgctataaagacacatgcacatgtatgtttattgtggcattattcacaatagcaaagacttggaaccaacccaaatgtccaacaatgatagactgggtgaggggatctttgcttgggaattgcatgcctggtgttgagaaagaggagagcgtctgagagccctgggtcttagggctggcacacacctttctgctcccttctctctaattgagcattagagactccgccccctgctgggagttagaactttagctgtgttttcccatgtgaaggagcaaagaggcaaagcttcatctctgttggggctagcatcaactaattcaggtattccccatttacacattggacatctacttgctgcaaaggcatggtgacaagtccttgtgtgggaggctggcagccagtaggaaaatgttccatttgttttttcccaaatttccccacaaaggaggggatgctggacagcatgaaattcttagttcatgacagattcccttccattcattcaggaactatttcctgactcattgtcatagactcagagatgggaactctaaggatcatttagaaaatctgaaagagagggactagtgacttcccctctctgcgacttgttaagatattagggcagggcatttctctcatgtatctctatcatgaggactgtgggagcctcaaccccaccccctgcagtgggtggggagggtgtggtctactggggtaacaacatttgtttcacaccttaaatactaccttacagactcattacagttttatatattactctacaatatacccaatttgagtttaatacaataataatgatatatatttttgaccatatagcaatgttggtgttcgacaatgattctctgtattgtcctggggcttctagcacctcctggaacatcgctagatggtcaggagcaccaaagttttaaaaacctgatgctctgctgtggtaccatatggtcctgtgtaaagcagggtcctaagtcctgagtctctaggaaatactgctcagtgagcactgactctatactagatgtgaagccgggggtagcacaggatatcttatctaagcctcccaacagcccaatacacctagcactctctttaactccattttctagataaagagatcgagacttgtggagatggcatgacttgccccaggatccagtggtggagttgggatttccgcattatctaacatcctcccatgttagactccaatgcttatgctccttcaattcattacgtgtctggaggactttggaagctatacgtggctctcccacactacctgtcccctgtggccagcataagtgaactcttgcatgggtggcttctctctccatccccggcaggctgtggactcttggctgccctgccctggcctgtctctccccaggtttggccacagatatcagagatgccaaccaagttatttgtaactaaaataaatcacatcccttatcagagtccagctgccctcccagatatgctctgatttacaggcttggaataaagagagaggtggttgcttgtctacaggacaagttagggcaatgccctctgcctgaatattaggaaagcagcattacaggagctctcactctgaccaggcaagcatttcacatgcacagacccagagacccactcctcacatgctcattagtaggttgtgcgaccctgggtaggaggctgacatgggtcttgaactgaaacccagtgtgtggctctaggtgacatgtggccacccaagtgaggtttcggatccacctgcagtgtcagatgcttcaaggctggggtcccctgatggagaggaggtggttggagatcacctgggcctcctcagcactgcctcctggctggggctggggctggggataagagagtaactgcaattgtgcttccccggcaccttcgctttaggtcactccaccgaagagcctgaaagggaagtggttcttgcgaaagaatgagctgaagcaggtggcagatgctaccaggcaccgtgtagttttcaaaggggatctttttctgcctcagagagaaattctggggtttgcacagcaagaaaccgatgactcaatttcctttgtgtccctgctttaatgggaaggttgtaggcgttctttagaatggcagggtaggttgataccttctaccttaaatttgaatcccacttttcactcacttagcaggttgaattttttttaagtgtaccccccacagctgcccaactgggtttgcgaggcaagcccaacttgccagagtaaaccggaaggggtgctttctaaagtttgtggttctggagtctggccaggcatggatacagtcattgtgcgttccagattttctgggagagtcaggatctcaaatatgcaaacactctaccaattgatgtctagtgcatattttgactaaatgtttatatatttttccacaaataaatacatgacttaatgtaattgaaagtcaaacactttttaaaaatgctttttgcataaagaaattcacatctttacaactccttaactaggatggtgtcaattaaattaatgtttgattcaggacatgtgtactttggaggtaagtatttcatattcctcccctctccattgctcaattgccccactgggtgacgtaccaagataagccacatgtttgattcttgtttgctggatgtggacatatgcacattgcaggtatgcctataagtacatgcctgaaggatctatgtgtgtggtgggaattggtgatgccaaagaatgctaaagactttcatgccccttaaaggggaaaataaccacaacaaaacaaattccaatgtatcttctcctgtcttctgcagcactgggggagtcccctgataacagggatcatgtcacattcatttttgtgggcccagatcccagtaatattgacccataactgttgaactgcaatgaatgtctagaatataaaagtcatgatatctatatatatggaagcatgctgtcagtatgggctaaggtgcaaatacatttatgtgtaagtgagaaccatggtgatggctgtgttgctcaggacagggctgacttggctggctgactgcccaccacaggcctcatgtttggtctaccccaaacagtgagctcacccatctgtttgtttgcggctttggtggctgcctgctgtgaccgctggggacatctggctaaagacagggttactagatagttgggctgagaagggagtgggagccagtgagatgaggacaccaaccccaaatttaagcctcaaaacaaaaacactccccagcagcagccaccttggggttctagttattttggagatactgatacgaggttgagatccttgggtgagaggcccacactcctccaacccccatgtctgcttctggaaggtggtggcagaggagagaagtagaagtactatatgggagatgcgggagattcttgccttctctgtcggtctctttgggcaattatcaagctgtcatctgaccagatactaccatagcttcttcgggggcaaatccgtagggaatcctgacatccgacggggagccactttggcaatggcaaacggtgtctcctctccacagagcttgtgatgtcagaaattacccataactggggcaggttttgtcttcccaaagattgtctgcccagctagacctgagagacagggagacaaacacagaatgagggggtgggtcttgtgggggtggggaacgatggaaactcacagagccagatctccccgagtttgagttgcactggctgcctgggtgtgtcctcctgaggtaagtgtccctgcgaagtgcaagtgtgggcagacagatctcaggtgggtggggagggactgagtcaccaaggaggtgatttgcaaaactcaggtcccagaaactttcaggtcttcagcttttaaaagtaaaggttaattgcaaaactccggggttgagggaagagattattcacatagaccagtcattttgagcatctgctgttgtggcattgcaagtctccttcgcagtgcctgaaagttcatttgtttttgagagctcttacgctttttctgtttgcatctttgcacaagttctatgtttctgagaaccctcaccactattagtaataatagcaaacacttacagagtgttgaccatgtaccagcgccattctaattgtttcctatatactgccttgtttaatccaaacactgacttcatgaaggtggtgctgttattatctgtcttttacatatgaggaaactgaggcacagagaatttaagtagcttgcccaaggccatgcagctgataagtgatggcgctgggattcaaactcacatctggctacagagttcatgctctttgtcactatgttagagtgcttctcttggtatattaagatatcgaggcaccctagaaatccagacgattgtacctggaagtactgtagttgttttcaaaaacttcatttgggaatctagttgtgggtgaggtcataacatccactgagcttttaaacatgatgtcagaggaaggggttagaattgcaaaaatgaaggaggaggaagttgtaatggaaacttctgccaatgcatattctgagttgactcattcattctgatctctgaatagaagctctactctcttctatgtgatggaaagttgaggatagggtagggctgagagggatgtgaattgagttgtttgttcattaggataggatagggctgaaagggatgtgaattgagttgtttgttcattatcacttcattatttgtcacctggatgaaaggtaaaggtggctgattagtgtttctccatcagctagaactttgactgggaaatgagccaatcaaatagcagcaaaatatttgccctcaccttacaggcccttggttccagggtcttctctccaccggctagaatggatgagggagggagagaaactctgagaaaagaggctgtcaggagtagggctgtacatatccagggcacaaggaatttggcaaaagctggaagtatactatagcccttctctccagccctagcctaaaccagatgaccaggcttctatttggcccagcatgtgaccatcccatcagggagcaagagagtttcctctgggtacccctcactgagaaaaaagccacccaggaagggaggaggcaaggccccctgggaacatctggctcagtccacaggaagggatgcaggccttttcctgggaatgaggactcatcccatattccagcccccttcccccaacttttttttttttcaattttagtgcatctctttacacttaacaggtctgcagtgacttctaggaggatccacacaccaatcgtggaactaggcagcatctttttccacttcctttccaagatagtagcacgataacagtaaagcccctttgcaagtgttcactattatgcacattaagatgccagggagagggctgggaaaggtggctcacacctgtaatcccagcactttgggaggccgaggcaggcggatgacctgaggtcgggagttcgagaccagcctgaccaacatggagaaaccccgtctctactaaaaatacaaaaaaattagccgggcatggtggtgcatgcctgtaatctcagctacttgggaggctgaggcaggagaatcacttgaacccgggaggcagaggttgcagtgagccaagatcacgccattgcactccagcctgggcaacaagagcgaaactcggtctcaaaaaaaaaaaaggtgccagggagaaatgaacaattccatgcagccaacacctggtctcctgcgtttggcttagaagggcatttctgcccaagcccccagctctagtctttgcacactttaaatgagtagctactacatgccaatcacagatgttgcctctgctgagtatccagtcaaaaaaccagaatctaacagagctaactaagcaccatcttgcaggaaaccagctgacgtcagctccgcagccaccagtgagttactgggcccacatctgcctgcaagagggggaggggaattcaggtaacccacaagaggggataaaagttcggggaagaaatctcctgtcaaggagtttgtttttgcagtggatcctctgcagtgagactagttgtctttacaatatcattagaggtcaggtacattcctgtagactcccttaagtgacttgctttctcctattgttccccctgaaaattcataaaaacctcacaaacacatctccatttaaaaagagaaagtttaaaggatgccatgtaatggttatctcttttcttttgccagtgagcataaaagctccttagggaaaagcccaaaccctctatacattttcatattcatgatagccctgagcggtcagcacagttccccaattatagtgggtgctcaataaacacttggatggcttactgaattaataatgtttctagacttggctagcaaagccatctccgttacttatcttttgtgatttttataggttctgtctaattctttttcttcattttttttctttctggtctatacaaatcttctttcatttttctctattgctacttgtagcgatcctcaacccgcctcctcccttgaaatttctgttctctgcactctcttcagtctaaagagatctttcttgaggtttgaaatgttacacaaggcaggggaagtttagagctaattgtattttgtccagtagaacggggatctggatttcctataggtctggctgcctctttgtctacacctttacttccaaatctggcctcatgtataaaaagaccccaaaccttaaaatcatgttctcaacaatactcagagaaaaattgttggctttttggtcaccatgctagaggaataaaagggcagttgtttctttcggtcaatggtttgaaaacctcccagactaaaaatcacctccatataatcagatgcttggtgtggtgtaatgaagatgaggaggtctggctttgataagagtcatttagaaggtataaaggcagtggaacaagacgggaggacccatacaccagttgattcccctcttgccacttaacagcagcgtgagcttgggcagttgcacttgttaaatgtctggaacaatacttagcacgtaatttctaaagcttaatgtttagttcacagaaggtatcccaagaatagaaatgattattatattttagcttctctctattactgattcactatgtgctgctaggcaaagtatttcacccccatttacttctatttttccatgtgtaaaatgcgagggttggattctagttgatctgtcaagtcctttccaggcctcatgttctataaattcaccactctgtgggcttactaacacctgagcctcataaaacctaatggaaagaataacacaaaaccaccataaggcagtgtcaaaaaaaattgatgcctgatttgtattaaatgtcaaaagtgaattattaatccatgccagaaataaacatatggacccaattacactctaactccaatgggcaagagtgttgtagggacaaagtgctttgcccgtagtacttcatagaatcctctagaccatgtggaaggtgagcagatgaagcagctctggccagagaagttaggaacatgtcccagtcacacaactgaaactgcaggaagtcagtcctgggattaactgcaggatctgaacactgtactctttatattgtactttaaaaacattgcttcacatggccagaaaagccaacctctgaagaagagaaaaattgttcccttcactctcagagcttcatgagcaccttggacttgccagctttcctcaagcaacccctgtaacttgttggcacaaaattaaccacaatattcagacaaagcagtacttacagggtgagtgctagtatcctatgcaactagggtagcctgagaatctaggggaaaaaaagctagaccaaacaaaagattatatataatctttccccaaatcaaggcactgagcaaggcaggcctgagagatggtgaatttctgcttctactgagagtcctccagacccccagtaaaaatttcttttcatcataaaaccagagaaactcttgctcaggaaaaagaaagaaaaatggaaatcataaagattgcacgacttaggattttgtcaaaatgtgtcagaggctataatataaggctagtttttggcattctgtcagtcactgaatgtccttcgtcagatcacagctccttttggttgtgctgactttatacccatctggaatccactgaccattagctgaaataaaatcccagatgtgctcagatctcacatcctgtgcaatgccctcagttattgctgatacggttcagtcatctgtctctccagctaatcatacagacacagtattctaggagaagtgagaacccactcatagccaggagagcttctccctctcagtcacagggtgactgtgggcaaggtccttcccctgttggttgcctctgtctccccagttataagatggtgacaaactgaccaacttaaaatttccttaaaatgtattggcactgtggacagaaatgaggaaagtggaagacctagtttctgtcctcagggagcttaccatttggtggaaataaagttaaacaggtgaaagaattatgcaagagagcataaccaagtgtcagaagacaggaaaaacagacatctcgattgcatgtgaaggcttcaaggaatttgaggatgagttgaatgtggaaaagaagatagacagagagaggggagaggagagaaacccagggaaaggcaaaacatgagccaggtgtttaaagtgggggaataagaatggcttgattggggccaggggaggggtctgtctgcttggataagagaattcatgaaaagaacagtgagagatgaggtcggacagattccaggcaatcaagtaacagtggcactgtccactggcagaagatccaatttttctgccccagaaactcagaagttctcatgaatcaccctctcagacagtgctagacagagttcagaagcaggccagctccaacagtgagaaagaactttggcaactttgcctgggttagagagtggcaatttaagtgaatcccaaacaagacctactgtggcaatagcaaatagattttagctcaaggaacatttcccattgactcctagaggcttcccaaaatgctgtactaagaagtcaaaccttggctcaggtatggagagtgctgtgatccattagtgatgtctgctatgggcacaatatgaaggatttgacccccatgcatcacatggacatcaccgtagtggagcagcaggctttctttgttaatgtttctgagagttgtgtgtatagtcctctgggagtttagccattctagaatctgtccagctagccatactatagactctatctccttctagaacagtaaaaaagcagtctcttgcccagagggcagaggttagtcacttgagccttttgttaggattcactcccattctgtcttcccatttacccacatgaagttagatgctgggagccagatatttcctgtgtttgaacaagggccagacttcctggcaaagggtcccttcttcccatcagtttcttcaactgcaaactgagaagacaaaagtgatgcctcacccgtggtggcgacaggaggaataactagctaatgcgaggaaagcttttgaagatgaaagggtggtatgtgcatgttaattacaacttttatcagccctggagcctctgcattctcagctgccactggaagctcttctgtgcctcccaaatgcaaacagcagccacattccatgagctggcctcactaagtcctgcttagagcatccaagtcaagaaggttggattttgagctcaggctggccagctggctcactctgggccactcaagtttcccactactcatccccaagggaaaaagtaggctagctacctgggcaggtaagataagatagaaccaaggtataaacaaaaggctccatcaaaagtctaccagaaatagcccctgggtaagattaggacactctgctctaattcccaccctgtgaaagcctaattgtttgaccttgggctattggctttatctgtctaatggttcaatatactgtgtgaaccatttggggataataatccctctgcctcccctagacctctccacctttgcctgctggtgtgaaagtgttttgtgctagtaggcagaaacacgtgatataaaactacaaggtcctattattacctaggataactttcgcctctatctatgtctcctgttgctggttgaccccaatcattgaaactgtattctttggaatgctcagcagtctcctccaagctgccattccctccttatctaggtgggcccagtattggctcaggcttcttggttgtgccacttcctaaggcttgcaaatgcattcagcctgcccttgctctcagtgccagctctcagtgcccttgctgggataactcaataaagggctagaggtgggaatgggataatcatcagatgctttgctagtgctgacgggacagcttagaaggtataaactgagctgggcccatgcagcaacaccaaaatatgtgttcaaagagggagaagaggagaaaaagagaaaggaagttatcgtggtctgataacagggcatgtcagaatgggaaagggtgttaggaattatgtagccaacttgtttgattggaaagataaggaagcctcaagggctgcaagtgactttcccaaggtcacaaaactaattggtggcaaaaccgtggtcttctgacttgtccggtttcctttcattttatcctttgagacgataaaggagaggacactaactaaacaagaagacaatgatctgatcaggacaagaagacttggagtacaaaatgagaagaagataatagggtaatggattttttagtggcacagtgggaaatggcgtaggtgtttacactgcactggagccctcactgtgcttggaactggttccctgtgcacagtcttgcacacccatatttggtatttttttatcctttttgacttaatgagcatttggaaaccataaggcccacagcaacctgacctttgacttgcccagactctctgagcaattttgtgagttgagtcaacaatcaatggttttcaaattattcaattgttcactcaacgcatactagttgaacaccaatatctgtgctctgctaggcactggggataccactgtagacaagagaggcatagtctcctctctcctggaacttacagtctatctggaagacagacagtaaacaactaatgatgcctttgtttaattacacttgtggtaagtgctatgaaggagaagcactggatcttgtgagagcataatagggagatctcatctgatttaaagcaccagggaaagcctcccaggacctgttggatgaatagcagtaaccatgtctccaggatccccacaattccttgaggacccttgttgtcagacttctcagagctgtaccagccctctcactgtctcaccattgggtcttctgagtaagaaagcaagaaaaaaaattttactcctcaaaattctgaaagcaagtggtttatcatgtctgccctgtaatagtggtgggaagaaaatcatgagaacctctaagctgactcaggattttagaagcacacatttggggagaagggaaacaaaaattctggagaagcaaaaagtgtcatatggtatagaagttattttaagctactggggaaaattcataatttacttagggatcttgagtgtcaagcattggtttagagacaaatcttatccatttcgttgaaagttccttgatcttgtggctgaagcttgggcctagggttttattagtgtacatttaggggatggtttacagggtgtctttcaaggtcatacaggtgcctcttttggggtcaggcaggaggaataggacaaactctgggatacgaatgtacaaccatttggctcctagggcctcagtcctttagctccttgcttctggtgacttcttggagacaagagtagactttttcagaacagcgagatagttgtgctgacaaaacaaaaacaaaaacatcatttaagatgccttcagatgcaagtacatgtcataatagaaatatttaaaaattagtagagtataggcactagctaattcaaatgcttggttgtaaacaactatgtcttgtaaatgagaataaagtttattctctcaatgacgatgataacatctttctcactcacttttactcaaattggctttattgggcaggagagacagagatggagttataggtatcatgattgaacttaagctacaacccatctatgcatcaaaccatcatgtgtctcgtgtgattgttatctgttgtgtatattttggtatatccctatctgtacataccagctgaatatttctgtaagtaacagaacaatcagctctcataaaatattacctcccagggcaagaagtctgggatgattccaggaagtcaatgatattatcaagactcaggtttatttttccaactttcaattctgccactcccagtgtcttcctgcaatttagcacccctcatgttcctaaactaaatcccacagttccaggcatcctaggaaaaaaaaaatcaatatttagcagcagaagaaagagtgtatattcacaaacatctcttctaaaattggaggagcggctttttgggaagtccttaattgacctctccttatttctcattggatgaatggggtcacatgcccacacctaaccaatcactggcaagaagagcttggaccacagtgcttgacttagaccaatcatgatccacccactggagctgggatttgaggtctcacctgtcctgaagcacaaattcagggtttctgaataaaattgcacttcaggtagaatagaataactttttttgcattggtaacaatgtgggctacaatgagtaagggagtccatttacctgctagagttgtggtttgagactatttgggctaaggaaagaaggcaaagctaagtttttgtgcctctgtgccacaccctcaacctttttctgaaaagacatgcctcatgggtagagctcacatgggggacacactgcagtttgaggtttagatggtctgtggcttatactcaatgataatacctaaaactttatcctttcctgtcttctacaaaagagaattatatcagggaataatcttaaatctgttataatttacaagaaatagccagtcttctgcacacttgagtactttattattagaaactcattacttgcaacccatctcagcactgttggagctacaccatgcatgaggaccgctgctctagagtcatccattaaaaaagaattcctacgaacctgaatgagcatttctttctctaaattatgagatgatgaccctcaagggaaatggccgtcttcccttttctactgcactcttagagtgcattaatgtgtgtgaagtgttttcggttccattatctaaagcagccctcatattaacatcgtggttggcattactggcctcctgtatgggatgaaagtttaatgacttctgcaaggttatgaaaggtcaagatcacagctaattagtgcaaattcaggatttgaattctagtttctaccccagagctgatgtccatgtcaccatggacatcatttgctcccaatatacctgatttactttcaaggggtctggaattgactattggattttatattaaaaattgctctttcataggcaggaaaaagtccttcctaatagtttgagtccaaagcttaagggtctagcatctcaactttttaatgaacccaaaaatgaacaggagggttttctgagccagtcccctgcctccacacagttagctcatgaatccaacatcatgggaggaagtcttcaggattttgtttcccattccttttttatcacctaaatatagttaaaggatttgtgatgactgcatccagagatgtttaaaaatggacctgaaggatgtgattgtgtcttaggcaggaagggtgccggttcttttcagtatctaatgatgaacgatctaaaggaaatggattctaaaccatttgattctaaaccaaaatggtgtatgtttcttttgagggtgaatttcctgatcatgagccttgttgagcattagactggccggctggttcctaatccatccttcagttctcagctgcagtgacatttccttagagagacagatctcctttggggacagcacaggacttgagaaaaaaggcttccctttccactgagcttggctccaactacacctcatgtgtctgttacatttatcatgctgtgttgtcaacttgtttaatgtctgtcagtggctcatgcctgtaattcagcactttgggagcctgaggcaaaagacttactttgacagcagaggtttgcagaggttgctgggcaacatagtgagaccctgtctctacaaaaatatatttttaattggctgtgcatggtggcatgcacctgtagtcccagctgctcaggaggctgaggtgggaggagtgcttgggcccaggagtttgaggttacactgagctaagattgtgctactgcactccagcctgggtgatggagccagaccctgtctctattaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattggggtgattttgatgggattgtgacttaccatggtggatgcatcctgtgagttccaaactcaacttcttaaaaaaccttgtctatcatctatccatctatctgtctgtctgtctatctatctatctatctatctatctatctatctatctatctatctatcatctgtctgtattctatgttccatctatcatctatctgtcatatatctatctctatctattaattatctctatctttatctatttatatctatcatctatctgccatatatctatctctatctcttaattgtctctatctttatctatttatatctatcatctatctatatctatcatcttttaacctatctgtttctattggaataagagacaagtgcttgaaaagcagaggagagtcaatacacaggccacatcttctctcactccctccttcctcctcatagctgtgagccaccccagtccctgtacctgcttccttggctggcatcatctaagaaatcatctcttccacagtttcctgcaagggcatcaccccaagggaagctgaacacatgcaacatctgcccactcaggataagtgtgagggataaggaggaaacatttttcctctagagacaggactgttggggcaagggctggggaagcaagacatggatactccaggctacttcttgctggggctgaggggagtgctcggtgtggctcccctctgggacgtgtttagggcagctctctcgcctctgaaacaagcctcatcagatcatccccaggcttccttccgcatagtttctgatgatataggaaaggagcccgattatctgtttgagcttcctgttctttgtattgtttggaaggctaaagtcaacagccacttttgtattctgcattgtttgcgttgttaaaaactctggaaaactcatctggtttcttctccaaaagtagcttcccagagccctgggagacactcagaaataagatccttttcaaataggccagcagggaccagggtctctcagaaccagctttcctatcttcttccaaaggccggaattgagaaggtttactccagcccacataattgagtctctgggctgtcaaggacgcattggggagtttgcttctggtgtgctgggtgcttagaaagccgtatgaattgcagagatagagttgggttccagttctgccagtcaccaattatgtggccttaagcagtttacttaacttttctgagcctcaattttctcttctctaaaatagagttgtaatatacctatggcttagagttgtgtaaggactgacgcgatcacagacttgaaacccttgatagaacgactggcatggagtaagcattcaacagtcataattaaggtcattgtgatgattacacttggggcctctccattcaccatttgccccaactgtgttcctgctgcacttgaaaatgattccagctgcctctggaagattttcatcccatttctgggaaaaacattagccaataaactctcattgaatttggcagggcgggcacaccagcaagctgacactatgtgcatacaggcttcctggaacaactgttgctgagcaaatgaagcagcatggaatgttccgggaagcaggattattgctgtagctggtgaaagtgaactgggaaacgcactccaggtcctgtctttacttgcacaattacagtcaatccccaaggctgcttgtctcagcaggatcagcctcttcctgccttctgtcctggcagtgggtggtggggctggaggaagaaatggtgttttcctccctctcccattgcaattgtttccttacagtgctgttctctgaggccagagaacagaagggctctttccagaggcagtttaacagagtagcttccttttcattctgagaagtttggagtttcccagagtccacttcctccctagaagcgcaagcttggaatttcttggttgccaatgaggtgccagcttctgagtgcataaagtgtgtccatcgtttttaatcaattctctcatctccaaaaatacctttaattgcctttagctgcttagttctgctgtcctctaaagaaaacaagatctggccactcccagccacacctcagaagtgagtaaggcttttgcaccttttaataggagtatttacatgtgtgtcggtttctcatctgcttttaatttcattagagtgtgattttggactgttgtttgagatgaaagagcagattatcaaagtgcagatgattttttcatggtgcaaacacatcataaattagaaactatgagacccctttgcagcggggaagactggggccagtcatccaaggtttcatcttcctgtaggagaagggaaaaaaaacggacatttattaactatctgttatgatccagactctctactggtgctttttgtatatttattctctaactcccatcaacttctctttgagagaggcagcaaatgacaactgaataaatgaatggctgaatttcatcagagccagtttacaggcagagaaactgaggctcataaagcggacgtaacctgcctgagatgtctcagcttttatatggtggggctggaattcaattcagagctccttctcccttttaacactacactgcaagttcccattcagcttcatgggattaatcctgttcttctgtccctagaatggagccttgaaagttcaaggtgtctccttttcctaagaaactggatttttctggctccttgagaattgaggagctcaaaacaattgagaactcttgggaggcatcttcaggaaaggaggtggtggaaactttcctctcctcactctccccaggggcaatggggcctccaaggccatcaaagatcaaggtgccaggtgggggatgcctcccagcttcccattcatttttcagttgggggccactcagcagctcctcaggtgaggattgtctcagaactgaagaatggttcaaattggcccaagatgctgaaatttattgcagggatcactgggacagtgtgtagcaatttaggaggcttctctctaagggaatcagtagctgctgcatttctcttaattgaaaccactctttccctccagcttcgatggggcaggttctcatatctgcgtgctgaaaggcgtttatttggtgtattctgagagcaggatgctggtaacactttcttttgtgttttgccaattgtttctttttactggctagtccaccctgtctgacgcattcattataccataaccaccttgacaccagagtgaaatgccatttctctgcaggtaggagagagtcacacggattccttgagtgtttgtagcgtaagtgagaaagatatgtagccttcttctagaggcagagggatgggttggctgggacttagagatattcaaatccaactctgttcttgtctgataaagtaaacgaggcctctgaaggtaaagtgacttctgtaagtactcacagcttatcagtaagaagcctgatattaaaactccaggtcactagaccttcaacctaatgttcttcccactaaaccaagttaacatttattgtacaccatactaaatggcagacactggggacacaaagatgaataaggcatggtcccagtggaacccactttggttatatgggttaggacacttgaggcaggatcctccttagaatggtgttttataaagtctctctttctctttctctctctctcatctctctccaatctatcctctctatcaagagagaacacatgtaatgtagagtgagagcccatgtattggataattaggcttctggctcctaattatcaggaagcctggaggtcttgagtggttgtaaccaaggatactgaaagtggttgaccagttaataaagaattaagttagagtaagaggcactttacttttaagctgcctttaatacactttaatctttgagatgattggctaatatctgttaagtaccaggctctttgcagagagtcaggtcctttgctaaatgatttaggtatatttcttcatctaatactcaaaaagcaccccataaggaaggcattacttttattttactgatgaagagactgaggcttaaaggttaagaaaacatagcatgcataacatcccacaagagctcaagccaggacttggacccaagtctttcttggatctttccgatccaagccatatggttactgcaatctcacaatacaatgagggtaaatccttgcaatcaccagttaccagcaattgtgaagcaatggatggcatagatgtcagggggtcaggagagccttgcaagcgttcagagggcttgggagtggacacatcacagttgcactctgctgggcagcgctgtaagtctctgattggattttgccttgaattttttctggtcaagactcagaaaggatggatgtagcttcacttacaccaattctacccagcttgtgacccaaatggaactcttatcccttaagccaggtcattcagttgttgtagcctttgccttccaagtttcccttgtctaccctactgagtctgaattctaaggacatcttcttatggactgtgggaggcaaagatgaattccaaatcttatttaatctgtgtgctgggggggaagaggagtgtatttccttttgccaggtatctgagcctacaaaaagccccataaataagtaaaatgtgtccatgagttcataaaagagtgagccttagacatacagaccacctgtcaaaagagccctgtcattctctattatattatcctcttttattttctgtgtaacactatgagtatctgaaattaccgtattcatgtattaatcatttacctgtatactatatcctcactctagaggtaagctctttgagggcacagatcgtgtctgactccccagcccccaagattgtatctggcttgtatcaaccatatcatagggaaggtgctgtgaattgacaccttgcaccatgctttatggaaactaatggtgctttaagaggcacagatttcatagaaagagacccagttgttcccaccctgatggttctaggtctaggtctaggtcaccaatgtctatggtgaaagaatgggcttttgcgaggtatggtctcctgtcatgtatgagggtcatttatttaagggaaaaccaagaccttattttctttgacaactgcacacaagggtcatttgtaatgtccttcatttccaagcctctggatctttgcatggatcatgctccttaaaagaaggaagttatgtttggcctgcttcagctaagcatggaatggtaaagattttggtccaaaccctgtgacttgagttggatttaaaagcttgtcagaaatgagttctctggagcttggcatttgagactggcatccgttgttccagatgagatttcacggattgaaagctcaggaagaggtgtgaattacaagcaattagttcacagggcagttggaactgtagtaatcctggaaaccttttggcccacattttaaaaatatccccacaatccagcttctccctctgtagggcttctgcttgggaaagtttgtgtaactccccaaaacatctgaagagtgaatagcagtagtgttcttggactgcgaaggagaccctgcttcttatgtgcatgctcttgtgcacacagacagaaacacacacatacatgcacacacacacagacatgtacacccatgttcgctttagcatctgatagaaaaagaggaacatgaggaaagacagagattgagtcaccaacatgtgacctggtgatttctgagtcctctgactttgaaatcagtggaaatttagagctctactttgtcacttgtaatgctttgttgttgcaaataaatatttttgcagctgcatcacttcattgctaatatatttgaagaaggcaagataacctaaaggcatgaatcttgttctgttttaatccacctgtaagtcagtggtggttgtaaggtaaattgtaagtaagagctattggccaccaagtgccaagggttatgaatgatttacctttttttttttttctaaactgaaggaaactcatggttgttcctagaaaaacatgcacactcacttgcttgcattcggataagcttctttgagtaacagggaagaggccactaggattacaaggcagttagtgcccattggagtgtgactggcattgtgcaccctgtgaatcatagtggtggtatggggaaaggggtaaaaaagcatcaatctatggagtatgcgaaccagatggcatctgtcctgggaagaacaaatatccttcataggagaattagaggactatactagtcaggcagaaatccagtccattcatcaagcttttcctcttgctgtggtccctacagggtcagccctgtttaggctcaagcctcttaaatcccagtgcaagaccaatttctctatgaaattctccctgtcttctttggtctcatggctacttcctgggaggaaaaagtagtaatcagctccctccccccagctaaatgtgcatggtattagcaaattctaacccaagatgttaaaactatctgagaagaggcatgattctgcttcttgtctgtaccctcctaaagtcaaggtgcagcaaggagagagacatttgcatgtggcccctgagaaagaagagatttgtctgcctcaccccctgctggtgcaaacttgcacctctctcagcctcagttttcttatgtgtatcaagtttcaatgatcgcaatagtacttatctcatgtgactactgtgggattgaaacgagatagttcatgtgaagtaccgagcacagagcctggcacacagtaggtactctattagtgttaatatcactggaaaacccagctgggggctcagcagtagaagctgccagagccttagtgttacagccacatccattaccccaccattcacatacatttcatgccccagggtgagaatccacatatcccaagcagagaggcacagctttggtaaactgagtcttagctaactcatgtcagaaaccaagtgttatcctggggtttgactcctggctcttgccacattcatagcaggatgctgagtggattgtactcagcctcacttgttgcatctgtgaaatgggggtgattttttgacttctcaaggtatagcatctattaaggcacatagactacaatctgacacaaattagcagctccatacattgcagaatcttttctttttcacttaaggagatgctaaaagaggcaagaggaaagaaaatcaaatttggagatgccgtgggctgtgtgttgaagttgggctctggtggaattggtggtgaccttttgcttctctccatctggatggctgtatcttcaaagacaacaagtcttaactgcagtttttgattgtataaatctggccaagtccactatttacccagcccagtctccttagagtaggattggaaactcaaactttgctatctcctctgcagagtgagcaagggacaatctttatgaaaaactttaagttgcaagatatttgtgttcttaataatgaagggaagaatacaaaaatgataatactaagcctggctcatggatagcatttttgcacaatatatttcatttgggctgcagcctttgagctgtactaattgctctgagcatctgtttgtatgtccgttgcatgggatgatttaccctcctaggtttccaaatgctttggagcccctggtttattgcaggacttactaagtggtggccatcgtcactttgattggcccctaccacagtattttccagacttttccaccaaggctcttagggctttgtggtgggtgccagaacaattgatggggtagggtgggtgctggaagagaatgagcatctggtagattgagtctctgggtctgcccttccaccctcactccagcccccattagctcagcttgattttcaaccacttgaaatactgtggttgtgcctaagacatcatgtcagggagagaaagaaacatctgaaaaccatcaatcttctctctgaatgcttccactggtcccatttgcctgttgacaacccaagttgaaaaggcagcaccagaggggaatggggaaaattagcagaactggaaaatctgagttgagatctgggtttaccaaactctccgtaagactttgagtctgtgaaacttatgtccattagtttcttcaccttttaaatgggtctgtagtacctaccctctgggcctcacaggctgcttttgggtgtgaaagtgctttataattggtgaaggaaactgctacgtggcaagaatagcaaagcctgatgtactttaatccattcggttctgctgagggtggagccccaatgtgtcttaattcatatgaggtttctgagaagctttttgagattttaatactgtcccaggtatgcacatcaaccttctcacttttatcccccaagctccaaaatttcataactttttatttcatcttgggtggcaggaaggcaaggtgtgcctgggggagctacagggagttattcaaggtcacataattagcttataattaacagagtttaggctagaaccagtgcatcccactcccagatgggggcccccggcttatctcagcatgtcagcaacccatgaatcagccctgaaatatagatattacctatgagtaacagtttctcatcctacctcaactgttacgaaagtcttccctcaaactaaagctaagcagttccacaaaatgccagctatagacattagcagaaactgtatattgattaggtgatgtatcagtcattgtaactacccagaaaaaaaaatacaatgacaaaaccaagtggcccaaccttattttctacttgcaagaggaaaaaccctatttgggccccaagatgcttttttcatttcatttaccacatcctgggtttgtgctagtcaatctgctaaatcaataagatccgaaaaagcagaaaacaaagatcgtgaggccagaggatttcctgatcaccatggcaacacacaggggtgggtactgtggtttctctgcctgaagacgcactcgtcaaagactacttggtgttacagaattctggtgcagtgaagcaacagttctgggacatatactttcttttgccagaaagactctgttggatccaggaccaggagtggggggttaaacagttctccataccctcacctccaagtccccatcatcccattaggagacagggacagtactgttctccaaactctcaaaacaacccaagagctttctaggctgtgcattgggttgatcatttggtggccttggctgaagggccagggtaacagctaggagaacccttgggattcttctccaatgtgacaggcccctccatgttggttcagcgttgactgccatgacaggctccaggctccacggaaaaaaggcagagaaatcagggggtccagccaggcgccaagacgttggggtgccttgcatttctaagtgccaagtgatgaatagctcagttgaaagcaacccagggcacattctggaggaaattctctgggtatgattgtgcatgactgttttctctgctcattaaaccctcatctgcctccagggcaattccgggagagactgagtcactcaagactcatggtctgcactgggcagccaaaggcgattcggccaccaagtgtgattctggcctcattcagaagtggatgctaaacaatacaccctttcaccaggagcccatcacatgggcatcaggagatgggggcgagtgatgtgccagccttctagactggcaggcctggggggcagcagagggcacaatagctagaaagactcccagatgaaaacttctgggctttgaagccttcgaacaaatgaagaagaaaatgacttcttcgtgtcctattaagacagtgagttgtggcttttttgagagcagcttgctcagacctcttatgaaagatagatcagtagcaagagcactggtgtaggagtcagaaatctgcaattatgaaccactgagttttgtgtgtgtgtgtgtgtgtttttgtttttgttttttgtttgttttgttttgttttttaacttgctggaggaccatactcggctatccttgattttattttctcctgtgtcacaagagaaattggttagaagcttcccattgtgcctcctggctttaaaaatagataatccaattaacaataatgctttaaaacaacaaaaccttgtccttttcccttcctacttctgatcagaaccagctcagtaagatttattagttgtgcaatctgttttggacatgagctcagcaaatcagaggacagaaatagaatcctggctttttaatgataaacactgtaaaaataaaaaatttggagagcttaccagtgcttctggctgcccaagtggtttgtgtgtggttgactcccaggagctcaatcactttgggtgcagtccacccagagagctatgttccagctacatcaacctggagccttagcttggtcagtctagatttttgggtttggctgcagacatctcgtaatgtcacaaggacagcctgtgtccttggtgacccaaccctgggccaaccccaagtcctggagtcctctcctaagagccctgcctaattgtagagagagcattcaggctgtaaagggcaggaggcctgggggctacgactaggtttgggctttctaaattcccaagagtatgatgggaagaccaacaggcagaatcagagagaagcagtcagcccactgctggggaaagccagtcaaggtcaagacttcagaatctcctctctggagagagagtgaaaattccattagtgaagtttgttccactgaagccttaccaggccttggtaaaggcccctatcttgtggtccagaatcaagggacttctgatcttaaaataatattcaataagctcaaattcttctctctagggctctcttttcatgatcacctctccacactttattaaaaaatcacatgaagggtaagtgggcttcctgtcatttcagtgtctgacctgtgcataagttggaatttaacactggaaaatgatcagccagattgcccagtctgaaacccaggtcccccagtgactagcacaagttacttacatcttctcaatgaatcagttacctcttgtgtaaaatggggataataaaaatgcctgccacacaggattgttaggaaaattaagtgaaatattaggtgtaaagtgctgaataccttgaacccagactaggcactcagtgagtgctcactgtggttatggaccaggagctgcaggaattagaacaccattgagtagcaggaactggctttattctcatcttcatgataaagcaacttctccttacatatagcttaatctggaaccaaaaatctaattctgcctcatccctcctgaggagatgacaaatagggatcaggcacacctgggtggctcaagttagaaaacaaattaactcattttgcagaatctggagacgtctggtctggagaactgacagtgccctctctttgggcatagtatgactgtaggttgtctttgggtggtcttcatatggaatgtactgtgtttgccatgttccctaggagatctggcctcagaaatggccctgtgatggtatgtgaacatactgtcctgtaactgagatgatagcttgcacattcagacagacaaagccagttacaaaactaaaagttggtctctgaaacatttgctttcggggaaaacagcaaatgttcacagaagcaaagttctgggttaaagacattttaagtatccaataaggaattctcagcaaacaccagctggtgattcctcagatatgatgtgggaaaggaacctgataggtgatctttttgcaccctataagactgcagcctgtcgggggttgggggcagaaagagagcatttattaattcattatttcattcaacatttgcctaccatgggaggctgtactaggtactgggaatataattgtgaagaagggagacaccatttctgttgtcaacgaagcccacagagaagttccaaaatttcagaatgctggaatttctggttactagagaccttgaagataataatttcttgtaattctttacctggttgtgtcacagactttgaaaaccaatgaaaaccagagatgttgccctacctaaacacacacacacacacacacacacacacatccatacacacaatcttgcatataatctcacaggtccatggatgtattgaccagctcctggattccatattgaaaatcccttgcagcccagctccaatactagtaccaggccactcacctctcaggaaagtttgggaagacgtagataatggcaacttgggtgaaaattacacagtgctctcttcccagcacatgttgtgattttctacaacttcagaaataactggggtggaccaagaagctattattcctcgcaggccctacaatctaggcaaagctttgaaatgtgctcggacaattttatcagagatctattttccttgatctgaggcttagggggcagtatagatgagattaatggcatttgggatcagtgatggtttatccaggagagaatgcatagtacctgtaaccaggagcctgaataggaggcaacatagcatagaggttagaatcctgactttcccacttggatgacattgggcaaaggacttcaccactttgtgcctcagtttcctcatctctaaaatgggtttagcaatagtgcctacctcatagcatttttatgagaattaaattagctgaagtacataaggcacctaataagtgtgcaatgctcattggctctgattattaagtgtcaaacaccatatcaagtgtttgacataccttatttcatgtaatagtcccataaaccctgacaggttcgcattgtcatcccatcaaggaagaggtggagagtcagagaggttaagtaattaacaacctgtgtcacctaaagtgagtggcagggtcaggaattgaaccaggtttgaggaggtcctaactaggttgaactactgaccttcataaaagtttggcactacagaccagctttataggacaaaaaaaccttctttcagagctcctttttctcgccttcctgacagctccctagcagacctcttcccatgtgggtagggagataaggttcctagacactgggacactggtctccatgacccctctgtgctgcccacagccctatagtaatgagcgtgctaaaggcctggtggcatttctaccacgggaagtctcctctccaaatccaaaagtggcctcaaacagtcagtgttttcagttgagctcatttatcgctcagagggaggcacttgggacattttattcattacatgatgcaggagatttattggagaccagagggctcaacggaaaacattcttggtttatttccagccagaaaggcttgtttgagagatgcaatcagccatttagtattagcttcttgaatcaaagtggatcctgaatcacagagttctctgtttctcaggagagacacacagacatctgaggagtcttgcctctctatagtggtttgcagcatggctagcaccattgccagagacactggcactctgtcaagcaatgttctgtggtccatggctattcacatcttaaccttgccttaattctacttcattgtgagtttgggcatgtttctttatttcttcccctctctgtgtgttagtttctccatctggaaaatgaggatactaatattacccacctcataggaatgttttaaggataaaatgagtaaataattctaaagtgcctaaaatagagcctggcatatacacaatgaatgcacaataaatattagccactgctcttgctgttggcattattaatatcctcccgggtaataatttgggtttgcgttagtatcaaggaaacctgatgaaatgtcttcataaattatcagggtttgaatgacacacagccttgaaaatgttggctccttttaagtcaagagggacctagagtagaaggattgtgaacattcacaggatagttgaccagaaatgaagtatttgacaccattcttgcaactcctaagtagctaaatagcgtcagggttaggagttggactttctcatgagatcaagataaatgtaagctgtggaatttttactttgcataggatttcttcatccaatcagcagccctttgcagatacctacaatgtgtcagaacctgcttaagccttcacatctaggaaggctaaaggttgagtttgtctgtttcatcctgtcttggctgatcacatgcacatacaaccacacactcacttgcatacaaacatataagtatgaggagaattcaaaatgttcatggaaaaatgagattaaaagataaaagtttaaagatgtaaactttacttctcaacataagcaccatcacattcaagatactgttataagctatgatagcggccatttagtccatccctaaagaactgagggtcctgggaatttaatcacatcaatgcaatctttcttacattgttaactaaagaaaaatgggtgccctttgaagatttttaaagattaagtaacaaaaaaaaaaaagtcagaaggagtcaaatttggactataaggtggatgcctaatggcttctccatagaaattctcaaaaaaattgcctttgtttgatgagaataatgagcaggagcattgtcatgtcatgatggaggaagactctctggtgaagcttttcgatacattttttcttcaaaagcttgggctacctttctgaaaacactctcataattagcagatgttatcgttctttgaccttccagaaagttaacaaacaaaatgccttgagcatctcagacaacggctgccatgaccttggctctacactggtccacctgctttgacttgtccacttttgctttgactggaccacttccacctcttggtagctattcctttgattgtgctttgtcttcaggatcacacacataaggccatgtttcatctcctgttataattctcaaagaaatgcttcaggatcttgatcccacttgtttaaaatttccattgaaagctcagctcttggttgcagctgatctgggcacaatggttttggcaaccactgagtggaaagtttgctcaactttaatttttcagtcagatttgtgtaagctgaaccagttgagatgtctatgatgctggccattgtttctgctgttaatcattggtcctcttcatttaagtcacaaataagattaatttttttctcccaaattgatgtggatggcatatcgctgcaggcttcatcttcaacatcatcttgtcccttcttcaaacaagttatctgtttgtaagctgctgatttctttgggacattgtcctgatgaacttttcataaagcatcaatgattttttcattcttccacctaagcttcaccaaaaattttggtgtgtgttcttgcttcaattttagcagaattcatgttgctctgagagaggatcttttcaaacatgtcttatccttgttagtgcctcaaactagatcctgttcagatatatcaagttagtgagagtttattttggtgcaaaaaaaaaaatttgaaatctatgtatagttttttcatagcacgtatttttcatggaacttttggaagacccgtcatatagacacactcacacaatggatgcatgtattgtcagtgaagttatgttggcttctgaaactcaagggattttgctgaaactcatgaaactcaagggattttactgaaaagtctcagcctcaattggttcctcttacatttgcatattctgtctgccaggtggcaaggtagaattgactgtaataagaaagaaactaccattgagctccaattattgtccatgcctcagagttgatttttaacctgagagtgacagcagccacctgggccaggggcagacaggtagtttgcctcacctggaatcagaggctcccctatcagccttatcttcaagaagctgataggaatgctttgtttttcttttgtgtgctggacaaggagaggccccggaaggtctgtcatgtagattgacagtttccttttgtaagactggccaactgaggccaaagttgaaaatgtcagtaaaaacaaatagtattgcaaaagggccttatgcatttccttctctatcctctcattgccccatcagccgagtgctgcatgagtggcttaagagaacaccattaggcttgaaaaagagtgaactgcaaaaacacattttctccatttcacctagttgttattttccccccatgtgctaatgatgcaaacaaaagaaaataaaaataatagacattggcttatgtcttttcaagttccatttcttgtttcttcttttactattttcagaatcaaggaagataatacagaattttaacagttttcttacctcattttgcatttgttagacattgtttcctcgtggttgagacctgcttcctgctcaggaaagagaaagcagtggttgcccatacaattcaataataatgactctttgtcattatttaacagttgtttaggtgtgcctctctcctttcttcagttgcactaatgatagaaaaggatccttgggcacatagtaaagtggttcaaatcatgggtttgggtggtaaacaggtctgagatagatttcctgctctgccacttaagagctgggtgacgttggggagtcatttaatttttctgagcttcacccataaataatacatacatacataaaactcacctttcaggtttctgaagatgatgcaacacagaatctcaaaggtactgggtacccagggacactgcagtaataggtcccctctcctattgctgtcagctcagaaatacagaacagagcaactgggattcagaaaggagactataggctctagatagaggtactcactcacttccttgggcaactcacttccctgagcctcaactttcttgttggtaaataagtggaatcttcctacccaccactagaactgtgcaaggaagagatggagctggttaatgccagttctgtctgattccagacctggttcttaactaacaacaaggagtggtgcctggccaggcacttggggcattgtcccaagaggatgtcaacatgtcttcttagagaaggacagtcattgaggcctgaggaagtgttcaggaggaataagcttcaccaggatagtttcaatgacttaaccctttgcatgcagtttcctcaagtgtaaaccgggggtcatatagtcccaggagttttcaattacagcctttgaagtcttttgagattgttacacaggatcaagtagaagaggatgatttctagctctctattggaatttcagattaatgtctacaaaactcactaaagtccttgtattgaataattctttacccaactgatagcagttaggcttcattttcaatgccattaactctgagagcaaacgacaggcttttggtctgccaatatattaaaagtgtgtttctgaggaaatttcaatgagtcattcgtttatataacaaatacttgttgagcatctactttctattgggtactgttatagggattagagataacagctgcaagcaagtaaaaggcccttgctttctcagagctttcattccaggaaggagagaaagagagtaaccacacacatcaatagatgaccaggctgttgtgaagacacaaaagccaaatgagttgagggagagactgggggttagacaagggtgtttagggaagcactctaaagtgaggtgacgtggagttaaaattctgaatgataaaaaaaatgaaccacctatgtgaccatttgaggatggaacattccagacagagaggaaggcagatacaaatattctaggatgggaaggagctcagaatgtctgagagaattgaagacaagctttgtgcttagagcagagcaagctactttgaggttagagagggagccaggagccagattatgttggttttagccataataagaacatttatactgggtatgaacataaactcttggaggttgtaagccagggagagatcacttgattgtgaaaaaatgctcataacataagattaagtggaaaaatgactcttaaatctagaactgtatattcagtaccatttcaattatgcaagcatatgtgtgagtatgtatatttgtgtgtatgtgtgtatgtgtatatagatacatactttatgtatatatgcataaagtacgtgtgtgcatgtgtgcacgtgtgaatgtgtgtattcagtaaacaaactggaagaagatatagaaaagtgtttgctgtagtttttgtagtggtggacttattttccttcattgctttcctgtgttttgtaagttttctgtaagtttgtatgacatcaataatcaaaattaaatcatttgctttttaaaaactttgttgcagagcaatcaatggagagaatgtaagagtgatattattttaccatgtcttttctcagatttgagcttaatatcatggtgctttggaatgctggagtgaattttgaaggctctggctagcagagaagtttatttggctttttgtttgtttgttctttttttttttttttttttgagatagagtctcgctctgtcacccaggctggagtgtagtggcatgatctcggctcactgtaacctctgcctcctggttcaagtgattcttctgcctcagcctcccaagtagctgggactacaggcatgtgccaccacacctgactaatttttgtatttttttttttttttttttttgaaacggagtcttgctctgtcgcccaggctggagtgcagtggcgcgatctcagctcactgtaagctccgcctcccaggttcatgccattctcctgcctcagcctccggagcagctgggactacaggcgcccgccaccacgcccagctaattttttatatttttagtagagacggggtttcaccgtgttagccaggatggtctcgatctcctgaccttgtgatccgcccgcctcggcctcccaaagtgctgggattacaggcttgagccaccgcgcccggcctaatttttgtatttttagtagagacggggtttcgccatgttaaccaggctggtcttgagctcctgacctcaggtgatccacccacctcggcctcccaaagtgctgggattgtaggcatgagccaccgcgcccggccttatttgactttttaaggagtctgtcctaaactgaacttattactgtctccaaattatttatgcaaaagaatctaacatttctatttcttcccatagatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtaagagaccagcacccgaccactggggaaagctggcggcctgggaccaggcagctgggcttagaactggaaggctcctttcccacagctgaatggattattgcctaaggagtcaaccccacgtattaatttggccaagtcaatctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctaccagttattctagagctgcatagagccttcctcaaactatggctccaagcaagataatcacaacaagcaaggactttattttttgaatttccaatggccttgcggtaagcggtgcacaagaagagcaagccacggtggcaatcacagtgaattgttgtggttcgatttgttttcactagaagaggactgagtaacctctgcaactgctctgaagtttctaccccagcctgtagctgtgcttttgcagtgtctttaggtaatatgattcccctttctctgcaacacacactcacatgcacacagactgcttttgaaaagtcaagctgcagaactctacggaaaccatgaagtgtaagttaagtgcttctatcctccaacactgggtacagtcatgcacccacattatgagtgatggctgagactcttgctgaaagggaaaaggaaagtcttttgcctaaaattgccctgtctgatatggtagccactaaccacatgtggtgacttacacttaaactaattaaaatactaaaattaaaactttagttcttcactagcactaactacattttaagtgctcggttagtcaccgatggccagtggctactgtactggatgacccaggttagagaacatttccatcattgcagaaagttctattgaggagcactgctctaaaataaagagcagatgtacatagacatctgtatgtgttcagagctaggtctgggggaatatgaaaggagcagagagagggagaaagctctggtggctactgaacttgcactgtaggatgcaatgaaaaaaggccatttagcaaatccattattctattcccaaggctaattgtttaattatggccctgactaggccactggcctaagaaagtgaatttagtaagctgaactttgattgtgaaatacaaacaaggcatacttgcaaaatatagatatgctgccatgtgctgaggaccaggggagttcttacaactgccactggccaatcatcaagcacttagatgctgggagccctactgcccacctggccaaacccctcacttaatcctcaaactgcagtattggtcaatattatcacctcattttatggatgaagcagccgaggcttagcgaatttgcacacacagcctgcctatggaggagttaggattctggttctgcttagcctcagcccaggacaggattttaatgaccaagtcctcctcaggggcttaaaaggggaggaaagtatgcttcctggatttgctgaatattctttcctccttgtgaacagtaacttactcatgccacatacacacatataaactttaatatccccaatttacagttagcatgacccataaaaccggtaggcaacatgaggtggcaaaaactcagtaatagcttacaaagagaatgcaatagattctagaatgttggtgttatccatacttgatgacatgatgtgatgggggtgagttggcgggtaggttcaccaagaagtattatttagaaaaactgtgccaaagaaatctatcatttcacccataactggtattaagtattgcaaaactcatttccataatttctctcaggtagctatgaatcagctttctgccacaggacagatggcagagtctcatgggttaggataaaaccttagcagctactctcttttgtctgccccaccctgattggtagcaactcttagatatatgaaaacttattaccatttaattgtgcccacaccccctgccaagctaaggaggctttggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgaggcattttatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgcaatgctcaggaggcagtgtgctgtgctgtgtacttggcatataaacaaggcttcatgtttagggcaatggagtatggagtaaggggactcacaggaaaagttgtggctgagaaagaagtgggggaatgggacatgaggcaggtctggaatgtgtgcactgaaataaagaagcaccccttcctatctatggaagctggccattttgtgtattttctggaaaacatgaaggtattccagagccagcatgaatcttacatcaaaacttctctcttctgtgactcaggcttccttctgtttgttcaaatagactcaacactgctgaacacaaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacaggtatgggttcatagaagggcacgtggtgattccccggatccaccccaactccatctgtgcagcaaacaacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtgctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctggaaaaaagccttggagagtatatggtatgcctttgaccttcttaaatatcccttacccaacagttgaaagaaccagagaagaagaaacctaagttaagatgtagatgctaggacacaggccagcctttctctatgtctttgtgactttctcccaaccattaacctagaaaatcaggcttatgagccttattcaagtcctagcaaaattaaagaattctatgcatcatgaattttcagaattttttgagaaggatcaaaatataaatgtcaaatatctcgatgccaactatcaaaagtcttacctcttaaactgggccttctgttcccatggaaggtttgaagttgggtgaagggaaagatgaagccttgaggtaaacttggtacatcttgctggagtgtcagttttccctaaagatgtgaaggggatgttaaattagctggaaagggacttaagacattatcagcctgagacaaacacagatatatacatatacatatatatatatttatatatatatttatttatatatatttataaatatttatttatatttatatatttatattcatttatataaatttatatttatatatttatatttatttatataaatttatatataaattatatttatatatttaaatatatattataaatatataaaaattatatttatatataaatttatatatatatattatatataattctatatataatataatatataatatatattatatattatattatatataaattatatataatatatataaattttatatatataaatattatatattatatataaatttatatttatatatatgtatatatgtatatataaatatatacacatttatatatataaaatcaagatatcacagatatatataccatatacatcaaatataaatatacatataccatatatatggtagtaaaatataaaaagctgcatggatttttaaactataaaaaggacatcaacttaattatgagatctttcttctactcactactaaaaaaaacccaaaaattaaaattaattgtgagattacatcagtggctttagtctacaccacctaccctttgttgtgtgaacagtagggatcagagtggaaattcagagaagaaatctagagtttaggacaaagtatcagggctggctagttgaaatggagtgcgtgaagccagtagattttgacaaaaatttacaggtcactgaatctatcgagagacatacgaaacaggaacagaaaactgtagaatgtttactcctccctgttatatgagtgaagaacacaaatggagtttgactaaagggaagggagtccaattaacactaagtagtacacgactcatacatactcagttcccatacccatgtctagcatgtcgttctaatgatattataatgagaaaaccacatataaaaaagtaagaaatagacatagagcaacatgtggtctagctagctccatctcagtgcaacaggtcagagggagacattgggaaaagcttgtgctttagatgaagaggttgactcattgggaaagggctggcatgaggctatacactcctgagtctctgggcactgcttattgcatctcccattgagtcttgctgagtgaatgtatgcaataaattatgtagttgcatacccacattgtcttacctgttttgcaagttggtttcacttgctaaaaggaacctcaactcagatagaagctcacactgttttattgcctggcatcgaagccatctaggcaggctgcgactgagacttgtttctatccttaattttgttcatgaggttgggcccatacctggagttgggagcaagagcattgattaattttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaaaacatggcctgtggctaacaaatgaaaataaggcagaacttgaaaaggcctttgtgattttttttccctcattttcagtggttgaggcccaacgtgagcctggtgacttctgtgtgaacacagaactgacttgaattgattcatttattaagcttgctttcagtcaagtgcctcattttcttttgagggtagaattaaagggaagattctacatgtacttgtttatccatttcctcctttattcaacaactatttgagaatatttatgagatacctaaaatgtatcaagcattgaagagggtgcctttctatctggcaaccagagattagtggttagactgaataattaatgtttctcttggttattttggtgtgttgaagccaaggtttatgagaaagcccacctcagagaatttctaacaagtcctcagattcaggaacacctcaccaggtctagctttccaagcagtacagagctcattaaatggaaagaaaggctatctaataaggccctggaatccgacatgagagcatgagtctgttaattgcacatttgggtcaatccactaagcatatttgccagatttgatgttctttataaaagttaaggtgaattggagcatgaagggggtccatgtgaacaaatgctctaataatttacaaaactgtcttagggtttgtgacatcatgctccattctattacaacttgctgcctggaaattcccagtgtactgttacttgcagttatatttgaagttaggggagattgtttcatccctggcatcaagaagccataatccaaagcctggttccaggtatgcacaacatacaaatatcagaagcatctcataggttgcgtcagtttctgctgatatttccaagagaaacaagatagatactcccctaaatctcccaggttggctatatgcccttattttcaagtgtaataattttggaaaatatttttgaaaactgtaaaaagctaaattaatattaattattacagtcccccatgaccttgtgagtttatcagaagcagggacagaaacatgctcatcttcttttctccttttatatggtctggcatataagtgttgagtagatgcttaaaaataataaatgaagagttatatctgtaacttcctttaattatttcttatggcattaccatttaaggataatctaaatgcgtgacctgtacatatttggagatgcatttagggggctaacatcttaggtgtgtttactggaagaatagacccttgggaaattatatcggtacttttttcttttttcatccattcaacacatttttattgcatgtttctctgtccccatcacacataaatgttctggccaagacagataaagttattactcatctgtggagcttatacatttctagggagggaggcaggtagcagaaggcagagattgagagaagtgccatgaacagccatcaagtaagatgaacaagataagtttatatggtggtaaacatgaagaagaaatgagagcaagatgctatgtgatggtgacaggtgtgggggagtgatgaagcagtttagattggatggtaaggaatggcctcgccaaggaggtgatacttctctttaaagaaatctgagaaatcttttaggacaggctttgcaagaatggtgtttcctaaaactttctgtttttttccaattgaatgtataaaactgccagttagttccactaactgcccaaagaaatgggcaggttaaggttatcctttttatctgtgggaaaagatgctcccaggtactaggaagcaaacaaaacctgttttgttcaacttgtgtttctatccacttttataagtacacaaaaattatagcaggacacttaaaatacttgtgataacagcctttcttgtgatagcagtctgtctgtctgcctgcctgtcttcctccctccctctctccatccatctatccatccatctccatccatccatctccttcttcctctttgccaggagcaattctgggagaaactaacctaacaaataaatttccattttaatttaagtatgcacacacacacagaataaaagctgtaatgcacaaatggacttaacctttctataaaggcaaaaccagtttaaagctctctgaggttttagagctcaatacaaggtatagtcacagaataaagcactttggcatgaatagaaggttgcttcagctacactgcagtctgcttttaagacacaaggaatggaatgcagggtggaagtttcagggcctgttatcagaccgcttgagacagtgctgctcagagggctaccagtaacatctgtggatgatcagtcaggcccaagattcaggcagaaatctttattcctaaagcaagggatgaaagagtagaggataaaacgagaacaagagaaaaaaaaaaccagaaatgcccatgatgagatatgccaaaacagtaaccttgaaaaatattctgggcacctaggccaaaggtggtcaacctcagaagcaacatgctgagaagcagtctatacagagtaagcacctaaaagatcagctaaattaataaatacattattacattaatgaaagactagagattcatttggtttttaatatttcaactgagtaaattctttgttgtgattatgttattttaaccttcagattgtcatgctgttcatgttgataaacatttgattgtgtgtctgccatgttttctcatcatttctgtggacttcccagattataaatgattttctcatgatagttcatactttacttttaaatttttttacaatgttcctgcattacttttgtaatcacaaattttaaaaatcctccctaatgtgtttgcattagagaaggagccgtgtctatcttatttaaaattgtacccccaggcttccacagtgcctgatatagaatgtatatttattaatgaatgaattcactgtggtgggaaaatttccggaaacttcataagttccagaaatttatgaaatcaggtaaaaacggaaaatccatcaggaaaggcagagaaattcctagccaacttaggagtttcggaaaaagaaagttatttggaataagttatagtaaaactccattctaactgactaataaaaatgagggtagattttcctcatgtttttaaagggttctcatcctttttttcctacctcatagctccacctgaagaagattgtacatcagtcacagacctgcccaatgcctttgatggaccaattaccataagtatgtctctcttctaatcttaattaaattttcctattttggggaaagggctcaggtgtgttctctgtggtatatttgaatagaatattaggccaggtgtggtggctcactcctgtaatcccagcactttgggaggctgaggtgggtggatcacttgaggtcagaagtttgagaccagcctgaacaatatggcgaaaccttatctctactaaaaatacaaaaaattagctgggcatagtggcaggtgcctgtaatcccagctgctcaggaggctgaggcaggagaattgcttgaacccaggaggcagaggttgtaatgagctgagatcgtgccactgcactccagcctgggcaacagagtgagactccatttccaaaaaaaaagaaaaaaaaatattagtcatttccctaagactaagtaaggacagttggctttaattcagtgtcccttcctttttttctgcaatgacttgaaactgctctctggtttacactcatgcatcgttcctcaaacttcagtcatttgaaaaccactttcacattttttttggcatctctatatgtacaatgctctcatttacttgatatttttatttaaatgatccactgttttctaattaaaatacacttatttttaaaaagaaattgcacatggaaaaccaacatcacatcgtaaatagaaggcaaccttaataataaacttaaatgtaagaaaaattaaataatgttcttaatttgcagctgctgaaagctctgggtctgagtcatgttctctcttataaagagggattaataagtgtcaggtgtaggggcattttggccctaattagcaattttctgtttgatataactgaagtattgaaagataatcatgaaggatataaacttcctgatacgtgttttgacattgtttataccacatccatcttaaatcatcctgatatatgattatccacagatgtatatattcgggcactttttaaaaatagacatgggggtctcactatgttgtccaggctggtcttgaactcctgggctcaagcaatcctccttcctcagcctcccaaagtgccaggattacaggcatgagccaccatgcctggcctattccagcactttagaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgtaatctcagcactttgggaggctgaggcaggcagatcacctgaggtcaggagttcaagaccagcctggccaacacggtaaaaccccgtgtcaactaaaaatacaaaaattagctgggtgtggtggcatgcacctgtagtcccagctgcttgggaggctgaggcaggagagttgcttgaacccaggaggcggaggctgctgcacactgagattgcaccactgcaccccagcctgggcaacagagtgagactccatctcgaaaaaaaaaaaaagtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctggtttcctagccagaagtgggtgtttgcacaagtggacaaaacttgccccttaaaaaagaaaatcaaaatcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggactctccagtacttccttgtttcctgcctcatccccagggtgtgtgggggatgggagggtgcactttcttagtgcatctgccactctctcccaccactggatagataggtgtttctcattacaaaggaaaatagctttgaagtcactatgttaaacgctaatccacatactcaaaatatgagctgtgaagttctgtaagtaccttttctctctcccagctattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtaaggagaataaatcactgtgcttcccaatagcaattccctggcaaaatgtctctgaccttcctgagcattgcacactcacgtgctgattttctcgtctctagacagctggaagctggtgatgccattcagggaggtgggctcttgtggttgtcagtaaactgcctgcattgactactactgcctaccttttttcctcatctataactgtttttcttaccttagcataagaagtgccatattggaagttttattttggggagagccctccttattctcttatccccaggtatacagtaacaattcaagcctgatatgaaaactgttttcattttttcatgtttccttcttgttcttatccacctatggataagattgttttcataaagttgggatcatagagtttgcataccactccactagcaccttttaaaaaacccacttatgcctgaggttgcaattttttgaatttttgcaatcagaccttggtgatgacaatgagcagtaggatataaataactcccacatgcttagctttccaataatggaacagtaggcatacgtgggtcaactgtggctttttatgttttaacttgatttacattcatactattgatagtgtaatattcagtgattttcaccaacgataatttactcaacaattcctttgtttttagtccaaggaagcatatctggaagagttttctggtgaaattaaatcagcttaagagctctataatccagcctgttggggaatgttctcaatacttacttggtgtgtgggggtaattcattacttagggttgcaagagtggaagtatgtaaacattgcgttccattcctttggagtttgcccctcgcgcttcagctccactggaaagtgtttacatctctcttgtctcctgtttccctctttgcttttcttctatggtttgttttgaaatgggctcccagatgggccatgttcctcctgtggaggattaatcaaactcaaatagggcatctgcctctggagcggttttcctagtatggtgtggatgttctcttttcctggctatagctcctgaggggtgaaacttgggcctccaaagagtgtggcagaaatgcgctggcttgtgaatactcaagacagggcccttctctattccttgtcacccagaagccagggaaacccccacagtactgtgatttcatttaaggtcacttgcgcaatagtgttttaaatttctgtcagtctctggctgagggcatgatacaaataggcttggggttcccatcactccctgcacattctttgaagctttttaaaaagcagagttttcaagctgcccatactttcttgggttattggccctcttgagtttgcatcggcttattgttggtagtcccgtgggcaacccttcttgagagaggcttctgcaaaccaagcgggccgtgctgctagctactcactgcttcttgggttccctgtctttttaaagtaaccatgtcgaaggtgcttatcattatggtaggcaattttgtcggatgttagcgaacacaataattagtggtctcagcaggaaggagaataggtctaccctaaagtaccacttcccaccaaagaagaaaatcctgataaaacataacttgggactatatgtagttaacattcaaaccactaatagcctatataaaatagtatttcatgtgtgttttaaaaacacacatttcattaacccctatagaatatctcttaagaactgtatcttcccttcctaagttagtcagcaaacgtattttgagaacctactacgtaccaggcctattagaatgcttgggatcgaaggataaacatagttaggaagtaatattgaagagaggcaaggattactgagatatttattcattcaatcaatatctgaggtcttctgtatgccagacactgctctaggatgctaggaattcagagttggacttaccttcatggagactacatattattggtttagaaatcagggaaaaggagtgtttatgagatttaactaaaacatagttcaggatttgagctgagaaatgaattgtgcctttctcctcccagataaattagttaagtttccttcagcagctaaaaaagaaagagactaatgagtctaccaaatgagtccagggctaacctgagagtcactgaagtactataggacccaatgggaccagtagcagctccaagtggatcacttcatgcaaagaaacataccaaggcaaacaacctggtggaaacttgaacgtagcataatggcatgccaggaaaagtcagcactgttaggttcctgagtagaatcgtatttctaaagtccagtgaggagatttgcaaaaccttatcactgttggactgagagctgggacagagtgacagggagtgattgcaaagcctccctcatgcattgcaggagggcaggggtcaagaggagtgctggctgagagcacagaagaagcggtctttggctcggctggctcattccttcctgaagggcctgtagtgggtggcaatagggacagctagtaagaataaccatctgggtagctttaggcttccagcaggctgtttatcttgagtgtcatcagcctcttcctattggtgacctggaactctctgggatcaagaaacctaaactaattcaggaagcagactcctgccttggaacactgtatttccttgtcttctgggtgtcaaaggaattctttcttttttttttttttttttttcagatctggtatggcctatttgggtggggaaaattagaaattctgctggctaggcagtagctttttccatttttccccctcataccactcctttcaggaagacaaaaataacgcctatttctatcttgttcttgtaggtttgtttcctctggtactattttttcctgttgtactattgggtgagggtggtgggaattatgcatctttaataaagtttctgaggtgagaatgtggtgtctgtggattttcccggggatgctcaggtttgtctggaggcttcatgggtaaaattggctcctatttctctactctctgttctgaactaatgtgtcctttgcagcaggggtgtccagtcttttggcttccctgggccacattggaagaagaattgtcctgggccacacataaaatacactaacactagccatagctgatgggataacaacaacaaaaaaagcttataatgttttaagaaagtttatgaatttttgttgggccacattcaaagccatcctgcatcacaggtggcccacaggctacgggttggacaagcttgatttagaggacagaacatactgtgccagctgttggcattttatatagatagagtcaaagtttttaacctagggttcatggaccttcagtaggttcaatggtagaccataaggcattctagaactatctgaaataatatgcaaaattttgagtgtgtatatgtagcatcacttttttgaggaaggaggacataacgtagattttcaaagggatatataatttaaagtggctttttaaaatctcagctggcttaaattagatatttatcctgatggtttttgccattccatttcaataagaaaacatgctggactcaagtcaaacttgagagtcgaatgagagattttaaattgcaaaatgttactgatgatattttctctaatttgagaaaagtctggaatttctctaactttggcaactctagtttttggtagaaacacatattgaattagaataaaaagtgacagaaatgatagatggatacctgaggaagttttatctgatttcgacactttgaacacattttctttgcaaagttcctgctcaagtatgaagtttgacctgaggctgatgcgtgtgggcggagctttgaaatgccagttgtcatcacaaactacctgggtacaatgctagacagatgtgaaaaatacacactagcaacccaaagataatccaaagataaatgcatgaaagcagtcgtttgaaatgctgcttcgaaaacctccagctcatggctcagtcgcccaatcaagtaaatagaaaatctctttccttcacaggttattaaattgctgcttgattttgctttgatcatgaattcaggggattcagtttgaagaatgagtagcatgaaatttatacccatgaggaatttgcatttctgatgttgtcctaagattgtgggagacattaggagtctggaaagataaaaccaggcctagattttcttttctaattatcattcaataatagatacagacatcatatataggcagaactgaaagtaaagatttgtagagggaatatcactaagtgatactttcataattgatccagttacttcaactgtgcactcaaacagccacgcaacagctcaggagcaaaataactagatatggtcctggtttggtaattcacagcctaagactcaggatctcacaacaacagcaacgacaggtaaactgctttgtcttttgcttatcagctctcctggatgtcagaccttttagtgttaggggagaggacgtccattatcacgtcaaatctccttcatcattcttagtgagaatagggtcttgtaccacttcatatatcagaaaggcctgtggatctggggatatgattgatattcttaaatgtcctgtatgttttccttttggcaatgtgtatatagaatcagaatgatttttccatcagaggaaggaaaaactatgaatcaatagttttgaatgaatgaatgaaattatgaaaaactacaaatgaatgaattgactgtgtgattcaatgagaaaatgtcctttagaaagaagtctgccggaaagtgcaggcttctcctttctgctgatctgattctcacagccagtaataagagaaggaaatgcagatttctctcatcaaagtgtaggccctgaacccttctttggacacttaaaatctcaactgtaaagtgtaggaaatgacctgttgctccatatcagaatctaggcctctaaccagctccctgggtgtgtggctcttagctctatatccctgcaaagtgtattgttacaggagctttggggaaaaacgattcaaggcctgtaaatatgggagattacaaggacaccctcatttattaactttcattgatggagttaatggccatatttcaaaataactaggcattctttctgcagagggggataataaacatggaaaaattattctttacatttgtttgccttatatgacattggataaattatattctttacttctataaataatcgtgaggaaaatagtgctcatgttatgttatggttgccatatcacaatgtctaagatcatgcaggggtggggaggggggatacagagattgcagaataaagacaatgctatttttaaatgttgacaatgtttatcttcataggacaaagaatgtgaaggaaaaggtctttttggcagtgtttcatcttcttggttcatttttgggctttcttgatagctgaaaaaaaaatctaactcaccttactattttgtttggggatgatggtttcagcctctctgcttgaacttgttctcagttttttgtctactgttagctcatattcttccaatgcacatttttgggcattattggttatagaaatggcagtctttggagatttttaaatcaagactcttgcttctggtcttattagcaagatcattggggtcacttcatctctgtctgtctttcctgattgattatcctattttcaaagaatgagactcaaaatgtcctgttctgctttgcaaaatatagtttcacataagaaattaccttgggcaaggttgtgagaggatttggaatctaaatggagaaaagtgtagaggcatatttttcaatcttctacttctatgtcattttccctgtgtgttggattgctaagattatgtatctattgctggcagaaatatcatatcctaaattcttggagaatgatattggttgcccaagattgtatagaagattaaggagctaggactctgaagagctgggttttagaatcataaactctcaggtttggaaaggatgttaaatggtctggttcaatcaacacttctaataatttaatctcttacacaactttcttgccaagtgatcttcctgactatgggaaacataatactttatgaagaagttcattgttggatagttcagattattggttttttaaatccaacatttggaagaacattcctcttcctgaaattttcaccacagatcctaatttggcctcatggatccagaggcaaaaaagtttaatccctcttttacattatatagactttcaaaattcaaagacggctgtcatgcgttcctggagccctcactcttgctaattaggcttctgacttcagacaggtcagaagctctgtccagcaaaatttttaaatctttaatataaggagcatgaaccagatgacatttaagatccttccctctctgacattctataaacttcagtttgagtctctgaaaaaaatggaacttttttgctttttccctttcttttcaccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttttcatggttgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccaggagaaggctaatacagagactatgaaacgggaataagtttttttaacgatatggcaaaattgtgactctgaaagatcattcatgtatattctaaaattaccacagtcataaaaagtcttggactttcatgaggaaatagcatagctagatatgaaaaaatatagaaaatcttcatcaatggaactattcttggggtagacactaatcatatgaaaagacaaatgctcattccctaagatagcctgaatctcatttaaaatgtagaaaacccctttttagtaaagagacatcttctacagtaaccactgagaagaagtggaagtttttcatctcctttttttattcaaaaagaaaaagaatttctcaatttctgaaccacagttcactttagttaacccctttgattgcctaataatgccaaaaatgatttctctgttaattggcttcacatttttgctctatgctgaagtagtattgggaactgcagtgtagcttccatctctgtttggaggtacactgatctgatctgatactagagaagataaaaaatgaattagcaaattgtgaacacaatgaaatgactgacgtaggtgtagattccaacatttttctgaaggtgtcttgaccaaaaaaaaaaaaaaaaaaggcacgtgtgaaacctttccattctgttcttgatggcttggctttaatggcatatggttaatgagttaataataaacatatctgaaagtgtgggggagttttcattagcctttaaaaacttatatggtgagattatgtccacacttattctttcagctttcttaaagagaatattcagttttaaagatcatagccacttgttttgagatttatgtattagcttcggagatcagaacataagaatttggggtatgcaagtcaactccctcactttcttttaaaaatcctgggaaatccattataccttctgtgcctgattttcttcctttgcaagtgggttgcttggcgtccagctcagccactaatgcaagtcaccacaacaggtacgtcttcaaataccatctcagcaggctgggagccaaatgaagaaaatgaagatgaaagagacagacacctcagtttttctggatcaggcattgatgatgatgaagattttatctccagcaccagtaagaataatcaattacagtacagccatttatgcaaggcttattgattaatctgagtgataccaaattgtatctctcttgagaagtagttaatgtgaaaaatgggtgaacctatgatcataccttagttatatcttgatgagattatggaagaagaaatagaatgttttgagaagtggggaaaatatctcacaaaatttctcttgtctcatgttcttcctgttttatttatctatgggatctactgctacagattgtctttgaatgatcaggctttatcagagaatgacattaaaacagtacaaaaaatgtacattgtgtacttactgtgctaggtgctggaaacacgaagatgaaaagagccagagcctttgcttttcagaagctcatggtctgttggagcaatagacttgaagaatgtgatgaggagggtattaattaaaagttgtaggccaggcgtggtggctcacacctgtaatcccagcaccctgggaggccgaggcgggcagatgacgaggtcaggagatcgagaccatcctggctaacacagtgaaaccccatctctactaaaaaatacaaaaaattaaccaggcgtagtggcgggtgcctgtagtcctagctattcgggaggctgaggcaggagaatggtgtgaacccaggaggagatcgcgccactgcactccagcactctaacctgggtgacagagccagactccatctcaaaaaaaaaaaaaaaaagttgtggaagttcctaaattgaaggccctaaaggcttaaatgatgggagctagaactcaagaattatcttagttaatcaaagcccagctgaggtcaaaggaacaaatccagagttttaacaaatgagctggacaccaatatagcagaaagaccttgaagggaagggcaaatgtcaggttagctttagcaagacattgccacttattaaaagcaaataatgaaaccactattggtacataatagtatccaaatttttgacaattataaaactttttgagaacaaagagatggaaattgagctttaaagatatccttaaaaagttaaaaacatgcaaaggttggtctaatattctgccagattactgagttttccacacatacctgtaatgacttaagattttgctgaacagagctgagaatcctgaacctgactccatcacagttctgcttttccttagaaaaaaggcttttggggtgctgtgtgagctctcccaattcactgaagttctatccattccattaaaatctgagaatttcatcctcaaatggacagagaagaaagggtccagaaaaaaaaatagcttaggccttgaaggcatctgagtatataacattgatatgacaaatactcaaaaggaactagaattttctatctaaacttttaagtgattttttttttagacccgacacccctccagagcttaatctatggaataagaaaattccttttggtaacttcagaacaaaaaccaaataatcaaaaacactggagttttacattatactgtctcctgtgttcagcatgtggcccagctttgcagatgggcccatcagtaaatacgtggtcttgatactgaagaaattaaattcccttgggtggtaacccaaacagatctacctgtaaatgaattgtatggtcaggcttcagggaaaaatttcccatggtgttgtttttttttttttttttttttttttttaattttttaaatctctatggcatatttttccaatttctgcttttctttttttttcttttctgcttagcacctatggacataattcaacatgatgccctctttcttctggaggggtgtgataactgcttgataataagcactttttcaggcctattgagaatgtggttaatgattctaaacttgatttttcataacttgtaaaatagagctgacagtattatagttctgaaaacagttttgcgttatttgggtatcaaaataaagtttgaaacaattaggatggatttgcaaataacctttcacaaaacatgttgactcagattttgtcatgatccttctgttaggtgcatctcttattccagccctaacagattgggtgacaatatcagggtgctggtggatgtacgcctctttctttccagtgtgctgctatgatggtggctggttacctgtggtgtcttattttctttcactggctatgaatggcttgctcatgacatattttgtatttgatgagaataccatagtgtttgataaatattcagaaatgtatcgctaaaacatatggctattctaggtattctttttcagaatcatctataggaaagctctagctgctcaggcattcctttccccactgaaattactaacaacataaagtgattatcatggtataactttcagttatctgcctcttcacccggaggatctacaaacagcacacagtgactaagtccctgggctttcaagtgcagagggatactacagactgcatggatgggcaaaatggcgcctttggttatcctcggtggagggctggtgttttcaaagctgtccttcctactgctgcagcttctttgactgttttatctggaagatctcatgttctgaaccccaaggtattctatgacagaatgcaaaggacactgagatgcttaccaatatggctgaattaagctgaagtcaccctccgctttccctccatttccatgcagccatctatacaacctggtatagatgattcattgcatagcctacagaagcaagactatgtgcgggacaagtggcgaaggctcaagaaataacatttttctaattgcttcaatcatcgttatcacagtttcaaccacaccacgggcttttgaccacacaaaacagaaccaggactggacccagtggaacccaagccattcaaatccggaagtgctacttcagacaaccacaaggatgactggtaatgggttctgcatatttaatgaaagatttttttcccctcaaagcccatgatgctgcaaaggtcaatcatcgaggcacagtgggaaatttagttaatatctgatcaagaaattcttagtggacttttatgaggatacttaattccatttaggagtcatttatcaattataccatgtgggcacaggattttttatgttgcttcatgataaaaatgaatatgtttgaatggtttgtggttctgcctttgacaaactgatcatagtggaataataagggaacatgaagaaattccaagcccattgattttctcttgagaccaattaggtaaagtcactcaaaatttttgagagtggatgctcagaggtaacactttggcatagaattgttaaatagcatgcactttaatggaagaatagaatcattaaagattggttgataacaagtcacagtgtatttaaccatcatcacagcagatgtagacagaaatggcaccactgcttatgaaggaaactggaacccagaagcacaccctcccctcattcaccatgagcatcatgaggaagaagagaccccacattctacaagcacaagtaagcaagatggcggtcggcagttctgggttagatgaattagtaaagacattccagcaatagggaagattttgtttagaaattggccgcatcttctatttccactcggtaatttcttttattcttagagcctgaaaagctgctaaacccgcacacaaattttaaaaattggaaggaaaatgataactcatcaggttgcccaaaggccaaaatgttttaagaagtagatctagatacaatttttgtgttaaaggttcctagaggttccatttgggtaacttgtgtgtgttcattgaaatgtgtggcaaagagtgtgttcttttggtgcttagtagtggaatctggaaagaaagtttgtcaagtgaattgatctttggaatccttattttctatgaagatctttgatgaatacagtgtcttttttgcattctgtccctgactgttctatagaaagacatcccttgtactctttagagcaaagttggtagctcttatggtcttcatttgaattctaccactgcttctttttctgtttttaagcccatggtaacttggggaaggctttgatgctcttactgttatttctactattatgaaaactcaggttttctaaaacaatctcaagttgcggcagtggactgtgagaatagggggccccctcactccccaaacataagaagtatgtgcttttcttcttttatctatcccgctgagatatgtctatcttatttggaataaaagtatttattttggaaaacagctttttagcatttttaaaatgatgacccaactgtcattctcacagccctagatacacctaatggggaaatgtgagccacttaaaagccacttaaaaaccaaagggctttgggaatctatggcttgaggggtgccttcagataacaaaagaaaagtttcaggtatcagttaggatagaggttagacattgtactgaatatatccagcagatcttacatcccattacaaaccccagtaggtgtgttgtatacatacggcttaggggttaagttaacaaagaagtctgataagaaaaggaaatacagaggaagcataaatctctttggaataggattttgttccactcccttagagccctaacagtataccttagaaattattttagacagtttgtacttaaagaccagaaagctactttagagacttggaaataatgagcctattgtcaaaaggtggtgcttgcggggcattaggactagagggttggtgaaaattcagacagaatgtaacttgacaaagagaagacagcaacaactgtaacaattatcttatgaatatttgcgaaactcaaagggatctgattggtgacctctgggctttatcaaattaacatcacaacttctagaagaaagtcaaccttcatcttttacaatagaaatcatatgttttgctaacccattcctatttaggctgaaaacaattaagagttatgggtacttaaaaaaatcattatgtttataaaattagtgatagaaggagcatagtgttctatacagtcacacacatacacttccttatttcttttatttaaactttgagtaacatagcagtctatgtttgggtcagttttcccttttttgtaattacattcagtggtttttgtaacttcattatttattgggaattagtgatttagtcagtgggagttttgtaaaacttaagattttggcttttttccccctcctcctggataaccagttaacccaataatggcttggccgatggaagggtaaaatgaggacagttatattttttaaatgtcattactgtcaccaaatcacacatatcattttctaagataaggaaatacaaccatttttacaagttgcaaaaaagtactctggcttggcaagtttatagactctcattttcttgataaactaaaaaaaaaaaagaaattgctacaagctgctatagacaaaaatgttggtgtctttctgacttttcctgaagacaccttgatggaattatattctcttgattttgtcctttttaaaatgatggttgaaattttaagcctgtcacacactattatttatataatgcctcaaactggcttggatagttttcgtcaactgaattaattttgttaaaaagtgattttagcaattttaggtgccatgtggacatcaccaaatactgtgttagtggaatagcatccaagccatcccaccatctttcctgctgggcaaatccactgctggtgcatttccagtgtgtgcgattatgggttacatgaccaccatttgagaaggtctcctaatgtgctgatcttgttattagctgttatacagtgttttcctttcgtcaaaatgactggagcaaagaggttattctttgaatggttttctcagacagggtatgtgaagccattcactacagtaaaataaaaataataataactcatagaactatgagaattcatcagctatggtctgcttagtcctatgattttgaacaaatcaaaacttctttggaccacaattttcctagctgaaaaattaaacatttggatcatttgatttctcatatcccttttagaatatcagtggcctgtttccttggtgcctttcttttctaccttccctccccatgtgtatctgcccttaaagtagaaagatatgttgacagctattggtgaggaaaatagacaattatgtctcccaactgatattcttctcacagtccaggcaactcctagtagtacaacggaagaaacagctacccagaaggaacagtggtttggcaacagatggcatgagggatatcgccaaacacccagagaagactcccattcgacaacagggacagctggtaatggatggtttaacaagtaaatttggatggaaacttccttttgggttaaacggtagacattgaggacattgaacaaaaggacactggaggaattgtcacgagatgttaggttacttaataaattatgctgcagttcacacagagccaaaccttaaaggctcataacaagtcacctgaacaggaatggatacaagccagttatgaataagaacaggaaacacagagaaaatgcccttgaacatgtctctttcacatcgagttttgggcatcatctagtgagattgtagcagaggccctgataaaatatcgctgtctgttgtataaaggaatctactctataatgtgggtccagactttacaatatgattctgcaaagtctggctgtgagaaagcattttgtcagaactccagtgtttgaagaaatagagccagacattatgtgaaaagtgacacctgtctgatgtcatttggccttttggccatgcctgttcagtaatttgtttttgagtataaaaaaggtatcttctctattcttgaattgtgagattgtggaaattggaatccagtcttatcatcatctctaagtgataccagataacttggctttgcaagctcccatgcaggattcttttgtctgtgtgacataagtattaaaatgtgtcctgccttataaagaatgtgaattccatattctcacttggtatcagtgagaaatattcccatatttctatttgcaacatagaagataatgcatcatgtccttctggggcatggcaagttctaaatgaattcctggcagagcaatggattctgtgattgtctatgtggtgtagttgttgctaagaggatgctattgtaatcttttctacctatacttcttcattggctcagaatgaagcaaggcatgtgctgctttcttatatgtcatttatgccataaatcccattgttagaaggtaatgcttctaacggattccattcatgcttttgagataaatggcattgactttcatattgatcacatggaaagctgttacctgattcctttcctgagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttgccctctatacaaggaagatggtttcattgtcttgtctagagaataaagtcttttttaaaaataaaatcggtgtatccctgaccaagcgtccattaacactttgacaattgctcaaactgcatggtcacagcagcctcagctcataccagccatccaatgcaaggaaggacaacaccaagcccagaggacagttcctggactgatttcttcaacccaatctcacaccccatgggacgaggtcatcaagcaggaagaaggatgggtaatagcctctgagatttttatatattatgttttttgaaatccactgagtgactgctgactatttttctagaaatatgcccttggttttagaccaaactactttcctgaaggacctgaggttcttcaaaaattagttttcttggtaggagtgatactcatattcacctgaatatgaagttctgagctgaaagtaaggaatttagcaggagggttggcaaaagaaaaaacttattgtcaaaatatatctgtgtgaggcagtaagtaatagatatgaaatgaatgttgccaacaataaacgctaaagaaattctgagaacccctccctgcccaccacagcatcacagaaaggtgaattggacttggtttatgaaaaataaaaaaaccctggatagtcagagaaaggaagtgggtggtgggggttggtggggggggcagttttcctaagaaggagactcctgtaaggagaaacgtgaaggaagaaaagccaaggaatgaatatgtcagtgagtggatccatttttcacaagggaagatgtgtttgaatggctaggcaggggccattatgttgagtgactgaagtaccacaggcagacccagcacacatgagtttgcacatggcagctggagctctgaggacacccatgggggaaaaccaagccaggcaaagatcttcagaatcaatattaattctatgtactgatgaagagaaagagattccattaaattaatgaacatgtcaaggacaatacaattggcttcaactacacaatggtatgatgactcttgaaggactctacttataagagggaagatgaacaagagtctagagcccatcatcaagtgggactttttctgggagaatgtccatttgtggttttgattcaggttagcacttgctcttgtttgaaatctgggataacagggtcaccacatttttgtcctacaaagatctttaatattttagtgttgaatatttagtgttgaatcttgaatatttagtgttgaaaggctgcagtgcagacctgggtacccagtattctggtgcttcactgggactgattaaatctcccccagaggcagtgatgtggatagactttgactgaattgacagccagaaatatcgatggggtttatgaattgtttggcctctgtttcactcaagacttcttatttcagcagagtagatctgtgataactgttaaaaacaacatttacaagtatttcagtgaaatttctgcactactcaacattgtacatgttaaattttaaagaccgcttatacttgggtttttgggaagaataattcaatgacgtccactgcttcttatttcttgcccctgtatactttctgtaactccacctaggtggtcttggatgacgattctgtttatttgcatattcactttgtgaagaaaaaaagactaaaggggggaagagggctatttttaaaagtccctttggttggtaagggggaggggataaaatggtgcctgagccagcacactttgtcttttctccatgtgtcagattgcatgtttctataaaaaaggcaatgtttctgtctctctgcaagatttgggtgttccatcatgcactcatgtggagtccttccagactcagcaaaaacaaacacacagcatagctttcatataactcggcccttcaaggaaagccagttacttgttgtggtgctctttgatgaaacaataatctatctcagttcgggagatatagtcagtatgtgctttctttcctcttggccagatgtgaatatttaaaaaaatcagctgtagaccataagccaccttcaggtagtggtttgggaaatcaagcaataacactaatattgattccttcagatatggactccagtcatagtataacgcttcagcctactgcaaatccaaacacaggtttggtggaagatttggacaggacaggacctctttcaatgacaacgcgtaagaataacgatgctcagccactttattgacttgtattcctgcttcatctcttactcgctattggccaagatgcagagctttggtggtggaatggtgctatgtggcttacttcagcccagagtgtgaaactgtcttcattgtctgtatttcttgtggaggtctctcaacctgattttcccttcatttctttgtgccttccagatttaatgactttgtgttttaagaaaaagtaggactctattcaactccattttcattctctaagtagttatgtcagtgaaacacatgcccacttccaggatagtgatttctctatgttttaactgaccatttcctttcaatgtccatctttcctccagccagtgcagaagaggggtaggattgcttgcatggttgtaaaaagacatttttggggccagataatcctagagatcacatcagttctcagaggagaggcaaggcatgttattgacaatcaacaaaggtggcgggatccctggaacaacaacaacaacaaaacattgctagtatctctttctatcactaagaaatgttcaaattctagtagccttaatttctactctatgtgcagggatgtcctagagatcagcctaaagtcgttcataatttctttgaggaatacaaaagaaatctagaattaagaaggtcccattttactgcttgccacacataatgggcagagtccttcatatgagccctttaggcaaaggaaaaaaatcagcaagcatgtattgatggtcagcaatgtaaatagcacagcgttaagcatcaaaggagatgcaaataagcctatgaatggtccttgccaaagaaggacttatatttccattttatgtcactgttggcttttgttctgacattgggtttgggatttagtgactgtctttctcctggttgtaatatttattcggtggtgggcatggcttatgggtgtgctttatgaagtttttgcacctgcaactcaggtcagtacctttcttaaaagaacacaaaagaaataaacttgaaacagtccaagtgattttagatatgggcaatgggtcaacctccagttgatatatgtcactgagggccctgtgtttgcccaggcaagcgtttccttggtgcagtgatgaaaatcccaatgcacaggtgaaattaagaaataacttaataatggagtaaaatggtaactttaatttaatgacctttacaaggtagctaagtatttccttgtataaatttgatctgtgttacttgagtaggctattctagataggcttctttttcttttgtggttacaactagactacaggctatcatagtgttcattttccctgccgtcacatttcttgacacacagttaggtgcttttggttactgataggagcattgggattcaaatattcttttttccatgtctctgtgttctctggttttctggagtgactgggagcaatgctgcaattgagcctggacaatccaggataggcaaagttttggctcagtcttcaccttgccactttacctttgatgattatactgagaaataaagggtcttcagaaccaaataggggcaaaatagaattcttctgtatatttctatcaatcagaggagaattgtgtgcacaaaccttggtcttcctatgcacctatccatctgactctactctagctagattttccttgctagcagataacaggatttgtaccgtagcttcaaattaacactggattcattcctcattgaaacagagcagagtaattctcagagcttctctacatcacatgaaggcttggaagaagataaagaccatccaacaacttctactctgacatcaagcagtaaggattataaaacctagttggcttcagctattgataagaatcaatcaattatgggtacttttgcagtgtctttggtggaggtgcatccattagctgccgttacactgttacttttaatcaaaaggtgcgtctggtggtggttctctgatttttctgttttatatacctcttcgtacattaagtgcaaactacatttcttcatcttaaaagttgggtttctttcactctagagttagtgatttgttttaacaataatggattgcttatatatgatttattttatttatttatttttgttaacttgagatctttctaacttttttatgtgggcgtttaaatttagtgctataaatttccctcttactactgccttagctgtgtcccagagattctgatatgttgtatctttgttcttattagtttcaaagaacttcttgatttctgcattaatttcattatttacccagaagtcattcaggagcaggttatttaatttccatgtaattgtatggttttgagtgagtttcttagtcttgatttcaaatttgattgcgctgtggtccaatagactgtttgctatgatttcagttcttttgcagtgtgatttataattggcgtaaatgtctgattatatcactttacattcctcacaataatattgttttgccttttgtcctctggacctccatggtgctgatgactaaaaagcagtcccttctggaaaagaaaagaataattaaattagtagcctcaggcctttgaaaccatgcatttgctattttaattgcaggcagcaaaattttatctttcaatccaatgatatgtttcctccactacatcaaagatgaatccaattgagaaagaactcaagattatctagtacctcagctgacttcaagatcacagttgtagtgacatagccttacctaataacccaagcagatgttgcaacaaatgccaattctgggtattaagatcaccaaaatctcttctgttgagtgatgtccaagtagtgtctattgcaaaatatttattctgttcaatagtatgacaaacttcactctatttctccctatttatggataacaagtggaaagcttttgcagcaattgtgtgttctggagacaagcacatggtgggtggtgatcttacaaatacgggttcatcactgattccacctccacacagataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggtaatttggcatttattatctagtttgctttctctatatagagaaacaatatatagtttcatattacagaggacattttctgtgtagtctgggattggactagtttgtgatatggaaatatctttcattattggttatcaattctagtgcaaataaacttgggtatattttagataaaagaatgcttccttttgccagtgttttttccatttgtctgtgtttgcatgtgtgtgtgtgtgtgtgtgtgtgtgtgtgttgtgtgtacaagttggctgttatgatggaattgctttctttgtcttatcttgtgatatatgaagttgaaccacatgaaactgatatttttgcaggtgaaagtagtcgaattttagcaattccgtttaattcgactaatatactctacttattttgtaaggttttatcctacaggtgaataatttctatatactagtatctttgctctgaaattattatcttgttttggtaatagattgatcagttttacttttggtgatggataaacctcttctagttctgatgcacacttaaaatgttcatgatttaatctagtattaatgaatagggaccacttctcttattgtaatagtgaagagaggaacgaagataatttattcaatgaagtttgacacggacctagaataagtctttttttttctcaaataagtagtcatctctgcttctgcttttctttgcttctccatttgtattaagaaattaacagtgaagaaaggggaaatggaaaacgcccactgtagtgaagaaataaaaaacagattctgtcttcctagtactagtttttcaattgctttgtaacacaatcactaggcatattcaagattagagactttagatacataattttggagcagagatcttctctcctccccccaaaaaagaaaaagaagaattcatatgtgtgcatatatatataatttttttttttgagacggagtttcactcttgttgcccaggctggagtccaatggtgcgatcttggctcacctcaacctccgcctcctgagttcaagcaattctcctgcctcagcctccatgagaatccaatatgtaaaacagatgacggttgtgatgcagggacagaaaattcagaatgccacatgcttggcctcatttctctgggtggcctacccaagagcttcaagaaaaacagtttaagaaaatgctaacttcagcaatattggcaagacaaagccccttacactccttagttctttattcagcattgttctgctctcatttattaaaaattccaagtaccattgtcagtattcttcagaaaatcttatagtgctgtctcatttctcttggcaaaagaaagcctgttgtgcaacccaatgaatttaattttttttttttaaagagtcttgccctgtcacccacactgtagtacagtggcgcgatctcggctcactgcaacctctgcctcccgggttcaagcgattctcttgcctcagcctcctgagtagctgggattacagatgtgtgccaccacgcccggctaatttttttatttttagtagaaatggggtttcaccatgttggccaggctggtctcgaactcctgacctcaagtgatccaccagcctcagcctcccaaagtgctaggattacagacgtgagccaccacgcccagccatgaatttaaagtttaaatggcaattttaatagtcacagtaccctagaatgcttatagcctaatgttagtaaatcaaatgctttttacaagactgatattcacagacactgattctttctgatttccacagtggtacggacagattttccataattctccatggattagacaattaagtcacccaattctcatccttggttttcttcaaaaacactcacccacataaatctcatttatgtctatacatttttctcagtctttacgcttaatgttaagaactaaagcatttgttgaagcaagcggatcacttgaggtcaggagtctgagaccagcctggccaacatggcgaaacctcgtctctactaaaaatacaaaatattagccaggcatggtggcaggtgcctgtagtctcacctactcaggagactaaggcatgaaaatcacttgaacccaggaattggaggttgcagtgagccgagatcgtgccactgcactccagcctgggcgacagaacgaggctccgtcccccaaaaaagaactgaagcatttagaatcatagtggcagtggtggtggtggtgatggtgatggtgatggtgataatgatggtgatgggatggtgacggtcatggtgattttggtagtgggagtattggtgtggcatttcagcaaatgttgttttcatttgttttaaccatcagccaaggaacaaagcaatctgtctcttcaatatagttacacaggtgactaagtgtcacccgcttccaccttctctaatcaaggaaatggtgacgatcaggttactatagattccttataaggtgccttcataatggataactgtagccattttatgtaagcattgtcctgtgattaaaaaaaaaaaaagattccagtatgcttttgaaaaatgtgggtgggggagagagttttaatatgctgcattcaagatttgacctatggatttagattctagcaattcatgaggttgtcttaatctaaagctttctggtgatagatgtttgagaagctaggattatattaactagtcatgttgaaactacagatttaactttaaaaaattattttaaacttactataatacccatattccaatacacattattaatgttagctatcatctcaccatttccttttttacttattttcaattttttttgaaaataagtagttgacctttctctttgaatctttacatcattcaatcccaagattccttattgcatactaatttcctgccgccaagaaatctctgtttcatgccctaagccagagtatgcccatttgcagtgattatgtttctcataatccaattcatattgtccttatttaaaatgtacaatgtctagtctcaacctcatacctgcaaagatatcacaatatttttgttagcatgttccttaccacagttcttggatttctaccaaaacaaagtttctacaaaacttcctgtggtcatccttcttagcctttgctgccccagtttccttaattcttattaaagttctagctcatttatcagtggattaagcaatgaacggtaattaacattgtggacccattcaaggctgttttgccatcattttttggaataccttaaaaagactaaactttgtgataggctgtataagaatgcaaaggtaaagaaatgcagatgggagtgtaagtgaaaacatgcagtactgaccttcctgattgctcattacaggagaccaagacacattccaccccagtggggggtcccataccactcatggatctgaatcagatggtgagttcaaaactgctttagtcatttactgttataatcattgagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagagctactgctctggaggaaagccttgcatctgaaagcctcaggaagaattcaagcagtgtcccaatttaaccttgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggccaaatggaactgccattattgtaggtcaagaacaggtcaatatcggccaggcacggtggctcacacctgtaatcccagcactttaggaggccgaggcaggtggatcacgaggtcaggagttcgagaccagcctggccaaccctgtctctactaaaaatacaaaaattagccgggcgtggtcctgcgcacctgtaatcccagctactcaggaggctgaggcaggagaattgctcggacctggcaggcagagtttgcagtgagccaagattgcaccactgcactccagcctgggtgacagagcaagactctgtctcaaaaaaaaccaaaaaacaaaaaacaaaaaaacaggttaatatcagcaaattcatagagtttatctagtatgaactcattcagtcatcctataaactctgtgacataggtaagtactattattatccccatgttacagatgaggaaactaaggctcagagaaggtaagtaacttggcagagttgacaggaccagagagtgatggagccacctttcaagcctggagggccttgtattacttctcatagcacagtctggagaaggcattccataatgaccataattactcccaggcatgaattcttaaatagactcctgtttgttgtgattcagatcacacccctacaaaccttaccccagactgcaaaagtctgacatgaggtaggtttactaattacttctactgctgggctactgggaggttctgccagtgctgccttactgtggtctccctgaacatcataaatccaggtgaccccatgtaaatgatttaagccatatcaattattgtctcccctttttatgcccaagtttgagtgaggctcaccatcagatttaaatgtttacacattgaaaacaaatatgaagatggatatttacatggtggcttccacaataactctctatggaggagcactaggaggtagggattcattagaaatgcttctgaaatagagacagaagtcacaggttcactggggactttaggcagggcacttaacctttcccagactcagtttccttgttagtaaaaaggagatcaaatcatctgcctcagttgcttcctagagttattgtgaggaagacagggtaccagaagtgtgaaagtactctgaaaaagtagggagttattattaaggggcatgatctctaaaaccaagagaccccagccactctctaagtatgattctttaaccatcagagtggacatcacctaggaacttgttggaaatgcagaatccttggccaacccagacctactgaatcaggatctgcattttaactacactctcccacccaggtggtttatatgcacattaaagtttggaagcttagactgtgctagactgcttttctcaccattgaagccaattgaacaatctctgtgcatatgtctcagattacatgtcatctcccaacaggaatatcaagtgctcctctttgtggaacttgctactgtggccagtcctaccctggctggatttgtagacatctagggcacaaggcaagacctgctatctcacatccatcttctgtggcttttgcttgaagtgagaatcaagcagacaggagccagtctcttttgtttggcttctgagcaggtgtctattgttcaaacaggaggtttcatcttgctgcacgcacacccagatcttttcttgctgggagcacttcttctttttttttttttttaaatcaaaataaagtgattatgatccgttaatggcctctttttaaatatcaaaggcttctatgagtcagaaaagaaaaaaaaaaaaaagaacagtgagagtgactgtacctcctggggagttttcacggccaaagatcttcagtttaggtggccagtgtcccatgagttgggcaggtgaaaacctgccaaccaccaaggacactggaaggcatgtagggaaagggccttggactgttttggagatttgtaaagtcaaaggccactgtcaacataggataggggatgttgaaacacccagatgtctggtaggaactggttttgctcccttttaagttttaacaaaagcatcaaattgcataaacaagagccatcctgtccccatataaccattgtaatcaagatttcagtgtgcacagcctaaagtttggctccatgaggaaagctctcatttaagaccccaccattttcatccattgatcagccttcaggattctacagtgggcttccatttggtaggaaaaaaaaagttcattttggtggaacactttcaaattttgttttgaagcaatggaggaagaatttttaaaaattcatgaagctttcattttgatgaggctcttcacaagatgtcttagaagtttcttttttaaaaaaattgtttatttatttattatttttatttttaacagggacaggatctccctatgtttcccaggctggtctcaaagtcctggactcaagagatcctcctgtctcagcctcccaaagtgctgggattacaggtgtgagccaccatgcccggcttcttagaagtttcttttagaaccattgtgtctccctcatttcgataggcctccagttctgacttgaggattgtctgtcttgcgatacttcctcccagtttaaggcattttgttcatctccttattttgctttttagcagtagaaaatgttgattcttctaacaaggtgtgtttcagtaatatattagcagggactctaatagggtgatttttcatagtcagaaagggccactgccgctaaactccttatttatttattgtgaggtggagtctcgctctgttgccaagctgtaatgcagaggcacaatctcagctcactgcaacctctgcttcctgggttcaagcaattctcctgcctcagcctcccgagtagctgggactacaggcacatgccactatgcctggctaatttttgtatttttagtagagacggggtttcaccatgttgactaggttgatctcaatctcttgaccttgtgatccgcctgcttcagcctcccaaagtactgggattacaggcgtgagcaaactccttattttatagtgtttatgttggctcctatgatgctattggatgagattttcaggttccctttgggctttctggagcgtgtgagtcccctgggggtcttgttaaaatgaagattctgatttggtagctttgagatgaggcataagattctgcatttctagcgatctccccaggtatgcctgtcctgatggtctgagagccacactttgagtagcaaggtcctaaattaaaaatagaaaataacaaccacacacaactaccaataccgtgtatttcttcaaatctctgcaaaattatgatgaacagcattctgttatccccatcttacgagtgtgaaaagggagacttggagaaggtagattgacccagcacacatggctagttagcaagggacagcggtgagacttaaatccagggttgtccagctctagacaccaaagtcctgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgccctttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcaaactagctgagctcatactcagatctgtccctggcctgtcccagagaagtgccatgttagttactaaagcttccttcctaaatgaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgaggaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctgtcagtctcccccacttctgactctacctccctctccaaactcatctaaaccaggaaaaggtgaggcaaaggtagtgctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaataccatggttaccattttaatatacgtctttttttttttttttttttttgagatggagttttgctttgttgcccaggctggagtgcagtggcgcgacctcggcccactgcaacctctgcttcctgagttcaagcgattctcctgcctcagcctcctgagtagctgagattacagcatgccaccatgcccagctaatttttgtagttttagagatgggatttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacatggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaagacatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggctgatcatcttggcatccctcttggccttggctttgattcttgcagtttgcattgcagtcaacagtcgaagaaggtaaggggctgtcctgggggctttcaacttggaaagggcatcatttaaacctgggctttatatccttgctgctcagagcgtagtccctggaaccagcagcctgggtaccctgggagtttgttggaaatgcacaatctcagacccaaccccagacctcctatggcagagtctgcatcttaacaagtttccagggattcatgtgcatggtgcagcttaagacatctttctctgccccggtttttagagacaggagacacctgtgattgtttggctcatcacttttaggtagtggttgaatcctttgtgattttacatgttttttagggttaaacctcatgcagactctgtctgatgaaagttatgaagtatctcaccaggaaggcacacaaaagtatatactcattcattgatttgttaaatatttattaaatacattcacaatgcacaaatatcgtataaagattcagtgattcatcatcccctgtagcctctctgaggcccagggaacctttaagaacttttaccagaaggaagtattggccttgtgcttttgtttgtcgtttgtttttttattggccttgtgcttttgtttgttgtttggtttttgtaatgatatcattttctattttctgggaactgtagttgaagagattcaggttatagcataagaagagcactgtttcatcgtcttcttgctgttaggaggtctatgaagcagagaagaactttcctttggaaaacaactaaatgaagacagtcacctcgctagaactgacacatgggctgtttttatattcttgaaggccactctctccctacctgaaccaagacctataggtttacatgttatttacattttatatataatatatatatatatatatacacatacattatatatacacaatagtaattctagcaacagaggaaatgacctttaacaggggtataaatctaaatttataaaagtataaatctaaatttcttacccaagacactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagatctagagagaattatggactccttactggtttttggaaagcaaccaacagctaattccaacaccatgggcagcccatacagtctctaattatctgagaaaatcaaatgatgctgttacaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgtgcaatcagccctttattgccaagccctagaatgcaccacttttgctcacatacacagtccataagctttgcacatgtcaccatagaaacgctggcatggatgctgtcgacatttagggagacctcggagaagcatctcagctgtccctaagagcagctggagtccatacattggggctgggtatctcccccatcgtctgtgtcttgtcagcagcagacagcagagaaggggcctcattgctgccctctccctcctcccaagaccagcagtcaccctggcaaccggcaaacagggacacacagggtccggcacagcgagtatctcaccaggaaagtagctgcttggatgccataaattactatgtcctgatttgataattgaaaacagatttgccacgcagctaaaaggtggtgaacagctgtacgggccccttaatgggctctgtgattctaaagctgtcaacccatttctaatccccttcaaaggctgaggcttttctgctttgagtgtcacatttaagagaaagagatacagaatcctattttcatcagagaaagtttggttgaaaatggggcctccaataggtgttcatttattcagcaaacatcttttgagtggctcctgtgactaccagccctggcaaggagaaagagaaggtaaaaaacaaaaagagtaccaccccttttctaaaagaatcttgaggtttagtggcagtattggcctcttgaatttgaattggctaatatttattgagaacattccctgtgccagacactgttatataaattatggttaaaagacaaaagtggaaaatcattagtctctgaagttgacatacaaggatgggtcatgggcttgcatgatgaagtgatctgtgagtcacgttgtcttaaagatgctgggttgggggttctattacttctttaggtttttccacccctgccatcatccaaaacagctttctttgctgttcctcatgtcacctgactccttgagttacagctctccaagagaaatcatattttattcccttttcatgagagcacataattattttaggagtcagttgggttgatagatactgcgtgaggctccagagaagattttcctttaaagaatctatctgggccaggtgcagtggctcactccatgtgcagtggctcactttgggaggccgaggcagtggattagttgagcctaggagttcaagaccagcctgggcaacatggcgaaaccccatctctacaaaaaacacaaaaattagccgggcatagtggcgcatgcctgtggtctcagctgctcgggaggttgaggtagaagaatcgcttgagccccgggaggtggaggcagcagtgagccatgatagtgccactacagcctgggcaacagagtgagaccctgtctcaaacaaacaagcaaacaaacaaacaaacaaaaacctatcttatttgtctaaagaggagaaaaaaacatgagaactttactatgttgcttgtacataaaagctgttcatcagccttcactttaatgggaataatcgtcttttctataaaccccagcaggcagtcacccacactccaatcagtaggtcttctctacgcatcgccataatttagaaatattttccttctcttatgctacagtctagctcctgcaatctgagctcacccaacctcgtcctgctgtctagaacagtgctatgcaatagaactttctgtgatgatggaaatattctatacctccactgtccaatatataactactagccacaactgagcacttgaactatggctagttcaactgaggaagtgaatttttaatttcatttcattgtaattagtttaaattcaaatagccaaatgtggctggtggctaccatattggatggcacagctctaaaacagtgcaaaataaatccctaaatatcgttaaggattgtcaggtagaagagtcatgagatcagttgccaagttacccacctaaatcttttaagataaattctgccatgccataaaagtatgttacctggcttctaaaccccagccagcctgccctctctttcctggtgaggtctcagtctgcctccttccacactgtgtgattgctgtgtgctcagctaatgcctgagatttaagggaagaggagataaaggtaagacacagatccatgaggatctctgatcttcagagtcagaagatccaagctgtggctgggcgcgggggctcacacctgtaatcccagcactttgggaggctgaggcaggcagatcatttgaggtcaggagtttgagaccagcgtggccaacatggagaaaccctacctctactaaaaacacaaaaattagccaggtgtggtggcgggtgcctgtaatcccagctacttgggtggctgaggcaggagaatttcttgaacccaggaggcagaggttgcagtgagccgagatagtgccattgcaccccagcctggttgatgaagtgagactttgtaaaaaacaaaacaaaacaaacaaacaaacaaacaaacaaaaacagaaaatccaagctgtgattcttgcagtgcagtgccataacaagctgtgaaactttggacaatacttcttggacttggtgtccagtttacataatgaagaagctgggctagatgatctctgaagccccttaaggtctagtgctccttcttaaattcttataactaggaataacttaaaaattagaatttgtctcttaaaagcacttattagacgcctagagcactgaatattggaatgagttatttatgagaatcatcctaccctcctgaaactactcagacagatagaaacacataaatccaaagggaaatgcaggccaaccaaaaaccaagcacaatattcctgtgtcctataggtcaaatgttatccactgtcaagatcagcttcgtttagattaacaacattaatccccacccactcccatgcacagacatattttttatgctcataaatcactttcccacaatatttcattccatccctcaaccacccattggttagggaaatgggaattactttaactagacaactttcctccaaagaacacaggggccagggaattggaagtaacacaagcagtattctaccttgagccttttaaatcctcttcatagtaaataataacgaggtaggtggaggcagccaggagaaacaagcaaaattcatttcatatggcttttgttatattaacaattatagatagcacttgaaagcttactgtgctccagatactgttctaagtgttaacccaaaccttagtttccttaccccgcataagagcaagaataacaattatttccttacccctcataagagcaagaataataacaatagactcatttatttagtgacagtctctgtttcaagggcttttcacaatcctatgatattgctactcttagtaacctggtattattgatgcaaaactgaggctcagagaggttaagtgagttgccccaggtcacatagcagtaagttctcaaaaccaggccttccgagccccttttcttctttcttttttccttttttttttttttttttttttgagacggagtcttactgtgtcacccaggctggagtgcggtgatgcaatctcagcttactgcaacctccacctcccaggttcaagcaattctcctgcttcagtctcctgagtagttgggattcagccacgcaccaccatgcccccatgaccggctaatttttgtatttttggtagagatggggtttcaccatgttggccagctggtctcgaactcctgacctcaagtgatccttctgcctcagcctcccaagtgttgggattacaggcatgagccattgtgcctggtctctttttcttttttgaaacagggtctcactctgtcacccaggctggaatgcagtggcacaaacacagctcactgcagcctcgacttcctgggctcaagtaattctcccacctcagcccccaaagtaactaagactacaggcacatgccaccacagccggcttatctttgtattttgaatacagactgggttttaccatgttgcccaggctggtcacaatctcctgggctcaagtgatccacccgccttggcctcccaaagtgctgggattacaggagtgaaccactgcacctggcctccaaggcccttttcttgaccatgcatcctgctggactccatctgtattcctggtccccatgaatctgtttcacagttcaagcatccttcccccaacccctcatcaagccttatgctagaggagacaggatctacctcctgttgaggaggtataatttttatttccccaaacaagagcttaaagtttatggccttggcagtcctacagggaatggtccatgatcatgaataatagaggctttgtcactattactccaaatatccagaggcaaagtgaacaattctgacttcatactgtttccaaatctccagagggctggcagcattgacagagccaggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatagaaagagaatcagaacttgagagtcagacagaccagggtttgaatcctctttcttacttgctgagttacttgggggaagttactgaattttctgatccccaaggtttcttcacttggaatatagagaatataataataacaccggcttcctggagtcttagttgctggtttgcaaacttgactgtgcagagaagcccctgaggggttgcaaatttgactgtgcagagaagccacagatcctgggctccaactctagagttttctgattcagcaggtttggggtggggctgagaatttgtatttctaacaggttccaagatgatgcttttgctgctggtccagggacctcactttgaggagtgctggttgttatgagtctggttgttaagtgctggttgttagttgttaaagtagagaaaacccctagcacagtgcttggcacacactaaagccatcataaaccatagtgatcatcaatgatggtgctcagtaaggatgatgatctgatgcctgagtcactgcaatctttctgatatggtacattttttaaattattaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaat

SEQ ID NO: 11840 - DNA, 44377 bp, Human
tgaaattccttgctcgtctttagaaagctgtgttgcttagagcacccaaaagtgccctttatctaactgagggaggcgcacttgtcttcatatatagaggcaggagctggcattgggaaagtcaaactagttctgcaccatgaggaagaagcagctgaagacggaggcagctccacactgtgaactaagtaagtagcccagggaagctgcccagctgagcagacctgaaagggtgacaagtacagctctagcaattttattttctagttataatagaagttgccaaaggaaaggttccgatctggaggaacttcatcaaacctttctgaaactccacagatgtactgtagcgagaatctcagaactaatttgtgcattttcttttttctccaggagaaattctgtatgaaaaccaacctgctccaggaagccaagcccccccgccttttttttggtccccgagtttgtttttacttcgcactttatttggatttttctctttgcagttcacgctcctttcctcatttcttggtctctcttactaatgaaattttctcctagctgtttttacgtgaataaagaagctcaattacctttaatgctgtaagcagtgcgaggggtcggggagtgagggtggcgggaggatctaatgtttttggtggctgtaaacgacattgcagaaaattacggtaatttgttaggccatttattccctcttcaccagtttggcagtctcatcttcagagcaaaagatacggtgtgaggctgaaactggcgatagagtgggattgcttttgggtaggtaggatgaagtctggggagaatcgagtcagctgggcgaggaggaaaacaattcactacggaggcttgggaggacacctaaggcggtcaaactggctgcactagctgatgtttctcggttcctcccaggtgtggggtgctcttggtggggcagcagatactatgatgtggctctgggggcgcgaggaaatgttccttccaggtggctatcctttttttttgagacagggttttgctctgccacccaggctggagtgcagtggcacgatcttgtctcaccgcagcctccacctcccaggcccaagtgattctcccacctcagcccccgagtagctgggaccacaggcgggcgccgtgatgcctggctaattttttttttttttagacggagttttcgctcttgtttccaaggctggagtgcaatggcgcgatctcggctcaccgcacctccgcctcccgggttcaagcgattctcttgcctcagcctcccgagtagctgggattacaggcatgcgccaccacgcccggctaattttgtatttttagtaaagacggggtttctccatgttggtcaggctggtctcaaactcccgatctcaggtgattcgcccgcctgggccctccaaagtgctgggagtacaggcgtgagccaccgcgcccggcctttgcttggctaattttaaaattttttgtagagaccgggtctcactatgttgcccaggctggtatcgaactcctggactcaagtgatcctcccgcctcggtctcccaaagtgctgggcattacaagtgtgagcctccgcgcctggcctggctaccctttacaggatagagctatacctcgtagcttgattgtcagtacctaacgtggcgccacggcgaactagggcaggaatcttatctgtccccagactgctagcggactggagctccccagtccaggggctgtgtgggtctggccaacgcaagcagcaactaggcagcatgcagctcccgccgggtgccccaggggccgccgcgtgccccaggggccgccgcatccagactccgcgtgggcggagcctaggtccctggtctgcgggccacgcatcccggccgctgcagggactccagccaatagggatgtgcggctgccgtcctgtcgaccaatcgcggggaggggagggcgttagccagcttggcgctggctcccggaatatggagccctgggcgcgggggcggcgtgtcaggtggttgcggagctggtaaggtgaggggaaggcaaggtcaggggtcacggcattccgctcgctggcagggaggggcgcggggcggctcgagggcctgtgtcgggggtcaggctccggggctaggatgcgacaccggctcgccgtgcggggctgtgaggggaggtgtggccagggagggcctcaggcccagagtccaggactgatggagtcgcgccattcagagaaagacccaaagatgggggcagggagggaacgccggaggtcgcgggggtctcgccccttccccgccgcggcctaggacacatggcccagctcccagctgcaccggatggcgcgcccggcctgtgtcggggtgcgctgacctgcttcgacgcctcgaaagaggccgacgggcacagggcaaggtctttcgtggcctcttcgtcggcgccgcagggggccgggctgctctccggggcctcccgccgccccgcttcaacaaaagactcattataacctaaccgacttcagggagcgccttctgtgtgaatagcctgcatacgcggctcagtaattgtgggtagattggttttaaggctgtttgtgtagctctcagggaccctctggattccaggctccaatgagcagggtttttctacagggggatattgcacatatgtaagtgggctggatggctctcccagctgtgcgtttcatgtgtccccacttttaaagctaccgcttaaatgtgatatctcttgcaaaagcaaaaattatatggaaggagagtttgcaaggggagataggcttctaaaaacttgctggcctcaattttagtgactgttggtgaaaaatggagaagctatgtttacattgacttctggaacccgaagccccaccagttcgcatgatttcttggctttgtaaatctttgagcatgttgtttgcctctttcttcttttgttccacgtacttaaaatggggattgataatatcagtcttacagggttgttggtatgaaattagttaataaacaacaaagtacttagaactcttgatgtggaggagtttttgttgttgttaccttctttccccttaacacttctaaagaattctaaccttattacttattctttgctcagagtctcatgacttatcaccagtgaacccgccggcctatactttccattgacatcattaactttgatctgagggtatagtgtagttatatgtgactagaggatttctgctgcgtgtttgttttattaaatacggttggaaactatcattatactaggtcatttattgtgatacctgtgttgggtaaatgaaacctgaaaccttcggctgtttattttttcattggacagtatttcattgacagtcttgcttggcctactcagtttattttggagccagtactaaaaaggccatgattgcagcatacttggtttctcatgtttccggaatggcagtgggactcgggaggggaatttctgggtagcctggcagcacttcttgttaaggaatggggaagcttcttatgaatctaatcttactctaatgttaggaaatcagcagtggtcccttggattactctacaaagctagtaggcagctttggttcagttatgactcagtgaaggttagagaattatatctacaaagtaggatctttttctttctttctttcgttttttgatacggagtttcgctcttgttgcccaggctggaatgtaatagcgcgatctcggctcactgcaacctctgcctcccgggttcaagcgattctcctgcctcagcctcttgatgcctggcgaattttttttgtatttttagtagtgacggggtttcaccatgttggccaggctggtctggaactcctgacctcaagtgatccacctgtatcggccttccgaagtgctggggtggtgtgagccaccgcgccctgccagatctttcttgtttgactttcattgctaagaatttgggtgagtgttgttgaatcaaagacatctttattctctgcctcctcaccatgcacatacgtacaaatgtctgctgacagatatctgcccttcctatggccttaaaaagccttctcatattctcgtggtgctatctgggatacaccagtggaagactgctttgtcttctaattcttcccttcaaagaagcggctatttatacacatagcattattaggaactagtcagaaaatgagaaactttaagtttatgaaaaaaaacattgcttacttcagctgcatgctggccaaatttagttgaagtgcagttggtataagtttagttgtttagttttggaataagagagttcaagacttcccctcccaccccccacaagacaaggtctggctctgtaacccaggttggagtgcagtggcatgatcacagctcactgcagggttgacctcccaggctcaagtgattctcctgccacagcctccctagtagctgggagtacaagtgcatgccaccacccctaatttttaaaaatttttttgtggagatggagtcttactaggttgcccaggttgtcttgagcccctgggtgccagccaccgtgcccaaccagtttaatacttctttaggatttaaagttggaagttggcctggtaagagtgaaggacaatgtctttgtaatctgtttttccctgagaggcatgggaatgacacctttaaagaactgagtgtgtttgaggcagaaagggaagtctgctgccctaatattgtcattattatcatctctctgaggctctgtagtttgagtaaaacattctgggaaaaaaggtaggggcatttgaatgagcggaatataatgaattagaagatgcagaccatgtctcacttactggctgccatttattctttatttttatatttttgagacagggtctcgctctcttgcccaggctggagtgcagtggttcagtcttggttcactgcaacctccacattccaggcttaagcgatcctcccactagagcctcctgagttgctgggactacaggcttgcgccaccatgctcagctaatttttaatttttttgtagagttgagttctcactatattgcccaggctggtcttgaactcctaggttcaagcaatcttcctgccttggcctcccaaagtgctgggattacaggcatgagccactgcgcccagccttgccatttattctttttataatttaacaaatatttatggagcaatttacattaattggccccttgagacacaaagaagagccttcaaggcatcatcaggaatattctagatacaataaaatgacatgtatataataaggtatattttaatgaaatcataatggaatataaaacaattggccagcaatgatcaaaatggcctaacttctcttccacttttaatttcaggttaaagtaatttatattttttggcataaggaacaaattagggtttttagtcttgttttggtgcttattgccgataagtcattttgtgtcaggtttgtgtttgttttggtctcatctctactaagctgatagctgttaaaactcctaggaaatgaaagaagaaagctacaagttaattattaaaactttaccaggtttcaaagagcagaaagaggcttgttaaaggctggagaatcttgtagtatatattgtcttaatttttctttgcttttaggaaaagaaacttggaggacaatatttacttaaagttgttaaggtcaatctacatcatttgggagccaatatccatcattaggaaaaatgggttgaatgtaatctaatgaaaattcttcatatttgccagagaaaagctacttaagtgtgaggacaaaacatattttctgaggcaagaagtaggtataggctggtttaataggggatttttttttttttttttggaaaaaagtaatttttttttttttttaatggagactgggtttcttgctatgttgcccaggctggtctcaagcttttgggctcacgcaatcctcccgcctcagcctcccaaagtgctaagggattacagatgtgagccaccatggccagtctaatagggaattttcttattccaatagaaaggggtctttgaaattgttcacagagcttggcattgtgttccatgatagaggtgtcagatcaggaggccaggtttgtcccccaaaaggaaacacactgctgtaaacttctggttaggaggaagtttagaggaagctcacacagagttgggaagaacaaagacgaagctatagtcactggaagtaagactttagtgaccctgacttgtgagcattcagggagatttggaagctggttaagcctcaagagtgctgatgggagaaggtgaagagttgtatttaatgggtaccagccccttctaattctgatgtctctggttgatgtgtgatatttttgtttaaaagataagtactccttgacagcctggccacatttctcccaactgttatcgtttttgacacccaggcagctggtttcattatcagctgtactcttcctccttacatcttcctcccccctcctcttcttgcttcctaacattttctccactttctctttttcttttttctttatcttaagatggtctcaatgtcaggtttttcattcaactacaaaacacttaaaagtccagctcaggtgagaaacagcaaacttggtgttgagttgaagttgtggttgtctttttttttttttgagacagggtctcactatgtcacccaggctggagagcagtggtgtgatctcagctcaccgcaacctctgcctcccaggctcaagcgattctcctgcctcagcctcccaagtagctgggattacaggcacgtgccactactgcctggctaattattgtatttttagtagagatggggttttgccatgttggcaaggctggtcttgaactcctgacctcaaatgatccacctgcctctgcctcccaaagtgctggcattatgggtgtgagccaccgcgcctggcccgaaattgtggttttgtaagttaaataggatgtctccaattttgagattattactagggcatgcaaagtatggtttggtatctgtaggggattggttccaggacctcactcacatgcataccaaaatcctgggatgatgcttaagtccctataaaatggtgtagtatttgcatttaacttatgtacatcgtcccatgtacttaaaatcacctctagattagttatatcaattataatccccctctttttcttctagacagggtctcgctttgtcatccagcctggagcgtagtggtgcaatcatggttcgctgcagctttgacttcctgggctcaagggatcctcccaccttagcctcctgagtagttgggactacaggagtgtggccatcacacatggctaattcttaaattttttgtagagacaatgtctcactatgtcgcccaggctggtctcaaatttctgggctgcctcagcctcccaaagtgctgggattacaggtgtgagcaactgcactgggtctataatacttaatacaatgtaattgctatgtaaataattgttctgtattgtttagggaataataccaagaaaaaaatggtgtatatgttcagtacaggcacaagcaaccgttttttcccccaaatctttttgatctgcagttgtttgaaaccacaaatgtggaacccagggttacagaggcctgactgtatctcagtggccattatgccagagagagagagagagactggttcatgttaagcgcattgtataatagcagctctgtttgtactttataaactgagtgtgtttgtgtggcttttggttgaagacattctaatattacccacttgagtagaggggattagagttttgaggcctttttctaaaatgaatacttaccacaggggcttttcactgtttaccatgaagtacacataatcagtcttcaacctgactttttttttctgtgtatcattttatatcaaattcattttaataagaggaaaacaggataaacttactccagtgtaaaaaataatacctcacttgagcccaggagtttgagaccagcctgagtaacatagcaagaccccacctttacaaaaaaaaaaaaaagccagctgtggtggtacgtgcctgtagtctcagctacttgggaacttgggaggctgaggtgggaggatcacttgagcctgggattgtgcaactgcactgtagcctgggaggctagaaatatgtaaataattgttctgtaagaccctgtctcaaaaaataaaataaaaaacaataccagactttataccttcaagaacaatttggaaattcacatgtctattctaagctgtttctttccccacacctcgaatgggagcagattgagttttagaactaattgggctgggcatggtagctcatacctgtaatcccagcactttggaaggctgaggtggatggatcctttgaccccaggagttcaagaccagcctgggcaacatggtgaaaccatgtctctacaacaaatacaaaaattggcagggcatggcacacgcctctagtcccagctacttgggaggctgaggcgggaggatcacttgagcccaggaggttgaagctacagtgagctgagaccacgccactgcactccagcctgggtgacagagcaagacactatctcaaaaaaaaaaaaaaaaaaaaagttggatggatatttttgatagactcagaaaatgctgcttcttcatgacctagaatggaaaaatagagggagagtaataatctcttattttaaaaaagtgattaataaccttcctcattaaaatacatagggttcagaaaataattagctctgtttgagctgctagaatatttcagaaagttttgttgactgtcagtcatccaaatggcaggagcccaccttcatgaagagcacctggtacaacaaggtgttgtgttaataatacagtaatggtttagtagaactgtcaagtactttggccttgaagtagaccattagggaaaagagaattttagaagaatctagaaaccttttcattttctttaggacaaatataatttttttaaaaaatgagaattctttgttattctctaataaacactttgggtgtcgctaagccttgatctgtgcacctagcagtttctcttttgtcactagcatgtctctggcactgaacagtgcctgaggaagaatgaactgaacagtgtcaagaggaagaggtggctttgccatgtagcttgaacgcattcttgctagcatttatttcatcagttacttccatgaagacacctttctggctgcttctatgaaagttttttcctatttaatgttgtctttgattttattgagatgaggaaggtgatgaaaaaaaaggaggaaagaattaagggactgtatttaaaaacattcctctctaaacctacaattaattttagggagaccttttcagctgtaagactagtgaaatggttttgagtacctttattctctataggggaattttatatgaaaacgaattatttcaaacccaaactatttatttatttatttatttgtttatgacagacagggtcttgctctgtagcccaggctggggtgccctgatcatggctcactgcagccacaacctcccaggctcaagcagtctgcccacctcagtctcccaagtagcacgcactaccacacccagctaatttttgtatattttttgtagggatggggttttgccctgttgcccaggctggcattgaactctgctcgcctcggccttccaaaatgctaggattacaggcttgagccaccgcactcggcccaaacttttgttttaaccgtagattaaaaaaaaaaaagttgaagttgtatatattaatactcagtatttcaaactttcttaggggcagttttctgttttgtgttttttgttttttttttgagatggggtcttgcttggttgcccaggctggagtgcagtggcatgatctcggctcactgcaacctccacttcccaggttcaagcgtttctcctgcctcagcctcccaatagctgggattacaggcacccacaaccacgcccggctaatttttgtatttttagtagagacggggttttgtcatgttggccaggctggtctcgacctcctgacctcaagtgatccacccaccttggcttcccaaagtgctgggattacaggtgtgaaccaccccacccagccaggggcagtttttaaaacaggtttgggctatccaaattgttcttccagagttcttataaatgctaagagaatatacagaattactgttaattagatgttagaatttattatagctagtatgtgttttggggggtaacttaattttcatataatttcaaacttgcagaaaagttgtaagagtagtaccagggaatggacaattttcaagaaaatgacagtggtaagcagtgggtgccttgagggaacacggagaagccacttaagccaaattagggagtcaggaatgctttcctgagaggggatttttaatattttacatttaggtggcactaagacaaactagtagtaagttaggctgaaggcaataaatacctgccaattagacagctgtagacttctgattatctattgcagaagctttatcagagagttcaactgaacatccctaaaatgtttgttgagaagctgagtgaatctatatgaccttgacattttttataaggcaaataatacatgtatctggtaaaacttctttttatgtgcaaaaggtatacagtgtatattcagtgagaggttttcccttcacatgacctcatttgggctctcctactccttccttctctcagggatggcctttattaccagtttttggtgtgtcctttggagattgtacgtgtacgtgtgtgttttctcttttttctttttgctacatacatgatagcatgctgctcaacaaattggtcttttgacttgacaacatgtaatattttagagattgtatcctatctatacatgatagatcgtcttatttatagtggttgcatggtattctgtccaatgaatgtgcacagtttattcaaccagtcctctactaatatcaaggttgtttacagtcttttcatactacaaacaatgctgtgggaaatatccttgtacatatttccttgatgagtactttttgctttttttttttaaagaatacatttttaggagtaaaattgctagatcaaagaatatgtagacttttgaaattttagacagaaaataaaattttgttagcatttttatcttgtaaaacagtcttacaacactttttttttgagacagggtcttgctttgtcacccaggctggaatgcagtggcctgatcaacactcactgcagccttgacctcccagactcaggtgatcctcccaccttagcctcccgggactacagacgcccaccaccacacccaactaattttttttttttttttttttttttgagacagagttttgctcttgtcacccaggctggagtgcagtggcgcgatctcggcttattgcaacctccgcctcccaggttcaagcaattctcctgcctcagcctccccagtagctgggattacaggtgttcaccaccacacccggctaacttttttttttttttttgagatggagtctccccctgccacccaggctggagtgcaatggtgcgatctcaacccactgcaacctctgcctctcaggttccagtgaatctcctgcctcagcctcctgagtagctgggattacaggcatgcgccactacactggctaattttttgtatctttagtaaagatggggtctcaccatgttggccaggctggtctcaagctctcgacctcacgatctgcccgcctcagcctcccaaagtgctgggattacaggcgtgagccactgcacctagctttaatttttgtattattagtagagatggggtttcaccatattggccaggctggtctcgaactcctgacctcaggtgatctacctgcctcagcctccgaaagtgctgggattacaggtgtgagccaccgtgtccggcctccacctagctaatttttgtatattttgtagagatggggtttctctatgttgcccaggctggtcttgaactcctgggcttaagcaatctgcctgccttggcctcccgaagtgttaggattacaggcatgagccactacagccagccagttttacaacttttgttagagaatgggataaaataggctgggcatggtaggctcacgcctgtaatcccagcactttggggaggctgaggtgggcagatcacaaggtcaggagatcgagaccatcctggccaacacggtgaaaccccgtctttactaaaatacaaaaattagccgggcatggctgcatgcgcctgtaatcccagctactagggaggctgaggcaggagaatgggataacatagtcatattacatttaaccatgagtgccattttttttctgtcaattgctgttcgataggaagaaacttaatgggtttaagagaaggtgacactttatggttaggggtaagctggaatatcaaagcaatgttaatcataattgtgatggttacttatcaaagtattgctgggttgattctagttgtttgtgtcctaactctggatcttttccttaatgtgacgaagtaactgaaacaacctggtgctacagccctggagagcaaaactgtcttaatattaacttactgcttccatatgggtcataaattttcatggagacttgaatgctgtgcataactggcctggccctttctattcctccctagttttttttttttttaactatttaattatttattttttataagatggagtcttgctctgttgcccaggctggagtgcagtggcgcaatctcagctcactgcaacctccacctcccaggtttaagcgattctcccgcctcagcctcctgagtagctgggattacaggcatgcaccatgatgcctggctaattttgtatttttagtagaggcggggtttctccatgttggtcaggcttgtcttgaactcccgacctcaggtgatccgcctgcctcagcctcccaaagtgctgggattacaggtgtgagccactgcgcccggcccctccctagttttattaattttttttttttaatgagacggagtcttgctctgttgcccaggctggagtgcagtggtgcaatattggctcaccgcaacctccacctcccgggttcaagcgattctcccgctttagcgttccgagtagctgggattacaggcatgcgccaccacgctggctaacttttgtatttttagtagagatggggtttcaccatgttggccaggctggtctcgaactcctgacctcaggtgatctgcctgcctcagcctcccgaagtgatgagattacaggcgtgagccaccacgcctgacctcttttattttattttattttattttgagacagagttttactctgtcgcccaggctggagttcagtggcatgatctcggctcactgcaacctctacctcctgggttcaaacgattctcctgcttctgccaccctagtagttggaattacaggcacctaccaccacgcctggctaatgtttgtatttttagtagagacggggtttcacccatgttggccaggctggtattgaatttctgacctcaggtgatccgcccacttcagcctcccaaagtggtgggattagagacgtgagccaccgcctccggccccaagttttattctgtaggcactgtaatgaaacatgtagtttgttgactaaaagctttgttgaaaaggctggagactggaatctagaatttgttttctttcttgaaataattcattcttgagatttcagatagaagacgaaactttttgtatttgaacggctctgtatgtacttggtataggaatgaacttagaatatcactaataattatttaaaattttatcatgaaatatttctgtctaaaaatatttgcagactacagtcctgggaagatcacgctattaccttaattgtttgcttttaaaatataacttaaaagcctattttggtgcttgcttcggcagcacgtatactaaattggaacaatcaagagaagattagcatggcctctctgcacaaggatgacacgcaaatttgtgaagtgttccatattaaaagaaaaatttttgtccaggggcagtggctcatgcctgtaatcccagcactttgggaggccgtggtgggtggatcacctgaggtcaggagtttcagaccagcctggccaacatggcaaaaccccatctctactaaaaatagaaaaattagctgggtgtggtggcacgtgcctgtaatcccagctactcgggaggctgaggtaggagaatcgcttgaacccgggaggcggaggttgcagtgagccaagatcgcaccactacactccagcctgagtgacggagtgagactccatctcaaaaaaaaataaaaacttttaaggcctgttttgcctattctggataaaaatcttcctcagatgtagacgagacatttctgtgtcttctttttcttcttttttagacaaggcctcgctgtgtcacccaggctggagtgcagtggtgcgatcatggctcaccgcagccttgaccccagggctcaagcagttctcctagttcagtctcccaagtagctggcaccacagacatgcactaccacgcccaggtgattttccagtgccttaaacagtgcccagctgattttccagtgccttaatgatattaatcatcattacaaaagtgatttacagcctggccaacatgatgaaaccctgtctgtactgaaaaaaaaaaatacaaaaattagccgggctcggtggtgggcgcctgtaatcctagctacttcggaggctgaggcaggagaatcacttgaacctaggaagcagaggttgtagcgagctgagatcatgccattgcactccagcctaggtgacaagagtgaaactctgtctcaaaaaaaaaaaaaaaaaagcaatttaattcattcagctcattttgatcagggccacaattggaaacttgagttattatacttgcagtaatattctcagaactgattgacgcataaggaaggactgtttgcctcatatcaaatagcccaagactaattgatgtacttgagttttttgattcctcagtgtgccaagttcctcttttcctggaagagctatgcatagttccagatctgatttgtggtttccaatttattgtgggttaagacaatctgataacattagtttgttacaattatatgtaaaacaaaagtaaaaaggctttgccgggaacgtcggggctgtgctgtgattggaatccaagtgagtactgctactctgagtggtcaaatatttaaatcccatttaggtgaggtgctattgtcattgactgaaagaggggttgaatttagtcagtattattgggggctgttggctgatgtttagtcatctggtggcttaaaacctgacaggagacacatggctagttgtccgttgtaatataatacttggcattggtgactctagagaggaaggattatgttttccaaattagcaggtggtggtatatatgccccagaagacagatgaaacctaaaaagaaaagaaaagctcctttctggtctgaattctgtaattctataagtacagaatatgttggtagatagaaagattacccaaaacctgaaacagcaagtagaagattgttcatgtaggaacaacatataagggacaagggtggaaaaaagactagatttaagcagtaaaagatcattaagcgaggcttcatcacttcttcagtaggacagttattattgggattcaaagaggggcttatcaatgaatactatgttgtccttccccttctaaatttgaaatcaactgagaagtagataagaagattgaaacatttttttttttaatagccttattggtaaggctcaatggagaatatgccatagatctgttcccaagtgagcttgctaaaatcctccctcccaattaaacttaacaggatgatggacatctggaacttccaccccacccctgactccacccgccccactgcgggttgcttagtacaggacctgtagacaaaggctggcatcccacacgctatgcttaatcctgctggtgcttcagctctcttggagagcttgggaggggctgggccacgggtgactagtttcttctagttgtcagagggttgaggaatgaggtctagaacattatggctgcagactttactttcttaggaagatttgaggctgccaaatagtggccttccactaccagtatgcttgtatggtgctttttcctaccctttctagaagattgaaccatgagcttaaattacatattttagaccaaagagaattacagatttctgtccttaaaaactcataaaataggctgggtgtggtggctcatgcctgtaatcccagcactttgggaagtggggtgggcggatcatgaggtcaggactttgagaccagcgtggccaacatggtcaaaccgtgtctctactaaaaatacaaaaattagccaggcatggtggcacacgcctgtaatctcagctattctggaggctgaggcaggggaatcgcttgaacccaggaggcagaggttgcagcgagctgagattgtgccactgcactccagcctggacaacagagtgagactccgtctaaaaaaactaaaaaaaaaaaaaaaaaaaacaactcataaaatagggggaaatgtgtctggctttagacacttgggataatttggaggcaaaggcagagaatggatacttgcctagcagcctctgtgtagatgcttattaaaaaagtatttgcctggccaggtgcgttggctcatgcctataatcccagcactatgggaggctgaggcgggcggatcacgaggtcagcagatcgagaccatcctggctaacacggtgaaaccctgtctctactaaaaatacaaaaaattggctgggcgtggtggcgggcacctgtaatcccagctactcgggaggctgaggcaggagaatcacttgaacccaggaggcagaggttgcagtgagctgagattgcaccactgcactccagcctgggcgacagagcaagactccgactcaaagactcaaaaaaaaaaaaaaatggtatttgctgtctcactaaaatacctcctgttcaatttgtccaccaccccctgccatccgtgaagggtttcacagtgaaagccagaaagcctgctagacacattctaaaagagctgtaacacttcaatttggttttgaagtcttgccagcaaaatcttgactaagacttttctttttttgttaaatatctgtcagtcatattctgaaaactgtaattattttcaaggttacctaattcagtagaaaaattactcttttcatagtaaggattcagtcatacagagtaacaaactgctggttctgaacttgttagtttgttcttcctaattcttctccctcacttttctcctttccagaatcatattctaagaactcagccactcaggtatccaccatggtgctgggtcctgaacagaagatgtcagatggtaatttaccgctttgtgttattgtctaattttatttgtaattaggtttatgttggtaacagaaatttatcatatttttcctcttgtcatcatctgtcatcatctattctaacaactccattcaaaagtcaccatctggtgacttaggctgtaaatgaaaatggattttttttttttttttgaggtggagtctctgtcacccaggttggagtgcagtggcacaatctcggctcactgcaacctccgcctcatgggttcaagtgatgctcctgcttcagcctcccgagtagctgtgactaaaggcacacgccacaatgcccggctaatttttgtatttttggtagagacagggtttcgccatgttggccaggctgttcgcaaatgcctgacctcaagtgatccgcccgtctcagcctcccaaagtgctgggattacaagcatgagctaccgcgcccatcctgaaaacagaatgttttttttttgtttgtttgtttggttttttttttgaggcggagttttgctctagttgcccaggctagttagtgttcagtggcactgtgtcggctcactgcaacctccgcctccccggttcaatggattctcctgcctcagcatcacgagcacctgggattacaggcacctgccgccacgcccggctaatgtttttgtatttttagtagagatggggttttgctatgttggtcagggtggtcttgaactcctgacctcaggtggtccacccgtctcggcctcccaaaatgctgggattacaggcatgagccactgtgcccggccctgaaaacagatttttaaccagagacctgcttcatatcttttttacaattctgagttgagccaagattagctgaaatttggtttctggcagtaatgcttgcaagggcaatgttattcccagacccaggataaaaacctctggagtgttttggctactcatgatgcttcctggtgtttcagatgtgtatggagcagtaaaatacagggcgagtaccttacgctctgtatttgattggagcttcttgagtgctttgactattccttcctaaatctgagcttctttggaatttctgttccttttctataaatttcttcattaattcaaagctgcttaattaagatgatatgagtcagctccctatggaaagaaagctcttatttgtttaaattagaggttgtaaggatttattgcaaacacagagattagagctttgtgattcaaaatagccatttgatggctgaagcaaactaggctctgtgtatttctggcagggtatcccttttctcccagaccttctgcttcccaatatttaagattgactgcaaaatgcagaactcagggaaacgctgatatcagtctgagatgagccctgctatcacgagggtgccagtaccccgtgaccggcggcactttactgcaagccttagtcagagtacaaagggttcctgcttggtggttttgctgcagcttcagagtttagcctgaactgtggcaggattttgtaacttgcacattttttgagaagtctgatggaggtataatgtccacggtcgattctttgagtaagtcctaccaaatataggaggtggggaggacatttcgctagacaggcctagttcttttcttttaaaagctaggattttaggttaccaggagctggtctgggaatatgatattttgagcccatatgtcagtgtttttagaggaaaatgaaatggctctaaaaattcccaagtaggagtagaagtgtggaagtaggaaaaccattgtgagttaaaactgatctagagaattgagtgactgggggagggggagggagataacttttttagtgtaggctaaattttttacttcctgaatttttaaccatgtgaatgtattacttattctaaaatgtacattaaaaataaactattcaaaataaattgagctagagtcaggttggtctcttgtgcatttagatattaaactatttaatttcagtatactaaggatgaattgttagtgtattttgttcattttttactaatttattttcaaatctgttaattcagacagtgtttctggagatcatggggagtctgccagtcttggtaacatcaaccctgcctatagtaatccctctctttcacagtcccctggggactcagaggagtacttcgccacttactttaatgagaagatctccattcctgaggaggaggttagtatcaggtccttggaggagaacactattgtctggggaaaacctgtgagtgaaagatctgctggatggctcaagttcagcagcctcaggtttaattttggctggcaatctctgaagactatatctatatatctatatatatatacacacacacacacacacacacacaccccatctatatctatctatctctgtctgtctgtctgtctgtccgtctatctatctatctatctatctatctatctgtctatctaatcttttttacagacagggtcttgctctgtcatctaggctccagtgcagtggcacaaccatagcccactgtagccttgaattcctggggtcaagtgattctcccacttcagcctccccagtagctgggactatagatggcatgccaccatgccaggctcattatttttatttttatttttagagacagggtctcactatgttgcccaggctggtcttgaactcctggcctcaagctatccttcctcttgtttgttgatgaaaaagagtcaaactctggctgagcccaggctcacacctgtaatcccagcactttgggaggctaaggcaggaggatcacttgagcccaggagtttaagacccgcctggccaatatggcgaaaccctgtctctacaaaaaatacaaaaattagctgggcatggtggtatgcacctgtagtcccagctactcgggaggctgaggtggaaggatcacttgagcctaggaggcagaagttgcagtgagccaagatcatgccatggtactccactctgggtaacagaatgagacctcctctcaaaaacgaaaaccaaaacaaaacaggccgggcgtggtggctcacacctgtaatcccagcactttgggaggccgagatgggcagatcacctgaggttaggagttcaagaccagcttggttaacatggtgaaaccctgtctttactaaagatacaaaagttagctgggcgtagtggtgggtgcctgtaatcccagctactcgggagactgaggcaggagaatcacttgaacctaggaggcagaggctgcagtgagccaagatcgcgccactgcactccggcctgagtgacagagtgagactctgtctcaaaaccaaacaaacaaacaagagtcaaactctgtaaaatgtttaaagaggtttattctgagccaaatatgagtgaccaaggcccgtgacacagccccaggaagtcccgagaacatgtgcccaaggtggttgggttacagcttgattttatacgttttaggggtcagaagttacaggcagacatcagccaatatatttaagatgtacattggttccatcaggaaaggtgggacaacttgaagtggggagggggcacctttcaggtcaaaggtggatttaaagattttctgattggaaattgattgacactgggtgcagtggctcatgcatgtaatcccagcactttgggaggctgaggcgggtggatcgcttgagcccaggagttcgagaccaaccagcttgggcaatgtgacaagaccttgtctccaagtaaaaaaaataaaataaaattagttgggtgtggtggtgcacacctgtggtcccagctactttggaggctgaagtgggaggattgcttaagcccaggagttcaagaccagcctgggcaacatggcaaaaccctgtctctacaaaaataaaaataaataaaaaaagaaattggttgaaagagttattttctaaagacctggtctaaaatgaggggctgtggagtgtctaaaatgaggggttgtgaagaccaaggtttttattatgtaggtgaagcctctaggtaacaagcttcagagaaaatagatgtaaatgtcttttatcagacttaaaaaggtaccggactcctagttaattctctccgggatcaggaaaagacctgaaaagggaaggagattctatatattctaggttttgctcataagagacagctttgcagggtcatttcaaaatatacaaagaaatatatcttggagtaaaatactttgatttctttcagggcctgttatctgtcatgtgatgctatgctagagtcaggttggaatttagcatgttattgctacaaggaatctgttttgtcagttttaagatctctggtttttgtttgtttgtttgtttgtttttgagacggagtttcactcttgtcgcccaggctagagtgcaatggtgcaatcctggctcaccgcaacctcctcctcccgcattcaagcgattctcctgcctcagcctcccgagtagctgggattacaggcatgtgccgttacgcccacctgtttttgtatttttagtagagacagggtttctctactaaagtgttggtcagactggtctcgaactcccaacctcaggtgatctgcccgccttggcctcccaaagtgctgggattacatgcaggaaccactgtgcctggccaagatctctgttttaatgctggtcatttgtgtctgaattccaaagggacgggagtataatgaggtttgtctgacccctccctcccatcatggcctgaactagtttttcaggttttctttggaatgcccttggtcaagaagaggatccgttcagttggttgggggagcttagaattttatttttgtttgctctcctcagtgtcccaagtagttggactataggcacacaccacacagcaccacacctggcttgtttcctttttaaaatggtggctcttgtcctttttgggaagtgtttgggcacagaggtactgatactgttattctggttttagaataagaggctgatggaacctgcaggtaagggaagagctttgacttggacagagaagtggccagcttcttaataaaaagtgggtaagatggaggtgaaacttggacacatgcaatatctgacattgtaaatccttttttcttgtgaggctggattttgttgcttcatatgtgataacagaccaattatatcagtagttcaatggtgatgttcagtttaatctcttttcctctcttgtacagtactcttgttttagctttcgtaaactctgggctttcaccggaccaggttttcttatgagcattgcctacctggatccaggaaatattgaatccgatttgcagtctggagcagtggctggatttaaggtgaacatctagtcctacccctgtccttttaagcacataatacactctcacatccttttctccaccctgcatgttggatagtagcctcaggggctacatgcagatacttcattggcagtggctcttatgtgtaaagtactttccatttggtcttatttttatccacatagtttccttgaacaaaggagaaactacatataggagaaactgaggctcagaaaggtacaaggtgacttagcaggtcatgtgcaaaatctgttatagaactcaagtcatttgattcttgacctgggctcttttctgaatgcagtatttaccactcatgttgccaaacaactaaacaaacaaacagacaaaaactcagttgttcaatgagtgttacaggagattttgttcttcttagttgctctggatccttctgttggccacccttgtggggctgctgctccagcggcttgcagctagactgggagtggttactgggctgcatcttgctgaagtatgtcaccgtcagtatcccaaggtgagcaatgtattgtcctgtttgtctctcacccatgccataggaatctgtgtgtctggcggtatgtgctggcctcattctatagtgagacagtcaaggacttgggggtcagtggccctgaagacagacggtaccaacggaaatactgtagctcctcctgctgccaggccatgttttccccctctttcaaaatctaacttgagactcgcatttcctagaaggttttcttagaaaaactgtgttaccattcactctggcttccagtatctagcaatgcccagcccaaggggaggaggatgctctctctaagcacttttattcatacctccatgttactccatcagtttgcattttatatatgttctttttttgtttgactttgccatcactttgaaaaagtaattttttttctttttagtacaaactatatgtggcaagatctttggatttgctaataattatttttcagtttcccctcccaccgggggctacactgtcctctgcagcttcttctggacattttgggcctttcttaccgttgcctaaggcaagaatgaacactatgtctggaagatatttttaacttagttttgtctcttgttttgtttcttttcctgggtgtgagcaaaaagtatccttatctgcttttcaaaaaaataaaaaaatcttgataatatccccatttactctgatgtgattattacacattttatgcctatatcaaaatatcccatatgccccataatatatacacctactatgtacccataaaatttttaaaaaacaaacaaaaccttggtaatttataatccttctagcttctttttctttctttcttcttattttttgagacggagtctcactctgtcacccatggtggagtgcagtgatgtgatcatggctcactgcagccttgacctcccaggctcaagcgattctcccatctcagcctcccaagtagctgggaccacaggcgagcacgaccacacccagctaattaaaattttttttttttttttttttgtggagatgaggtattgctatgttgtctaggctggtctcaaactcctgggctcaggcagtcctcccaccacagcttctcaaagtgctgggacgacaggcatgagccactgcaccaagcctagcttctctttcttcatacacgttaatagttattttgtaataataattatatatatatatatttgtttgtttgtttgttttgttttgttttttgagacagaatctcactctgttgcccaggctggagttcagagttcagtggtgtgatctcagctcactacagcctctgcttcttgcagtgaggcgattccagggattctcctgcctcagcctcctgactagcttggattacagccacgtgccaccatctggctaatttttgtatttttagtagagatgaggttttaccatgttggtcaggctggtcttgaactcctggccttaggtgatctgccagccttcgcctcccaaagtgctgggattacaggcatgagccaccgtgcccagcctgcttttttgtttgtttgtttgagacggagtttcactctttcacccaggctggagtgcagtggcgtgatctcagctcactgcaacctccgccttcagtttcaagtgattctcctgcctcagcctcccgagtagctgggattacaggtgcctgccaccatgcctggctaatttttgtatttttagtagagacggggtttcaccatgttggccaggctggtctcgaactcctgaccttgtgatctgcccacctcggccttccaaagtgctgggattacagacgtgagccactgcgcctggccttgttttggtatttttgagatggagtctcactctgttgcccagcctggagtacagtggcgtgatctcagctcaccacaacctccgcctcttgggttcaagctattctcctgcctcagcctcctgagtagctgggactacaggcgtgcatcaccacgcctggccaatttttgtatttttagtagagatgaggtttcactatgttggccagactggtctcaaactcctgacctcgtgatctgcccgccttggcctcccaaagtgctgggattacaggcgtgagctactgcgcctggctctgccctttttttttttttttttttttttttgagaccaagtctcgctttgtcacccaggctcgggtacagtggtgtgatcttggcttactataacctcaacctcccaggttcaagcgattctcctgtctcagcttcccgagtagctgggattacaggtgcgcaccaccacacccagctaatttttgtatttttagtagagacagggtttcaccatgttggccaggctgatctcaaactccagacctcaagtgatccacttgccttagcctctcaaagtgctgggattacagatgtgagatactgtgcctggcctgtttttttgagataggatcttgctctattacccagactagagttcagtggcacaatcatggctcactatacccttgacctcccaggcgcaagcagccttcctacctctgtctcttgaatagttgggaccacaggtgtgcaccatgatacccagctatttttaaaattttttgtagagacagggttttgccatgttgccaaggctgggcttgaactcctgggctcaagtaatcctcccacctctgcctcccaaagttcagggattataggtgtgaactaccatgggtgacctgacaaattttttggatgctagctatctggaggtgtttttttctggcttcagtgagtcagcataactaaatctgattttcagctgtattgtttggccagataagtttctgactttgttatatgccacccagttccaaccatcttcccttgagtccttttgcatacgtgggcattattattacattaaaggtgactccaaccttttctgttgttgtggtggtggtttgttgagacagtcttgctcttgtttgttgcccactctggagtgcagtggcatgatcatagctcactgcagccttgaccactggggcttaggctgtcctcctgcctcagcctcccaagtagttgggactacaggtgtatgccatcatgcctggatacttttgtactttttttttttcctataatttttattttaggtttggagatggatacatgtgaaggttttttctttctttctttctttcttttttttttttttgtgaaagcaagtttattaagaacgtaaaggaataaagaaaggctattccgtaggcagagcagtcacatgtgaaggtttgttacatagataaacacgtgtcatgggggtttgttgtacatattattacatcaccccgatattaagcccaatacacaatagttaacttttctgcttctctctctccttccaccctcccccatcaagtagaccccagtgtctgttgtttctgtctgtgtgttcataagttcttatcattttgctcccaatttttatactttttgtagagatggggttttgccatgttgcccaggctggtctcaaactcctgggcttaagggatctacgttggcatcccaaagtgctgagattacaggaatgagccactgtgcctggtccaccccaaccttttttttttttttttgagatggagtctcgctttgttgtccaggctggagtgcagtggcgcaatctcggctcactgcaaccttcgcctcccgggttcaagcaattctcctgcctcagccccctgagtagctgggattacaggcatgtgccaccatgcccagctaatttttgtatttttagtagagacggggtttcgccatgttggccaggctgatcttgaaccctgtcctcaggtgatccacctgcctcagcctcccaaagtgctgggattacaggtgtgagccaccgcgcccagcctgaccccaaccttttcatgtttgttttgtcttcccagctatggtcaggatagatatgttcttctgcaatcatttaatattctttcttgacccatatttggaccgtattagcatccttattctcctctaaactttttaggattgtttttaggaaattaagtggaagttagtaaatggcaattatattcttctcaagtagaaaggaaaaagaaaaaagtaagatcaattactgccttgaccttcgttcacaggttctgccacgtggtagcacacttttccttctccaggtgagagccacagtgcagtgatcggccaagtggaggcacgttctggtatttcttctctagtctggaggcttataaaggactgtttatggtttagtgccaaaatgtgaattccaaattgtggaggaattttttagaaatgattaatcagaaccgtgtctttctactgtttgatgtttaggtcccacgagtcatcctgtggctgatggtggagttggctatcatcggctcagacatgcaagaagtcattggctcagccattgctatcaatcttctgtctgtaggaaggtgaggggttttcctctagaaagtcatcagtgttttgctggatttccaagcagagataaaaacaaaaacccaattcatttttaattttgaagactcaactcaattgttatttcttctgtggaacctttctggaaacaatttcttctcccctggtagatgtagactctacatcttccgtttcccatggtgggttatgcttacctttattagaatgtgtggcgttttgtatcgcaattattgatttgtatgtcattttatcccgctagatactatctttttattttattttatttatttatttttttgagacagagtctttctccgtcacccaggctggagtgcagtggtatgatcttggctcactgcaacctccgcctcccaggttcaagcaattcttgtgcctcagtctcctgagtagctgggattacaggcacctgccaccatgtccagctaatttttgtatttttagtagagacgggatttcaccatgttggccaggctggtctctaactcctgacctcaggtctaggaatgcccgcctcagcctcccaaagtgctggtattacaggcgtgagccactacacccagcccccactagatactatctatctaatcctataaaattctatctgtctaactccatgagggtaagacccaaacttttcagctttgtatcctaagagtgacatagtagactctcaaagtttaaatgaatgtaattaagttgatgctgttaccctactttacccaaggcctagttttctgccattgtccctcctccctcaagtcctagcttctccaagtgttctttatctggagagctgttgggaagagagtgtttttcaatgtttcctttctttccgtctctctgacttccatatctcatctctgacctagaattcctctgtggggtggcgttctcatcaccattgcagatacttttgtatttctcttcttggacaaatatggtaaggagagcgggaatgggagggtcaaaggagctgctctctgtcatgtggcagatggggaagtctaccttctctgagctcactgctgccttttttcctttaggcttgcggaagctagaagcattttttggctttctcatcactattatggccctcacatttggatatgaggcaagtggtacaggatattcattagcttcttaaaataagtttttgtggtttttttttttagccttttattataaaagacagtaataatgctagtatgattcacttatagtgggtgtatcaacaaaaagccaatttttccctgggccaattttaaaggaatatgatctatagcaaagattagcatgcagaaaggcctgcaggggctcccaggtttaaaatgactagatattttagggctttccagactagattctttggtcccaagttgaccatctgacaacagaacagccatggatagtgttaattaaggagggggttgcagggttattcttgggtgttaacttagaggagttctgcttttgttcatcctggtttatattaattgcagcttgaactttcccaatattaaaacagttaatgaattatatgaaatatactggatatttcctggtttgtgccccaacccagaaactccttagagtcactaatattatttgcagtactagcacctttctttgtacaattcttataaactgatttctgcttactggtctggctgaactttaaaaaatatatgtaatctatgggttgattatgcctcttggcctaaggcttccaagagaaatactgaaccggggaagagtatatatgagagtgtttaaggatgagtctctcattacacacgtactagtggcaaacagcaagtgatttttaaatgaacatgggtgaacagaagtatgctcagtatggataataaaaattgattctatattcttttttaatttttagatttttatttatttatttatttttgagccagagcgttgctctgtcatgtaggctagagtgcagtgggtgtgatcttggctcacttgcagcctccgcctcccaggttcaagtggttcttgtgcctcagcctcccaagtagctgggattattggcgtgtaccaccatgcctggctaactttttgtatttttagtagagatggggtttctctatgttggccaggctggtcttgaactgctgacctcaagtaatctgcccatcttggcctcccaaagtgctaggatttcagctgtgagccactgtgcctggccctggttgtatatttttgagccttgtggaattactaataaccacaagtcccttagcagctttttcttttttcttttcttttttttttttgagatggagtctccctctttcgcccaggctggagtgcagtggtgcgatctctgctcactgcaacttccacccccaggttcaagcgattctcctgcctcagcctcccacgtagctgggattacgggtgcccgccaccgtgcctggttaatttttgtatttttcgtagagacggggtttcactatgtttgccaggctggtcttgaactcctgacctcaggtgatccacccgccttgacctgctaaagtgctaggattacaggcgtgagccaccatgcctggccttttttttttttttttttttttttttttgagacagagtctcacactattgcctatgctggagttcagtggcacgatctcagctcacctcctgggctcaagtgatccttccacctcagcctccctagtagctagtactataggtatgcaccaccacaccgaggtaatttttgtagagataaggttttgttgtgttgtcaggctgctcttgaactcctgggctcaagcaatgcgcctgccttggtctcctaaagtgctgggattataggcgtgagccaccgcacccagccctttctttagaaattaattatgtatcatacacatctgtttcatatatctaagatgtgttgtaaactatccggatactcagtcttgaattctctggcccctaatagtaagccccttatgttgcttggtcctatgatgattctgtattcctcattatcttaggtagttgcagaagaaaagattttggccaggtgtggtggcctgtaatcccagcactttgggtggctgaggtgggaagattgcttgtacttgggagattgaggtttcagtgagctgtgatcatgccactgcattccagcctgggtgacagagcaagatcctatctcaaaaaatataaaaataaggaagaaggcattgtaagggataaaggatgctaactgttccctggtactatgttactcccgtttcacgttcctgtaaaggctaatcattgttatgttggtatgtagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaaggtgagcaaggcccttatctccttcacctcctagacagttcatgggatcttttccttcaattgcaagggacacaaagttagtttacaattattaggaccatgaaggagcaaggtattttccaagcctggacatttataaactccatatacttagatgctgtttttatcaccaaattgaccagagattactaactgcataaagcaggtggggctaaagttctttttttttttttttttaaattgagatggagtctcactctattgcccaggctggagtgcagtggcgtgatctctactcactgcaaacctctccctcccgggttcaagtgattctcgtgcctcagcctcctgagtacctgggattataggcgtgcaccaccatgcctggctaatttttctatttttagtagagatgtggtttcaccatgttggccaggctggtctcgaactcctgagctcaagcaatccacccgccttggcctcccaaagtgctgggattacaggcgtgagctactgcacccagctgggactaaagttcttcataaaaggttggaagtgcatcaagtctcttgtgtttaaatttcaaaagctcgagtggccttatggaggtcaggagtaaaggagcccaaacaggcttttactgtcagtattatgtaatagtttgctgggagattttagaaacctttataaataggtatatgcacaccttaggactgaaatcaggtcgtttttataggtcagtggtccttccagccactgagagtaactgagagctcagtagtcatttagtctctgttccctatttggggaatgtacagttcaacgaaagggcatgaagttcttttttctccccccatatgaagttcttaattgctcagtgaactaggatgtaggtgagtgttggatctctcacttttcgtctggtcaacttttgtcccctaaatctctcagctgactccaaactcctgaaatgtcacaaggaaacttgttctaactggtcaaaaagtgactgctgttgttatctttctagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggtgagtaagccagggttatgggtggtagtgaatgtgagggtaaagtgaagactgcaatgggatggggaaggaaaatacctcatcctagtgttaatgttcaggagaaataatctctagcttctcgtctgccccccaaaatcactgtgcaccagtcagagtctacagtatggggctgaccaagcctggaccctctttctcagcttttgtttgggagtagtcaacaaacagaaaacagaaactgtgatgatgacagactttgtcttgtcattttgaattctgtatcaatcttgatttctgattacctatgtagtgttttttttgagacggagtcttgcactgtcatccaagctggagtgcagtggcacagtcttggctcactgcctccacctcctgggttcaagcgattctcctgcctcagcctcctgagtagctgggattacaggtgcctgccaccacacccagctaattttttgtaattttagtagagatggggtttcaccatgttggccaggctggtctcaaactcctgacctcaagtgatccacctgcctcggcctctcaaagtacagggattacaggcgtgagctcctgtgcctggcctgcctgtgtagttttgatcaccatttgtttcccgtctatggaacctctgactcctctgtctgctttgactgaggattctattctgggtgttctctcatgtctgaagccttcttcagagcctctcctcttgtcatcatttaaagtaccccagcgtttgtacattattaccatgcacactgtaactcagtaaagatttttgatgacctgtgggtgtagaaggattatagaggaagatcctagataacattgctgctagtctctgcccacatcacagcatatgtccagtgttttccctccagcctacctcttatagatgattgtgtatgatatgtaggagagctcttatttggtccttgcttctgaaacaaaagttgctgttgaattgctttgggttctaggttgaagtctgtacaaataccagcagtcctcatgctggcctctttcctaaagataactcgacactggctgtggacatctacaaaggggtaagcatgtttggatttgtgatctttgttcctgaatcagtatttttagcatagtatgtggtcttttttgtgacttcacttcagatatgagcatatctcctctggagtgtcatttatttcagagttccagacaccagacaagcattttggattaaatgggaaggaatagaggatcagttgaaaagatatataatacaggccgggtgcggtggttcacgcctgtaatcccagcactttgggaggctgaggcgggtggatcacttgagctcaggagttcaagaccagcgtgaccaacatggtgaaacctgtctctactaaaaacaaaaatacaaaaattagctggatgtggtggtgggcacctgtaatctcagctactcaggaggctgaaacacgagaatcgcttgaacctggaaggcagaggttgcagtgagccgagattgggccactgcacctcccagcctgggcgacagaataagactctgtctttaaaaaaaaaaggaaaaaaaagatgcagtatacaccccagctttttttttttttttttttttttttttttttttttggagacaaggtcttgctctgttgcccaggctggggtacagtggctcgatcatggctcactgcagcctccacctacctggtccaagtgattttcccatctcagtcttttgggtaatgggactgcaggcaagcaccaccatgcttggctattttttttttctttttgagatggagttttgttcttgttgcccaggctggagtgcactggcgtgatcttggctcactgcaatctctgccttccgggttcaagtgcttctcctgcctcagcctcccaagtagataggattacaggtgtgtaccaccacacctggctaattttgtatttttagtagagatgggggtctctccatgttggtcaggctggtctcgaactcctgacctcaggtgatccacccccccctcggcctcccaaagtgctgggattacaggtgtgagccaccatgcctggccttgtattttttttgtagagtcagggtatttgccatgttgcctaggcttgtctcaaactcctgggctcaagggattctccaaccctggcctcccaaagtgctgggattacaagcgtgagccaccctacccagccccaagaaagtgttcttagtaaagtgtttttactggagtctctcagttcttttatgctggttacattgtgatcctccaacagtagaatatatagtgtgtagcatttcaccaatttatttgatatttccctgtacttctattgccattttccagaatagtgtgtaaaggaatataatttggggaaagtggtgtagacctcttttttttttttttttttaatatttaagatggaggtttaggagcttggagaagagaaaggactaggcagagaaacgaaggagcatccagtaaagtttagactgaaagcttctggaatgaggtccggacttgagcctagcttctggcacagtgcccagcacagcacttggtgttggtggtgcatagcaaagaagggagaaatgccacagggaactgctgttttggatattgtctgagcagattattgccacaatcatatccttcctcttggcctctcacagggtgttgtgctgggatgttactttgggcctgctgcactctacatttgggcagtggggatcctggctgcaggacagagctccaccatgacaggaacctattctggccagtttgtcatggaggtacgtgctggtataggatagagggagataacacaacccttttgttacttcttcttcttcttcttttttttttttttttgagatggagtctcactcgtcgcccaagttggagtgtaatggcatgatctcggctcactgcaacctccacctcccgggttcaagtgattctcctgactcagcctcccgagtagctaggattacaggctctggccaccatactcggctaattttttgtatttttagtagagatggcgtttcaccatgttggccaggcaggtcttgaactcctgacctcaagtgatctacccgccttggcctctcaaagtgctgggattacaggcgtgagccactgcgcctggccccttttgtcacttcttaatcccattcttctgaggtctctcctgaacctccccaaaacttttttttgtttcctgttgcagacagtcatctgctcctatgttttcttccagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacaggtgaggaggaagctgaggaaacacatcctagttattcaggtagcattatgtactgcccttgggtaccaagcctagctgagtgctggggggatattgagaggaagacagaggcatggttgtggtctgcagtaaatgtatatgaaatccttggcatctaaaaggattttagaaatggttggttttttaaacctgttgaatgggaactatgaactttacttacatatgggacacaaaattgtagttcattaatgcaagcaaacattaaatgaacatataggacactgtgctaggtcctgtggaggttaagaagacaagtcacatacaaaggtttgtatgctaggttaatgacagctctgcagaattcagcataatgcccaagcatgttgggatgataggaataattatttctcatggagtagttgaggcagcatttatgtttccctttcattaattgtgctgttctctagggtgatacaaggacccatagtaatcccatctgatcttctttcttttccagcttccctttgctctcatacccatcctcacatttacgagcttgcggccagtaatgagtgactttgccaatggactgtgagtgtactcctcttcgttcccaaaggggatgctgatatggggaaagggtatcttcatgcagtaggccagtcagacgtgagacacagagggaagcgatatgctttgagaggtgattgctagctgcttcctctttggcttagagaatggaaactgtgaatatagtaaaggaagagaaagcacgtctttcatatgaaggggagagaaagttcagcttttacagcataactcttcagcttcagccactgaagtttgaggcaccttaattctttgttaaatgatcttaacaaaaaaggcataagttagtaccttttatatatatctttaaaggatatgaggtatctgaagtgacttgttgcatttttgggaacgttaataaaatggctcattgcgtttctaggccttgttgcatctctagggacttaaatattagggattatttgttggtgtcttttcccccctctttctccctgtctaccagtatctaactttgggtgatttaacttagacttatgaagaatcattttttttcaaattaagaacaatttttccattcattttgaactgcctctaattcccatcctgtttccttttctgtctgtggccaagttggattattccatcagtgactgtgctgatttcttttacagaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttggtaagtctagcctggaagagcaggggcataggtatcagggatggttgaggtggggttcactgacattcagaaatgaacagacccaggctgggcacagtggctcatgcctataatcccagtactttgggaggctgaggcgggaggattgcttgaatccaggagttagagaccaatctgggcaacatagtaagactccatctctacaaaaaaagagaaatgaacagacccaaaagagcacataacaatctacctccaggtgatcgagacaatgtatatggaattgtcaaatcagctgtttacaaaataatatttctaaccataaaattcactttggttactaagatttgtcatttttcaatttctgtcacttctgtagtttccattcttagtaattcctaacaagagagtatagtatgtttgaggaactaaaagaagggtagcagtacagagagtggagaacggtacaaaacagaggtggagaatagggcatgcagtgtgatttagagattcggggtgggacacatgtggcacacagccccactcagctccatcacttactagctgtccaaggaaataagtaaatagtgatagtctccccttgactctcattctagagtcattttttaaaaatcatggttataaaactatagctacatgaaaaaggtatgtaaaatttatatttcaattataaaaaattttttaagaagtctagaattatataaaaatggcaatatagttgttgtaggaagctaggattatagatatattcttctctattttccaaatcttctttagcattgcttatattaatgaaaaacagccaaaataacaacagatccatttccctgttctatacaggtttctttgaaaagacacaggggttagggataaggaatagtagaatttataccatttttgctgcagagaatggctacagatggaggctggaaacctgctgttaatctctagaacacttccccacaccagtgtgccacacattagatactttattaagaaaatcacttcagtaaatgttgaaaaattatttcctagatctcttctttttttcttcccaataaactttgtgcacacaaagactgtactgaccctatgatctaggaacttaacttcaaggaaaaccaagtaactgaatgtgtccttgacaggaattgtttttaaaaattcactatagaagttagggggatcctttcagaatgcaaattggatatgaacatgccagtttgtcctcagtcagcctaaggctaatgagcttgttgaagacccattattattattatttttgagacagagtttttctctatcgcccaagctagggtatagtggcatgatcttagctcactgcaacctctgcctcctgggttcaagtgattcgcctgccttagcctcctgagtagttgggactacagccatgtgctaaccatgcctggctaatttttgtatttttagtagagatggggttttgccatgttggccaggctggtctcaaactcttgacctcaggtgatccacctgcctcagcctcctgaagtgttgggattacaggcatgagccaccgtgtctggcttgaagacccattttgagaggagagggctgattctagagtgggttactgttgtttaacttcaaaacaggaacttcatagagcagcttaggagactacaccaattgtattagtctgttagtcattcttatcatggggaggactgaggaaaagtggacttccgagaacttacagttgggtaaaagaaacaaacaacaggctggacgaggtggctcacgcttgtaatttcagtgctttgggaggccgagccaggaggattgcttgaggttaggagtttcagaccagcttgagaaatatagcaagacaccttgtctctacaaaaaaaaataaattagctgggcatggtggtgtgcgtctgtaatcctggcaactcaggaggctgaggagggaggattgcttgagcccaggaattcgaggcttcagtgagctatgattgcaccactatactccagcctgagcaatagagggagaccttgtctctaaaatgtaaaataataataaagattttaaaaaaaaggaaaaccacagacacaaagcagtaagaacagagaaattcaatatttaaaatagtatggacaaactttgttgaggaaggcagctgattttttgaagggggagtggggttgagagaatgacttgtgcaacccttggtggtagaagatgggcacagctggatgttcaaggaagggagcaggtttgcatttgagaagtgctgtgtgagcagtcatggctcttcaaagagcctggtgagtgatgaccatgttttgtctttcagggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccattgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaatttggtttcctgggtatttttttaaccttgaaataatttattaatagggttacaacaactttgatacaaaaatactgaaacagcaactaccacctggaatggcacactaagtccacactgttaggattttctccttagaaaggatagagaaataaatggatttagtcctcagaaagcttggattaattgcagataccaggatattaatttccatttacccacttagtcaaatagttttaccatagctaaaggtcacatcattaccatgttgaaacttgggaaaaaaattttattctgcttttctctaagctgactattttctacctgtagcttatttcactgtttcacttttacattctatatgtgctgccaatgaaaaattagtatttgaagagaaaccaaactcatttagcttaaagaccaaggagcattttggcagacctgatataaatggaaatattgacaccatttattaaaaacaaaggcagagctcaggcacagtgaactttactaggcacatgacaggaaaacttgagtcagcacttgatttgtcccaggagtgtcaccagaacttcattttccctttctctgttgcaaggcttccctgtgagtaacacagtggaattcatctaggaagaattttgttctccatgttgtccttcctcatttagtgctctctctttactttggatttaatttcagaactaaaataggattcaaaacaatgtgaggatcctgttttgaaacatttcctttagctctgccctctggaataccttctgctccttcattggtaggaccaatgaatctaaatctgtcagcttctctaagtcccttagcttatgaatttaaaaatggctaactcagtactgtgttctaaggcctggcctgaacagttgtattatctcatttaatccttgtaacaacaagaggatcagcctctatgtagatgagtcaactggaaggccaaaagtaacttgcccacatttacattactaatgaaatgtgcagttggcatttgaactcgcatagcttaactccagaacccatgttttcattcccaaactatcctgtgtaatatatagtatacccttcatgttgggttgtcaccaagctttgttgtttagcagcacaaggaacataacacactgaagcatttgtttcatactctgattagtgctagaatatgcattaggcagaagttgccaactggtagattttggtccctgtgcagaatttttaaaagtaagtttgaatgcttttggcaagtgtagagaatggacagggccctctatggtcctatcccagcaatagccaagagttactagttaataagttcactcatttgcattagctctctgcccctggaagtattttagcctatttccaggccatttagtctcatttctcaatgtctcagaacaatataacaaacatctccaatgaaagtggtctatcaactaagtcatctaagtgacactctgtgggcatcacaggaccaatactgcaacccttgcttactacgtattgaagaagtctaccaccattgctcacttgggaaaggcttcaatgaattgtcaatatatttaattgctgttatttacttaagcctaaattaagcaagctgatgtctgaagagctgtttccatgtcctaaagccagtgtaatacagtgttttcctagcccactagttggaaatagttttatcctgggcatcatttggtctaatctgtcttcacacagtcatcactgcaagcctgtgaggttatacactgcagtttgtaatgtgttaaatatatgtgtcgaagactcacatgagatagtatattggtgtacttggcattttctttttttttttttctgagatggagtcgagctttgtcacccaggctggagtgcagtgctatgatctcgtctcactgccacctctgcctcccaggttcaagcaattctcctgcctcagcctcccgagtagctgggattacaggtgcccaccac

SEQ ID NO: 11841 - DNA, 47419 bp, Human
gaataactgcattttctgaaggaaaatcaacgaagtgctttgaggccaagtagatgggattcttgaggattccatgaatagcaaatagtagtatccccctcagaggctcttgggtgggggcattaaatgtgttaatacatgtgtttgctgcaggtatagccagaatatgtgaaagcagctacagggaatagagtgtagcaaactcctaatcatccctcaaaaccctgccctggtgtcctctcccttgtaaactttccttgaacaaggcagaaccagctacatcagcaccataccatccctccatcactacagatatcactctgtactataattatccatttatttttctaggccttgcactccctaaggccaggattctgactctttccctgagtgctgtttacctgaactgaaccggcatgaaccaccacgcccggccatcttgtcactttctaaaatgcattgctcttcgtggcagatgctccataagccagagctctaagccgcagcattgagccgcagcattgagctgaagcctgaagggaagatggctttgatatgttaaaactcattccagtttactcctatttttcattcattcatccacacattcactcaacaaagatccttgagctctgatatccatgtcttttttgtggctcttagtttatctttgacaaagttaatatattatgctgaatttaacttgggaaagacaagaaggaaatgagtggacagtggtagcaaagtgttgggacggtgagatcaagggtgactttttttccctttgcttctcaacttctccctaatgtagttgttattttacttttatgatggaaaaatgcatatgtatgggaatactgtatttcaggcattataaggaatgaaattataggccgggcatggtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctatcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgccttcatttctggggaagcggctgttttgagagggttttgtttcttcctctttgagaaggctcagaaaattgtgggaattttctgcctacagagagaaggtgttggaaagtctaggtaaaaaaatgccgacatgaggtttggtcatttgaacatggcatcttggtcagatttcttttctgcaaatattagctgtggttgttacatgacaaggaaaaactttctgaaaagttcaaaatgggagtttgtatctgctaagaattttttttaacagagattatcttatcagtccttataacatgtaacctccccacaaatcctggtaagatggatatattaaacccattttatggatgaataaatgagtttcagttaaataacttgatccaggacacataactggtagagctaggattccaggatttgaacccaggtctatggggctataagttcttttctttctttccctctttccttcctttccttcctgtcctttcctcccttcccctcccttcccttccctttctttcttttttttttttggaaacagccttgactgcccagcctcaagcaatccttctgcctcagcctcccgagtagctgggactacaggcacaagacaccatgcctgcctggctaatttttcaattttttgtagtcaaggtctccctatgttgcccaggctgaactcgaactcttggactcaagcgatcctcctgcctcggtctcccgaaatgctgggattacaggcgtgagccactgcacttggcctaaaattcttacatggactatattcactacactgtcttctaaagacagagtttttgcctctttgatcttcctcttgtctgtttcaaaggagatgatctcagatttcgagggatgagtgcatttttcacaaatatttcctccccacataataaaagaggagcaagtaataatgctgagttagaacaacaactgcaaaatctttaaaagaaaggtagctacagcttgagtgctttccccagtaacagacctaaaactacagttgataatgagagctgctgggaagtgtctttcagggtcaggcaaaggcacccctgtttcaacgacctccgggctcttcctcaccctgcctgtggccagtgatgaagcctggctgggtctggtgggccagcaggtcccgctaaggaggctcatggtgcatacagtttgtccttgttaagtggcgatggggatgggggggttcattgtttttccttaagattattaggtggctttacagaattgaagtctgtgtccgaaggctccccattccaaccccgaaatagagacagaggttgcaaagcattgatgaaggggctcatgctggcgttcatatcgattccccagtgagccaaccccactgagaagccctgttctgtaaactcttcttcaaccttccctcacctctgcttcccttcttcagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccaggtgagttttccctgggggaacctcctgcttgtctccttgggcacccatgccctgtcggcaccgatgactcagaattcctctctctgctcctcctctctcacctgaggtctgatctcctcattgcttcttgaaagtccctgttggaattcaatgcagccgctgattattgggcacctcgctgtgcctgacggtatgtgaagaaggaagggacatggtgcggggctggccctgaagaagcttggaatctttggggaagaatatgggaaggagcttggcctgagaatgggaggcagtagagcctcgtggtgggcaccatggcggaggggtgggggtggagggtcagcatcctggcctgcgtccattccaattcaccgcttgctagatgctttgaatatcatcctggtgaagggcatcaggatgttagacaaactagttccaagccctgtgctggccgcactagttgccgggtgctgcctctagccagctgtgtgacgcagggtaagttaacctctctgaaacttagtgctcacctgtggtatgaggaacccaagggggccctcaccatagtgtgctgaggatgaaatgagatctacagcactcagcactgtgcccacacagaacagacacttagtccacatcagggttcatcaccatctactgagtacctgcccttgccagagctacacaggccacttgacagactttgcatctcaactgatctctgtggcggctctttgaagttcatatgattgactcatttcacagataaggaaatagaagctctaataggattatgacttcccccagcctgaatgaccggtaattacagagtttacagagttggaacttgagcccagatttggattcttcatgtccctcctccccgggcccatccttcctcccagggcagaaccaagagaatgagtcagttaatgaacaagtcaagggacaggcttgaggctcgctcaggtggaaagacaaagcaatctgcaataacgcaatagtgcaactgaaaccaaagcccccatctacacaagaccaccacatagccacacaaccccaccgccccagaggagcctttcccatggactacaaagggtagggcgccccctggatgtgtgcagcatgacggccctgagtgtatctgtcagaggcggcaaaaaatgccagtggctaagaggatgggcttggggatgagcaagtggctttgccactcagtagccctgtaacctttggcaagtcccctagcctctgagcctcaatttcctcctctataagaagagggtaacaatggtgatttcctggagttggaggaaggagtaaatgagctttcccatgtgagcaacttagcacagggcctggcctggagtaagtgctcagcaaatggcactgttggcattgctatcattagcggtggtgttggcagttaggaggtgatggagcaaaattgaacagagttccctctaggggcttcacagaagtcaggtggactctgtggcctttgaagtatgggtagaatgtagacaggtgcagaggagtagcaaggacattcaggaagaggggagaggtgagcagaggctcagaggcagaaatgagcctgactgtgcttggccaggagtgggctgggggctgggataggcaaagccaggccagagcacaagggcttgaatgcagggtaggagatttggactcgctctccctggcagtagggagccattgtaggttcttgagcaggacagtctagctgtggtgtggtaggtgaattggaggagaggactttgaaaccaggcagtctgggctatggcaactgaggtggctaagagaccaagaggtgagaacacagagttgatggcctctagatgtccagattctaagggctgtagaggggcagtggcttcgccccttccttctcttcatctcatcattgcagccgctgccagctgacctccctgactccagctccccacactggctctgagctctctcttgccaactggacttctagcaagtcacgcccctattctagagcctgcagtggctccccattgcctgtcaccacattaaagcttccacagagttctgagcgagcaccctacccaaatggagagcccatcccacctgcccatcccagccttcctcagctccccagtgcctgtgcatagcacattcctccctcagctcatccagacccaactcatcccctatttttttcttttctatttttattttttattattattatttttagacagggtctcactctgttgcccagacttcagtgtagtggctccatttcagctcactgcactgcaacctccacctgccaggttcaagcgattctcccacctcagcctcctgagtagctgggactacaggcatgtgccaccacgcctggttaatttttgtatttttagtagagacggtgtttcaccatattggccaggctggtctcgaacccctgacctcaagcaattctcctgccttggcctcccaaagtgctattacaggtgtgagccaccgcacctaggcttcttttttctttccttttcttttctctctttctctctctcttttaaagctgagaatcttgctctgttgtccaggctgccctcgaactctgggccctagtgatctatctgctgtctttccggatcaccctgaatctcccaaaacccttacggtgttggctgcagcctttaaccctcatccccacaccctctaatagcattgccagttatccctatgtctttgggggctgacttgtgtctttggaccattcaggaaatatgagttcagactccagggagggccctgagctgcagtggacatgtgacaaaccagctaacttgaccatgtttttccccctcctcttcatgctggggtgggctggcggaaaggatccagtcagatagaagaggggatgaagaaaaaaatatcacacatcaattcattcaactctcccaacgatccacaaggaaggaattttagttatcccattttaaagatgaggaccctgaagcccagaaagttaaagtaattttcaagatctcataattagcaaatgacagagctgggattcagatccaggcagtccagagggacccctgcatggggctgccacctttgtgtcctgggcatgtcacattccattgacgagtacatgcagatgcccactcccctggctctgtgctgggagttaagatatcaatgaaacccttctgctcatcagtgaattgtttgagccacttattacttacatacaccactgctaaaaacaatagataacatttataaggtccttagtactgtgtcaataatgagacaggaactattatccttgttttacaagattgagtgacttactggaggtcaattcctggaaaatagtggagctaaggtttgagtcaagtccaaactcataacatctacactatctgtgctctcccagagggcctactgtgtgctgcactgttcaagagacagagaaaaatgacccagttcctgctgtcaggaaggaaacggggaaacggatgtcttcctcgctggtttgggagacgtacatgaagaatgcgagttggagaaattgtgtcaggagtaggtgggatggagtgtagacaggaggtcgtagttgtgggtgtactgggaccgtgctagaggcctctgctggggagactgcagaggtgcctgggcaggctgtagtgtggggaggagttggggggaggaggtgggtccacccagagtgcaacatccactcaggtgagggaggggtgatgttactggaagaggaagcagccgtgcaaaggggatttcatcctgaaagcaatgagagccaatgaatatattttgattttaaaaagtaattttctaatctgttcaggtgtcatgaaaccaagagcctattctaagtgactggtgattctataccttcgtaaacaattaggaaatgagcatggtgtgtgtgtgtgtgtgtgtgtgtgtgtgtgtgcgcgtgtgtgtgtacgcatgtgtgtattttagggacaaaggcaaatgtgggagcatctaggtgaagacacatggaattcagaaccaagtcgagctatgtgttgcttgctgggctgcagttggctagaaataaatatgtgccctctttcattctgctttaactggggttcgggatttaatgtgcttgcatactgccagaagggccccctgcatgttgaggtccagggctgctgccccatctgggtctggaccctacctgttatcttgcttgagataaggagcaccttacaggcggagcaaagtcaggaggctctgcgcagtccaggtagcaaggacaaggggcctgcaaggcaccggaaggggcttacgatccctcctgcaatattcctactagaagtcacccctaacccagtgctttctttggtttcttttctggaatcgcacagaacatgctgtatgtaacaagtaatataacacttcccgggacagccttgtgaggtggtgtgagcttaggctgggctgtggtcctggggctgctgtgtggccctggacaagatccttaatctctctggccccagctaatgcctcaataaagtggagatgacaacgtagagctgtctgcttaacgagactggacgaaatgacagaaaggaaatttgctctgtaaactagaaagcaccgcgcaatggtggtaattatcataagctttattgcgattttatggggaataaacaaacacgaggcccaacacgacccgggcatcttagcccagacacagtccagtgccatccaaactccgcggcagacgccggctgcgggcccctgggtgcttgggtcccgggatcgccggggaaggcagggaaggaggggcagctcggcccgggacatcgcgtgggtgaagagcccccgccgctgctcggctcgccccgcccccggggcgggggctgcaggctccgagcgataaagcgcgggcgctgggaggcgcgtggagccagcggagctgcgcctaaggagccgggccatgcgcgaggggctgggcgcggcgtgcgaggccgccgggccccggctgtgcaggctgctctgcaggatcctccggccgaagcctgactgctgcccgcgcagagccaggtaccccgcgggccgaagtccgccctgggagggaagcggtgggctccgagcccgggcggggccccatctctctctgggagaaatcggagggcggggatgtgcgctctgtgggattcctgagggtttactaaaagcgttttcctcttttagaacgcttgagaggtcgcaattcaggagcccaggcggcccagagaaaccccccatgcactatgagaggcgtctatgcgggttcagttgcgctgcgaatgtttcagcacttgggagcttttgaaatttttcagcactggggttgaaagttgctacactctttggatcaaatatggttaagagagcaaggaggttcttgtttcacaaatgagatccatttcccagggcgccatcccccccaccctccccatctgtccccaccaccactcttggtgtaaggcgaggtaaacaggcagggaggcgtcggaaccgcaggggaatctggcccccaggtcagcccaggcaagccacagtctgcagctgtgaccggctcggctggtcaagggcttgtagaaagttctgggtctaagcaagccaccacactcacagcactccccacgcccccgacccctttttttgatagggtctcactctgtcacccaggcgacagtggcgccgtctcggttcaccgtagcctccacctccagggctcaggtgatcctcccaccttagcctcctgagtagctgggactacaggcgcgcatcaccacacacttggcaccttttttttttttttttttttttttgtagagatagggtttcaccatgttgcccaggctggtcttgaactcctgggctcgagtgatccgcccacctcggccttccaaagtgctgagatgacaggtgtcagccaccgcgcccagctgccagcactctctttgaatgcaggtccttgagggtcctcaggaccccgcacagctgtgggtttagtcaaattgcacgagcgtctgcggggtcagaatcaacaatgtgataatttggaaagaagtgtccagattctgaaggtgctcacctggagtctggtcaccctgtcaccctgtctcccagcagccagccagaagaaatggtgtgggaggggacttgggcaaaactttgtttattcatttttcaaatttaaagaattgtccaattatgaaaggaattcattgtcactgtaaaaagttggaagatgtggaaaagtataagaaaagttaaattgcctatgatcttatcacttaatgctagtcactgttaacatttactaacattccctcgaggtgtttttctgtgcttgtacgcacacacacacacacagccagcatcagactgtgtatacagtttaaggcattatttatatgagggcaaaactagacacagtctaacatccagccatggacaatgggaccaggctaatcgtggcccatctgtagagtggatttttagccaacttttaaaagtgatactttttaatatatggggtaaaatgattatgttaaatgtacaaagacattgcttctcaatctaaacagtactgtagatgtttctggtctgaagcttctgaaattgtccaactctacttccagaagtaagtgagaggaagcaagaatgggtgcagggtgggtgctggggtgagggggaatggcaaaagagcaagaggggcagttgtcccctggggaccccatcccccatacatcttcctattgaagcagccccatggtgactgctcagccatggcttatctgttctgaatatccagattgccatatatatatatatttttgttttgttttgttttgttttgttttgtttttttctggcaggccacaccagtctagaccaggtgtgttaaagaaaaaagtattcaatgatacttgttaaagaacagtatggaagtctttatttaggaccatctcaataggtacagggacctactgcagtggggtctggcagtggaggagagagattgggcccaaatccaaatacagcaggagcaagtgggaatttatagccaaggatcagggtggggtctgtggatggaaaattaccaagaaaaacttcaggcatagggggaattctgcctcacccaacctaacaggattcttgcttaggacaggctaaggtgatcagacatcgcctgggggaggatggaggatgaggaccctgatcagatggggaggacgacaagctatcaaggatggagggttcttgttaaactgactaagtagggattcttttgctaaaactgcatttttacaaggaaatgcttggatgggccccgcagaagattcagaagtctgagtaaagtttggctaagcaaagcatctttgccagttggcaatggttggtcacatggaaggccctttacagggttgtggaatcccttgattcagatataagttgctttctgatacatacttacatcctcttttaagacagtatctctttatagtaaaaaatcacttactgctactatgtaatgtatataattaatgatataatggtaacatatagtcatttttttctataataaaagcaatacatggtcatttatcgcatttcaacatcatagatacatatcaagtagaaaatgtgagaccctcataatagtctctaaccacctctccctcagatgcacaagcatgcataccctggaaaatactgccaagaacatggaacacaatatgctttcaaaccaaggtgccctggtgggatgattcttcctaggggaggcatgtgtgagtggtgactattcagttcgccggaatgaacctgaaatcccaaaccaggacaaacggtttctgaccggtttcagaatactgaatttttaagtaatctttaatttaaaaaattactttaagtaatgtttaatttaatttgtaagtaatctgtaatttaatgctaatttttacaatacttgtttttaccttggtgaaggtaagttgacatcttagatttgttttaaaataatgatgggggcagggaaggtataggtgaaacaagatcggccgtggattgatcactgttgaattgggttgaatctgggtgaagggcccatggaaggttattagactattctctctacttttgtacacttaacattttctgtaatagaaatgtagaataagtaaataaaccaagataaatcacgtgttttaaataaagcttaagtcatgaaaaacaagtggctggggctgggcgcggcggctcctgcctgtaatcccagcactttgggaggctaaggtgggaggatcacttgaggccaggagtttgaggccagcctgggcaacatggtgaaaccccatctctaccaaaaatacagaaattagccaggtgtggtggtgtgcgcctgtagtcccagctacccaagaggctgaggtgggaggttcacttgaacctgagaagtggaggttgcagagagctgagatcatgccactgcactccagcctggatgacagtgcaaggctctgtttcaaaaaatataaatcaatcagtcaatcagtcaaccaatccaagtggctgctgggcagtgctgctagtctgggaggcagagttgttggagccattctctgcccacccagcccctgtgccacgtttgtacttggcttttccagagggtgaaggagcattttccagatcctctatgggctgctgtttgggccagtagctttggctcagctctgctcatgcccttttggctctgcgggaggaagaagataagaggaagagggaagatggggatggggaggcagttggtcagaccgaccatgaacaattcactcccaccctctggactcagtttccctatttgtcaaatgaggttactggcagagggaactccaagatgcccctccacccttggataccgcatctcatgctagctgtttcctttcacagtccagtgacacaggatgaccttcagtatcacaacctcagcaagcagcagaatgagtccccgcagcccctcgtggagacgggaaaggtcagtgagtcacatgggtgtgggaagccccttcctccctggtccaggcagatgcagacatagcagcctgttagagctgggctggagagggcaggaagccagggtttggatggagagtggagagtcccagacccggggtgttggggggaacaggtgggaatgaggaagggctttgggagagtgagacaacccccagtggtcgggagtggtggcccccaaggtgcactgacagctagcttctatctcctgggttccataccattctagagaggtgggcagagaaatgggtaggagtgggagagagggtggcttatatgtccttacatgctcccagggaaggaatgcagtggtgcctttctgttctcagtagtattggctctgacagtcatccttctcacctccaacttagtctttagtccctcctacagcagttcctctgaggaagcatttggcaaggccctgggtgaggagaggaccctggccagtggcccaggcacctggagctcttagcaggcactggcccaggtcgcccgggggctggaaacagaggagggacgtggagggacaccctgccctgtgtggccacccatagatccttccccactctaagacaaggcagggcctggggtctaggagagacctgagagaaaaccctgttttttccccttgcagaagtctccagaatctctggtcaagctggatgcaaccccattgtcctccccacggcatgtgaggatcaaaaactggggcagcgggatgactttccaagacacacttcaccataaggccaaaggggtaagtctggggcttcagggagaaccacctttgtcccaagctggtgaagctgccagggctttgtggatcaaacaggtgtccccctgggcaaaccaaacaatcatctgcttgggcaaaggggtctaggaacagagacattcctcacagattacagtaggaagtaaatgatgccaactccctgttaaccaccccagtaaataatggataatccagaaggtcaaataaatgattgcagaaacaaattcatatctttcttagccggatttcaggataatgtcagggagaattttctaacagaactgctcagagctggactgtattacatcaggaggtagtgagctccctgtcactggaaggatttaaatgcaatttgatagattgcagaggggttcaagtatcctgtgagtggttggactaaatgtcttttcaggcttctttctgtcatgtaagtttttaattctaacttcaggatacattctatggttgtaaagtgggaaagaatggacaatttcaggaccatgaaagcaaaattatttcccacatgcccccaaaccaccacagttaacattcgggtgtacttcattcgtgtgtgtgtgtgtgtgtgtgtgtgtgtgtgtgcacgcgtgtgccttcctatgtctcatttcagtttgttttggccaaataccaatatcatgttcccataggagccatattggattgactttgctctggatctggagctggctggggagcagggccagagactgagtccggagtagggagaaaaacctgactcacacccactggggttcagccagtggaagagaggagatctaggtgggagaaagccaggtggaccccaaggaggaggtgccacaggggtggagaagaggtgcagggagccggagcagccagagaggagccaggtggccaggagagctggccccagaggagggtggcaagaggccgaatggcccaccctcaccacctgcctctctctttccagattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagagtaaggcttgcctcctgcagggtcgctgcctcctgcccttcctcctgctctcctgtctctacccatcaccctctgatcctagctagatcccttttctttccagatttgtggtgttaaatcactatgattttgcagagcgaaaatcacggttttctaggggagaagaccctggagcaggttctcataattgtgggataacgttgtacatagcaataccagttaaaagtgactgaattcgaaccctggctcccgcattgtgtctgaacgtcctcatcatattaatggcaaaaactgcaactacttttgcaccaacctaatataaaatggggataataacagaaggtggctcatgagatttttgtgaggattcagtaagttcagaacagtgtcctggcatccagagaccttgattgtgaattaatatggaccctttaattatgaaatgtttgagacagaaaggatctctgagaccacctagtcaggcccctactcctacaggtgtgaacatggaagctggtgacatacctgaagtcacctcattccagctagaagccaggccacctgactaggagagggcaggccattgctctttgccctgaccctggtggggttctacatttctggagttctcttcttttttctacccagtgaggcttccctgaggaccatgctagacatccttcatttctatggccaattggtcatttggttgacagacacacatcaggcactgagtatgcctcagccttgtgtcagacactggaatacaaagatttttaattgtcatttgccaattttattgccaacgtatacaattttaatcatccaaagagaggttgtatagcattgtggccttcccaggttcaaatcctagctgtgccccttacgagctgagtaaccctgggcaagttactttgtctctctatgccttgattttcttaccgaaaatggtgataataatagtacccaccttgcaggaggagggtagttggcgggagtttataaagatgaaaggagttaaagaatatagagctaggaacaatgcctgggccacagtaagcacgacataagtattagccattttcatgtttttagaacactgcgttgtccaaataaaatatgtggctatgtaatttaggcccctttaaaacttttaaaacaaaaatgcatgaagagattgtaagaaagaatgtctgaaagaaatggattgttttctttttgtttgtttgtttgtttttatttttgttttttgagatggagttttgctcttgttgcccaggctggagtgcagtggcacgatcttggctcacttcaacctctgcctcccgggtttaagcgattctcctgcctcggcctcctgagtagctgggactataggtgtgtgccactacacctggctaattttttttttttatttttagttgagatggggtttcatcatgttggccaggctgatctcaatcccctgaccttgtgatccacccacctcagcctcccaaagtgctgggattacaggcgtgagccaccgagcccggcccagaaatggattgttttctaggctggaaggggagtgttgctattaggggagagcctcacacagcactgcaccacacaaagtgagccacagacatgtacctgggactccctggcggaaagagtggcttctggtggtaccacctccacttttctttggcttttttttttttttttttttttttttgagactcggtcttgctctgtctcccaggctggagtgcagtggcacaatctctgctcactgcagcctcgatctcctggatcaagtaatcctcccaccacagcttcctgaggagctgggaccacaggtgtgcaccactatgcttagctaattttttaaatttttagtagagacagggtctcactatgttgcccaggctggtcttgaactcctgagctcaagcgatcctcctgccttggcctcccaaagtgctgggattacaggtgtgtgccgctgcacctggcccacctccagttttctacaaccctagaatgtctgagctgggagggaccgtgagtcttcagaagaggccctcatcttccagggtcggtggtcctcaaccctggctgcacagtagacttacctggaaagcctgcaaaattctgatggcagggtcccttgagccaagggcagcagaatctggggagatggggatgaggcagacatgtgtgtgcttcaaaagctccccaggtgattctaatgcacagcctggattgagcagcctgttaggggctgcctgcttcctgactgcaaacttcacaagatccttggcctttcagctcggttgttaattaatgagcctttcggggtccagggattttcctggatgggtttcattgggccacagtacttatgttatttatttatttatttagcataaagcacgtgtgcaccatgacactatgagattggtattattgttatcctcatcttacagacaaggcaactgaaatccacagaagagatgtaccttgctcaaagtcacacccttcgaagccccagagtggggattcgaacctaggcagctggtgcctgagcccttgcttttcccatcaatgctctagtacctagctgtgtggccttgcaggttcccaactctattctggacgtgggaggccttgctgttgtgtggaaggcaattgggcgggtgttcagaagcccagcagggctacagggccatgcttggtggtgttggaacccatttgcttctcccagaggaaaattgtatttttccaagtcacaagtacataccttgaacccctgcttccctgagcaagagatcctgggggtgtgaacggggaatggcagcctctcctcacagggaccctggcaatctaagacatgaccagctgagcaggttcagtggccttttgtatctgaagaatcatagcatatttagagattgtgacttgctgcatgttacatttaaatctgttcactgatgatgaaagccactcctttttttcagagctcatagacatcatagcatttctaatgccttagaaaatgactatatgaaaatggctatcacatctaaaactctgaaggaattggatgtgaatgtaaaaaataatcctttcttgcatatgcacgtgctgaccaccatgtgtgttggtggtgtgggtgttatggtgatcattactgttgtcatgctcaggtgcagaggggggaatattgctggaagctttgtttggggagggaggtctcccagcagtggggtggttcccacctcacccagcagctccttatggcaggggtgtccttggggataaatatcatcagtgttttgtctttgtgctttttttctctaatcaaggaaaagttgtcgagacactcttcatccacagaaaggccattttgttcagagttacccactctccttaatcaggagttcattctttaaatagttttgatgctgtttcaaaaggctttggtgctgactggaaatctcaaggttgttgttgttggtggtggtggtagtgtgtgtgtgtgtgtgtgtgtgtgtgtttcaaagcctttctgactgagtccctccctccctttgggatatttttgaagtctgggaggggaggagagaagcaagtttagaattgcatatggagtgactgaatgagcaattctgaggctgaggaacagcacggtttagagagactatgacgtgggcagctcttttctggccaggccctgggaccctgcagactgagctccgatagccaggtcccagtcctggcttgaccaggctcctgagaagggtgggcaggccctcaacatctttgggcttactgtccccgtagggtggaagatggaaggtcacgttgctgacagttaagaacctgggcttggcatcagggcgacctgggtctgagtcctgactttgctctttcctgtacttatgttcctgggcctggtgcttaacctcctagagccttgagatccttggctataaaatagatgcaaaaatacctccctcccagactcagtgagaccctgcctgtgggttgcttcacccagtgcctggctcatgtgggtacccagtacaccggagctgccacggagggactggctcatctctcagtcatggcaaggaaggagggcactctactaactaatggagaggcaggacattgctatggctggatgggacactcctcccaggcttgcaagtgtctgagaaggattgcaccccttactgagatgaatatgattaaagaaaaagcacctgaaaataagcagtgttcccatgggctcaggactggctaggtagtatttataggactcaatgtaaaaatgaaaatgtgggctctttattttaaaatgattaagaatttcaagatggggacagcagagcattgagcgtggggtgcttctaggctaagtgtgaggtccccaaagccagccctggagggagctgtctctggtgagaggcatcttgcccttctgatgtcctatttcagttcctgcttctgtggattgaattaatccccatgtaaggccatctcattgttgatcttcctgctgtcttcctgtcccccagggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtgaacttccttagacttgagcgggagagagctggaggcggccaggccctgagcagatggcttggaacagccacacagagctgtgcccaggcctcctgggactgaagccatggccctggatcctctcttacattcccaaatgttgagatggggcacctagggtccctctctagaagccttgaatcctgtttcagcaccagggtttctagctgcccattctctattgtgttaaattcaggagactaaatgccatcattagagtaaaccacgaccttgtttttattacacttgaggccgtggtgctgcaagatgtgttgttttcctccaatgcttgaattcttggctccaagagaacattttatttagcctagcctcctaggccatctttttgttggggagtcatttgttgcaggataatatcaaaagcacttggacagagaaatcgattagaactgccagtgaaaccaactctggctgtgtagtatgtgctggtgtgggaaaggacctagcctggggctgtggcaatcccgattcatggtgctttcaagtcaggttttcttggaattctgggtttgctggggtcttctgagtggggttgcctgtgctcccctagagggcagccatgaaatgggagcggtggtgcagatgggaggctgaattcttctgcatggtgttgagtggcaggtgcagattggaggctgcactcttcggcatggtgttgagtgtttgtgtgttgagtgtttcggctgcactattgattcccagtgacttctgatcagcctcaaagcctctgtctacccagtctttgatgggcatggtctggatgggctgttgcaggtcttcgatgcccgcagctgttccactgcccgggaaatgtttgaacacatctgcagacacgtgcgttactccaccaacaatggcaacatcaggtcggtgcacgtttcccagggctgcagaggggcttgccttgcctgagaatcttagccaaaagatgcagcacttgggtctaggggaggcatctccagctccaggagaaaccagggagaaagaaaaaagagaaagactcaggcttcttcggggacttccagtagtgagcccagcccctgtgagctcagctcccatcggcaacccatgcccttggtttccttctgatgtggagccacttggaggggatggaggatctttaagaagtaactgcttcactattcagggttggggctcccattttttagaaggcatgggacattaagaggttaccttcctctcccaaccaacgaggtcaaagctaataggactgaacagctcatttggtcattcattcatctttttgttcagcaaacactcagtgcctacctaatgcaactcaacacaggacaaggctgggagagcagggggaagatggggtatgggggggtaggaggaagagtgactaggaccctaagatgctgctccagctggtgtgagcctatgacctgcactagacaggcaaccagctaactcaactgcaaggacggagacataggcagtgagggaaagactggcagatcagctaaccctgcctgatggatgggaaggcccccttgagggggtggaccctgggtcttgagggagggcagcaggagaaggcatgtcaggaggctggctcagtcagcttgggatcaggggctgcagagcaggtagggtggagagggaggtagggccagtgcaggatggctgggcccccaccagggctaggtggtaaacagtactgttcctgtcctgggaaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcaggtacccggcccagcctcagccgccggccattggggcggggagccccgtggtgagcgagtgacagagtggagcccagaggagacacgcagcccgggcttacagactcacagggcccgtcttgttccccagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaagtaagtaggctgagggtgctgggggcaagggcgagtcaacacacagcccttctcctttcctaagtgcggctccagccttccccataccttccctaaagcccagccagcagcaggtgacactcagggggctggccttcaaggactcttttgtcactgttgcattctgcagccattctgcactggcacctcgggcctcagacaggtggatgtgttgatgctgaggggaagcagaggcttaggcggatggggccccaggagcttgagaagcagtgactgcaggagaggaatgcattgagattctagaaaggagcagcccaggcctcttctgccctcctgccaatgctcttagctgtccctctcctgtcgggatcatatagggctgcagtgacttcaagagtcctactggcccagcccctgctctaggcagttctcataattgcaaaaatacctctgcgtattgagatttactctgtagcagacattgggctgggctcttcttcctggccgttgaatgaaccaaattcagtcctgactcacagcctttgtactccctgttccctttgcatgacatgccttttcctcagaatttttctaggctcatttcttcttgtcaaaaggtatttcctataatgtcacctcctctgagaaggctctctgaccactcaagctagaggaggcccccttaccctcagtctaacacatcatcttgtttttatttcttatatatttgtttacccatttataatctagagtctagacattagactacaagttccttgagggtggagatcttttcttttctgttcacaatgtatacccaacagctagcagagtgcctggcacatagtaggtgctcagttataaatatttgtggaataactgaatatacaagtgaatgatattactagctttataataattccatgaatttgatgctatgtttctattctgataatggggatgttgaggctcagagaggctaaaaaacatcccaagttcacactgctagtcagaggcagaacttgaaccccagctttctgacactggagtccttaattgctctgttgtgttgcattctcagcatttagcacagagcctggcacatacttgaagcttaatataggtttgcatgaatgaatgagtgcatgaatgcataatttaataaatggcatcctatgtgtccaatacgtctctctggctgggattaactcagaatcaactcttggaaaggagttttcttgtttgactctttctgaagcttttttcttggtgggcaggtgggggggtcagtgggaggccaaaggtgcaaaagtgaagcccccagcgccagacaaggtagttcacacctgtaattccagcactttgggaggctgaggcaggaggattacttgaggccagtagttcgagaccagcctgggcaacatagtgagactctataaaataataataataataataataataataataataataataaggaaaaaaattagctgagcaagatggcacatgcctgcagtcctagctacttgggaggctgaggcaggaggatcgcttgggcccaggagttaaaggctgcagtgagttatgattgtgccactgcactgcactccagcatgagcaacagagcaagaccaagtcactaaaaaaaaaataataataaaataaaaataaggaaggccccagttaaattgtgtctacctttttgccagatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgatgtccagcgctacaacatcctggaggtaacccagccagcccagctggccagatgaaggtgtgggcctgggggtggcttcagggaccgactcgccgctatcactctgcctctgtaggaagtgggcaggagaatgggcctggaaacgcacaagctggcctcgctctggaaagaccaggctgtcgttgagatcaacattgctgtgctccatagtttccaggtatgtctggagttttgtgagtctgaagactttttggtgagaagcttaactgatccagtgacttatgtgatgcttaatttataagtaagcccccttgctcactctagaggtccagcaacaggcagctcctcacctcccaagactgttcaatccctgtacttgagcactgaattctgtcctctctcaatcgctcaaggactttactcccaaaaattttcctcttctctctctgtatcatcaatgtctctctctctgctgagtcattcccagcagtgtacagacaggctctcttagccccatttcaaagaaagaaatgaatagctaaccacataactcctgccaaacctcaggctccctccagccactgcctcacccttctgctcctttctacagcaaaactatggagagatctcattgtgcttcctcatcccccaactgcttcagcctggctgggcgacagagcaagactccgctcaaaaaaaaaagaaggcctccctgaccgtgccatgtaaaatgacgccctcaccccactgccaacctgtctctctgtgttagtcctttaaccattttatttttcttcaaaatacttcctcatacagttcctggcattatataggacatcgactttcttctttcttttcctttttttttttttgagacatcatctcactcggtcacccaggctggaatgcagtggcatgatcactgcagccttgacctcctgggctcaagtgatcctcccaccttagcctgccgagtagctgggactacaggtgcataccacgcttgcctaatttttatatttttagtagagatggtgtttttccatgttgcccaggttggttccgaactcctggcctcaagtgatccgcttgcctcagcctcccaaagcgctgggattataggcataagccacggtgccgggccagctttctttattgtttggtttcctccactagaatgtaagctccatggggcagggaccttgtctgtctgtttgctgctgcacctctggcctagaagagtgtctggcacatggtagatgctaaaataatttgtctttgaagaatgaatgatgagggccacatccgcgatctggcctggcacaaactgggtcttcagtccttgtctgacgtgtgcatgaatgagtgatgctgggaggggacctatgagctgtggctgctcttgcttgctgtgcgaggatgacaacctccacctcctcttaagcccacacacagccgctgggctcctgtgtagggctaagccctcaggcccatccgctgctcttactcatagaaacacttcccttccctgtgggaaggaggcctgagatgtaggaagatactactttagaagccacagccattgccacaaagctgacagatgccctggagaccccaccactggtcagtcattcattcattcagcagtgttttactcagcatttgcctggtgctgggcactaggctgggccaaggatgtgagtggtgaacagagtacagatgagcacacactgttccccatgactgggtcaccccataggcagatcaggcctgtgcttgacgggggaggggaagatggaacaggaagagccccccggtgtttcgggaagggctggctttgcaccacacatcctgactcctggggactcccagcaccagccctgatgctggcaggatgtggatacgtcccagaaaatctgtgagcctctgctgtctcctcaccgtggctgactgtgtccttccactgcctgagcgtctccaggacttcctcaccaccctccttcagggtaaacttcaaaagatgggcccttgtttcctcctctgtaaaatggggataatagtgcctccctcatctgaggattataagagttaagtaaaaatgcatgcaaaatgtttagctgcactgcctggcccatagacaacactcagtaagcaatgattttcttactgtttattatgttgtcatcatgatcgtggctaccactgagtttttttttttttttttttcctttggagatgaactctccctccattgcctaggctggagtgcatggtgtgatctcggctcactgcaacctccgcctcctgggttcaagcaattctcctgcctcagcctcccaagtagctgggattacaggattgcaccaccatacccggctaatttttgtaattttagtagagatagggtttcaccatgttggccaggctggtctcaaactcctggcctcaagtgatccacctgtctctgcctcccaaagtgctgggattacaggtgtgagccactgcacccatcctgtagctaccactgagcttagaactgatctggctcccaggagttgctgtgtcttggaagaataagtgaatgagagcccacgtccacaagagtggtggccggacttttatatacacatatataacttatgtatgtctattgaatttacaaggcatggctggccttcccaggcctgacaccagctggatcctctcatgcctccctgccttgactcatgcagtgccccactcaactaacttgcacccctctcacaagtctcccttcctctcaggagctgctcccgaaattcgccaactcaccctgggcctctgtctggcgttgtatcctctcttctgcccttccccagcacctttgcctgcctccatcagagtttctatcaggccgtgtgaaaatgactgattttccttggcttccccacccagttagactagactctaatgcagagaaagggctgtgtctttcccttctataacgccgatgccttatgcagtgcctggcagatggagattataagagcagctaatatttattaagcacttactatgctttgcttattccagcttattgcatcctttcaacaacctcatgatgtaagaactttttttttggagacaaggtcttgttttgtcacccagactggagtgcagtggcccaatcatggctcactgcagccttgacctcctgggctcaagcaatgctcttaccacatcagcctcccacatatctgagaacactggcatgtgccaccaaacctggctaatttttaaatttttttgtttttgttttttttaagacagagtctcgctctgtcacccaggctggagtgcagtggtgcgatctcggctcactgcaacctccgcctcccgggttcaagcgattgtccttctttagccttctgagtagctgggattacaggtgtgtgcctccaccatgcctggctaattattatattttttagtagagacggggtttcaccatgttggtcaggctggtctcaaactcccgacctcaggtgatctccccgtctcgccctcccaaagtgctgggattataggtgtaagccccgacagctggcctactaatttttaaatttttatagagacagggtctcaccatgtttcctaggctgatttcaaactcctgggctcaagcagtcctcccacctcggcctcccaaagtgctaggattacaggcatgagccactgcacctggccattataggaattcatatcactcccatttcacagatgagaaaacttaaagaactaattgctcaaggtcacatggcaaataaaaagccagagtttgaaccactgtgttaaacaaatgtctcttgactgaatgggttgccacagacatagaggccagtggctgccttgctggaccattccatggggtcagaccccacagcccgtaatttcagactgtgagtgattcgtctcccatacactacagttctcccaatgcttcagacctccccacggaggggtctggctccttcttggctgaggaggctacaaccccatggaagtgactcttagaactctccaccataaatggctgggatggtatttcctttacctgccaaaaggtgctgtggtttaagttatgcagatccagagagagccatttgctgggagtctggggagacctgtgggcatgagaggctggatattgccctcaaagacttaagggaggcccccatgggacctgtgggctgaccctgactaatgtgctttcttgggctctgtcagaggctccacaagcgccttccatttgggtgtttattttcagcaggcaaggagagggccaggagttgctctcccgtgttacagattgccaggccttcccaggcactctctgggagccctgcggccaaccggcccctctcctgattcccccacccttatctccactccctatcttgccttctgatacagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggttaggggccttcctcttctctccttcctgggggctcagatgtggctgtatgtgtgtgtgtgtgtgtgcacctcattgttacacatgtagggcacgacgggaagcaggagtatgttgttagagctttccaggccccactcaaggatgctgagcagcctttgtgcatttccacggagagtggcactgaaggaagtggcttccactgcaccgctagtggcctgtggctcagatggggggtctgtcattacacctgcttccacgggagggcccggcaacagtcactcagcagagtgttgaggggattggcccctgagtcagacgctattgattctgccacttcctagcaatagggtcttgggtgggtcctttcacctttctgagccctgatcttctcatctctaaaagggatgggcttcactccacgacggggggttgtgtggatcacaaagctggtgtatggaacagctcagcccagtgcccaatgcagaatgcattcagtaaccatgagctattgagaagagttcattttgtgccaaaaaggacttgggttggattttaagagcttccttcatctaaaggaagagcttcctccatctacaggacctcacatgcagggtgacggcatgtcctggagtcttgcctgttgtagtagcagctcttcttgctctcaaaggtgtctcggttgggactgtacattatgtcatctgcctgctgataagatgctaaaagcaaaaggagtgcagcctgttccttccaggaggacactaatgagaataagggttagccgccccccctcgatgtgcaggctccatgccgggcagtggagaggcaactctgggggagaggcagccacggccctcccttgtgggagttcagtgacaggggtggggcgcaggccagccttctctcccaggctcatgatgggtgtgaagggtcctctaccactccagcatccgcgagccgagccaagccaggaccccgccctgccctcacatctcctttcttttctgaaggtagaggcctggaaaacccatgtctggcaggacgagaagcggagacccaagagaagagagattccattgaaagtcttggtcaagtgagtggcagtggcagtggctagtagtgatgtgtgaactatatctctcccttctagtcagcctctgcctccagtccttgaagggcaagaacacaaggaatggttatgctttttgcttttgtttttgagacagggtcttactctgtcacccaggctggggtgtagtggtgccatcacagctcactgcagcctctgcttcccgagctcaagtgatcctcccacctgagcctcccaagtagctgggaccacaggtacaaacccacgcctgactaattttgtttgttttttttgtagagacggggtctcgcagtgttgcccaggttggtcttgaactcctgggctcaagcgatcttcctgctcagcctcccaaagtgctgggattacagatgtgagccacggcacccagcctgggaatgtatattcttcgtggaatttggctcccagaggtccagtcgccaattccaagggtcccctgctgccattgttccaaccttctctctcctcccttttcccaaaggggcctatagtagtgggtgaggggaggaaaagggtgagttgtcacggtacatggctggtgagaaacgtagcttgcttttccctcaacctgccccacattaaacgctgtcccctcccattcccctggtcccccattttcttctggaaggctgactcagcacacagcgcctgcctgtctgtctgtccccacagagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggtactggctcagtgggatggctgttgttttttctgcttgtgtgcaggggagtctaggaaaagttaaaacggtttccccactcctggatgtctcagagtcttggatgtggtaatgtgcatcattaatctggaagagaaggaaagacttgtgtgcagggattcccaaacttacacagtagatgagtttttcatggtgttctggagaacacagtttgagaaacactttcacaatgaatccaggcctcaacatacatcagctgctctggctgaactttattcaggctcactgaacacctgctctgcaggatgcagtgctgcatgtgaaagggggaagagatgagtaagcttcagataaacaaaaaaaggccgcagagggtctgtctaagctctatcccctgccttcagcactgatggataaaatccaactcttagggaatggtggccacgtgctggaccagccccgggctctgaggatctgacagtgggtggcgcagagccaggccttgcccttggggagctctccagcatacaccccaccctcccctcccagcgccctgcaaagcaggcgtcaatgccattgttaatgcacagaggaggaacctgactgttagacaggttgatgggttttccagggtcgcacggcttctgggagatggatgtgactctgaggacagggcacaggccagtgtaatgccacgatgggatgagctgtggtctgtgccacgtagaggcttaggccaagggggcactgactgatgaccaggtcggccaggttgctgaaaacacctcttgggtccaagcctcacctgctggctcccaggagtctggaactgccaggagagtggtggcaggtcccccatcctccgctgggtgggcctggatagaacagcaagatgagggcacatttccccggccattccctccaggcacagctgtgacctgctcattccaattttgtggaaatatttccacacacacaaaattgcaaatagtagtggacatggtgagaggcatttagacatgggaaaggcagtatttttgggacagatcttccagggcttgccaatgtgttaaccatagggcttaagcggggaaggagaacagaggatgatgtgttcaaattggttcattcacgtcctctgtgccacgcctgtgccgggccctgggagagacagatgagcacaggagccgcagcctgggggcagtgtgggaggaagcccagggtgtctgcgcagggtagggagggccctactgggagccgagggctgatgtccacttgggtgccatccaggttgtctgcatggataagtacaggctgagctgcctggaggaggaacggctgctgttggtggtgaccagtacgtttggcaatggagactgccctggcaatggagaggtgggtggcttgaggtctggctggtctagggggtggtagggcacgggaggacccaggaaagggtctgggggatgcggcaggtcctacggaggacatttgggagtcagtgctcaggccactccgggtcactcaggtcatttgccggcctccattgtaattattgccatatgggagtgccacctttcctatgacatatttaatatatttctgtgaatggcctacctgtttgtatttacaaattcatatttaaaggaaacttgtatcactctcacaaatggaaagcagcaaaacataaattcaatgaaaacaaaatgaagttaatgaattttagctagatactattccctggccaaggcctgctctttgtttgttttgtttgttttttggtttttggtgtgtgtttgtttatttatttatttatttacttaggtggagttttgcttttgttgcccagggtacagtgcaatggtgcgatctcagctcactgcaaactctgcctccctggttcaagtgattcttctgcctcagcctcccgagtagctgcgattacaggcacgcgccaccatgcctggccaattttgtattcttttttttaagtagagatggggtttctccatgttggtcaggctggtcttgaactcccaacctcaggtgatccgcccgcctcagcctcccaaagtgctgggattataggcgtgagccaccgtgctcagctatctttgtttttaaaaaagactaataggcaatgagagaggtattaaaggtctattagcaccaatatgagactgtctctccagtgctccgaagaatgaaaatgtaattgaaggggaataactaaaaaataaattatgaaaagggagtaaatactcaccatgggatttgacgctagttctgctgggtcacatacctcctggaatcatcttggcttcctggaaagccagccttatttcagagactgtaggaccaattgttgttgcttctaccgggttccaaacagaatcacggcgcattcggagcccctctggagaaggcatgctaccaggcaggcccctctgccagggctggatgggtgggggcccagctgttccaggtcccccattaagaggcagggcctacacaagttgctacagtttagttggagtgagagacaagctaaacttgtcagctgacaaccaggtccttggccaggtagccccatatgtaaaccaacttccgtggtgggctgtgagccttctcctgcaagctgtggccaggtttccagaagaaaggaaaaaacagtgtttttattcatcctggcttgagaactctgtcattccctctctttctagaaactgaagaaatcgctcttcatgctgaaagagctcaacaacaaattcaggtaaagctttttccgttgtcctactcctagccctgccctgtggacccaaagtctgggttcaggggatggaactgggtgtgcacagggggtcttctcagaaccgtgcaggcacagagacctgggtctaaggtctgtactcagaatgtgtcgagggtcaaaccacagaaaccaagtccctctcacaggtctgcaggccaagcatggggtggtcatgggagttggtgacaaggctgggggatggagaggaccagaagggggtccagctccattctccagctggagggggagagtctggggctggctctccaggctgttggtgctgggtgctgggtgccaggtgctgcttgcatgggacatgtgtctctgtgtgtgtcctcgggcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggtcagttcccagccagagctgccccacagcagggacatgacagggtgcattcatgcctaggacatctgtgctgggcgtcccaggtggcatgacctctgcctgtggtcctgtagatgtggtcccaggcatgggccagggccacaaacctgagggcttaggtcactgctgctctccctcagccccctagaagagctccaccttgtgcacacaactctgggggagaaggtggcacagatacccccctgcccttagggagcttctagtttaaggtctttcctccagtgactacctaggtcacctcttaactactgtgtctgtttcagtctcacagccatagagagcctggggacaggcaccacacaatggcggatccactttggatccactcagtatctccatagctctttattgctgtgattgccccagtcatttagggaactcgtcactcatgcagagcgtcactcagcggtggtgcttaggagcatcagcttgcatcggggcaggcttggttccaaagcccaggcctcctccatgtggctccacaccaggaacataagagcaatcagacctcttccagtgtgggcatgaggatacaacaagatcatgtcaatattggcattcatagtggtcgggcacagtggagcatgcctgcaatccaagcactttaggaggctgaggtgggcagattgcttgagcccaggagcttgaaactagcctgagtaacatgtgaaacctgcctctaccgaaaatacagaaaattggctgggcttggttgtgcgtacctgtagtctcagctactcaggtacgggctgaggcgggaggattgcttgagcccaggtggttggggcttcagtgagctatgatggcaccactgtactccagcctgggcgactgagtgagaccctgtctcaaaacaaaaacaaagcaatatttataatagtagcaatagctactatgtgccaagcccagacacctctttgagtccttgctgtcaccctatcaggtaagtgtgcttcgaagttacacgaaacacacggctcagtgtttggcccatggtaagggcctaaaaagtggtagccccagtggtggggatgctgctgctgctgaccattaaccgcagtctgctccaccttcttccaggcagcctgtgagacgtttgatgtccgaggcaaacagcacattcagatccccaagctctacacctccaatgtgacctgggacccgcaccactacaggctcgtgcaggactcacagcctttggacctcagcaaaggtacctgcttctctgcagcacatggggcttgtttgtgttggggtctgagccctaagcccatggtcaaggagacccccaggtctttctgaacagagacagctggcctcggggcctccctctcactgcatgcaagagcctgttagggcataatactcaaggtgctgagggaggctgtttcaggagggagccccaggagggtggtggagacagaagggatcagcatccgccaagggcctactgtgtgtcagacactgtgcggggctcctggcccacatgggctaagtgagcctggacactcctcctgggagaaaggcacagatggagaaattgcagttcaaggaggtgaagcaagctgctagcctgtggccatgttggggtctgagccccagccttccagctgcgaaggcagccaagtgtcgtagagaaggtgtcacagaggcgattccaggctgtagtggtgaactctccactctgcacccccaggtgctgtgccctgtgccctgtctaagatagtcctgaaggtttctgcatatttaagatatccccaatgtcaacaatgctctcctgtggatcccaagccatggagatgtcccgggactttccatttttaggttcctaaattgaatttcccaacacctagaagcaacacttagaagctgccctgtatcagatcaaggagcttttttttttttttttttttttttgagacggagtctcggtctgtcgtccaggctggagtgcagtggcgcgattcccgcttactgcaacctccgtctcctggcttcaagtgattctcgtgtagctgggactattggcactaccaccatgcctggtttcagtatgttggccagtctggtctcaaactcctgacctccagtaatccacccaccgcggcctccaaaagtgctgggattacaggcatgagccaccatgcccggtctggaccaaggatctttatttgtggaataaaaggaagaaaaagaaaaacccaacggccacctcagcaggatgccccaagggtggtgttcagatgtcactgactcagacatctgggggcttcccctacctacgctcaagaaccactttgccatttcaccgtctctgtgtcctccacagccctcagcagcatgcatgccaagaacgtgttcaccatgaggctcaaatctcggcagaatctacaaagtccgacatccaggtaagggaaagtgcagggcttcgtgggtgatactctgtcgattttattttaacgaatgaaagatcagaagaagtcagtctttgaagggagaggagaagagcatatgctggcattagcagccacactgtcggtaggaccggcccacctggtaacctgcggccacctgtgcttttacgtctactcttggttaaccacgagccacttttccagcttggactctaagcatctgctccacttcctctccttcctcattgaactctttcactaaaaggagagtgcaagagagacttaaactgtttgattcattcttaagaactttcaggaaaagtgttggcagggaaggaaatttcccagctctgggaaagagccttgtggattatctgcaggtttcattgatctgtgctgtcctccccgcatgcattaggaaaactggccttggttctaataagaacagggtttgtcctggcaacaaggaaaggtttcttctgatatccatgtatgtccaaggcggatgctttctttaggcagaggctgtagccaagccctcggggggctccaagggctgctgggaaggggtgggcccccctcctccccagagggaagctcctggggccctcttaagcacccctgcctgtggggatgcctcatcccaagctcagggtggtggcctagcttgtggaaccagccaggaaaatgaaaggagggcacatttcctggggaatctcgcctgcccatcaaggagccctggaggaaatcctgcaatgtcacctgaggcttcattttccttccccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggccctggatgagagtggtgagtcccgggctagaaagccagtgctgcctggcaccctctggccgccccacctggctgaggggctgagcctgggcctgccggtgacagccatccctgtccttcctgctgagagggcgggccaccaaagcttatgtgaaagcagctgtggaaacagtcccagcccataaggcatggccccctggccttagtttccctaatgataacatccccctcaatgcagtggccaaagtcagaaagtgggatgagctgggtgtggtggctcacgcctgtaatctcagcactttgggaggccgtggcgggtggatcacttgaggtcaggagtctgagacaatcctggccaacatggcaaaaccccgtctctactaaaaatacaaaaataattagacaggaatggtggtacatgcctgttatcccaatcccagccactcgggaggctgaggcacaagaatcgcttgaagccaggaggtggaggttgcagtgatatgagatctcgccactacactccagcctgggtgacagaaactccatctcaaaaaaataaaaaagaaagtgggatcagagaaacagagcctggcagtgacccccactgtccaggagaaagtgagagaacctgagacgtggggacgacaagacagttgcccttgtgactgtagggtgaaggatgtggttcatcaggactctgttccagaggagagaatgtcaggctcttatttttacccagtgtttacaaagcatctgtgtaccaggcacggcaccaactattatggcacaatttcattcagtgctcatgccaacccagcaagataggttgtgctatcagatctgtttcacagggagggaagccaaggcccagaggcttcagtcacctcagaagtggggagccagggtttgaacccgtgtcttctggcaccagggtctgtgctgtgactgccctgcatgctgctccctgggacttccctttgggctcatctgctcacccagcacatcttggtacagcacccaggggactgcagtcatgggcttctctctaagtgaacaactggcctgtgaggtatccattagtctttggtggatttagtcattgtgagtctgtagatcaccagtgagtgtcttgctaaagttcaggtctgggccagagaaggacgtggttagtttatcaggaccacgccaacttactgcccctttgggggctggtgatcagccttccctggcagtcctttctccatgcgccaccttcttcctgccttttgctcttagagccaggtctttagagcctcctttcccctgcagctggagaatagagggtgtctgcctgggggcctcgctacctactgagaatcctgaatggggcctcttttccatcctgacaccttccttccccatccaggcagctactgggtcagtgacaagaggctgcccccctgctcactcagccaggccctcacctacttcctggacatcaccacacccccacccagctgctgctccaaaagctggcccaggtggccacagaaaagcctgagagacgaggctggaggccctgtgccaggtgaagatcagggctggtgggcagtgggggtatgtggggggtcccagcatgtggggagccagagtccagagctggttttaactttcaagagggatccacaccaggttcccaaagtgagacttgtcaaaggctggtgggaagccaggcatcgtccgctggcccatgtctaggacacagttgtgttgagtgaactgaatttttccaagtgtctgcaggatgcaaccagagtgcactgccttgaacattagctaggaaggggagccgcccttatccgtctttgctttccccaaaactggaataaacttgtcacttaagatgtattgggggatggatgatgtggatgaatggataaatgggcataatgggcagagtgacagatggagagctgaattaataagttaatgagagaatgcgttaactcacctgcaactgtctggttccaagtctttgcaaaaggcactggttgtcattattatcatcatcattatagctaattatctcaatttaagctacctccaccgccattattttgtggctgcaatgtactaacttggcacatgctttctcatttaattcccataacatccccacaagacaggcaatactgtccttgtttcacaaagggtaattgggacaagattccacagctagtgaggacacccagccaagatttgaacccaggtctgattggttccaaagccttgccccaaataaattacaataaagatttgacccctgcccatgagttgccgacagtggaggtaacacaagttagataaatgtactggactgagttcctccaggacaggcacttattttgtctcaagtttggtcgtctcagcaccatggacagtgcctggcacatggacttgtttgttgagtgagtgaatgaatgaatgaatactgggttgtgacagtcttttccccaaagcgggacaggcgccctgagtcactgacatcacccttggcttttagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacacccgaggtgagccaggggcagaggctctggaacagccccgctccgcccattattggacatctgttcatcaactcagattcagctccctcatcagttcaaggagggagggaacacccacagcccagagttgttaacagtattaggaggtgtgtgggaagagatctctaggaaccaggcactaaaccaagccttctgtatgtatatgatcagttacattgtggggtaggcactgtgtgcattttacaggtggcacagaaagtcacactgttagtaagtggagagctgagattcagacctggatagtctaactgctgagtccaagtcctccaccactccactgtcccactactcttgggacaatttaatgagatcagatgtgaagagcactcaacccttggtaggaggccagtggttcttagtcttcccaatcatgcagcctgaacgcaggggagattctgcattgattattcattcactcactcagctattcagtgggtgcctggcactggggtgggtatggaaatacaacagagatcagccctgccctcagggagcatctagaggcggcagtggagagataggcatagaaataattagatgattttcattgtgctgaagccaagaaggaaaggtcagggtcactgagggaagcagagcagggggtgacgctgccatagagcgggaggccaacatctcgtccaggtggtctcggctccaccactggccgctgccccctgccctgccctctgtaactgagcattgcctgggttggcaaagctgggagctgcccacacttccgagccctctgtcctcaagaagcaaaaacacagtttctaaaaccttggcagagactctatttgccctgctagagaacagcccacccagaccaggagaggagaggcctacatgtcttgtgagagcaaaatttaatcccgaggaaaaccagggggacctctgcagttggttggaggccttcttcaagtgctgggccattgtaaagggaacacaacccagagagacctcctgggtttctacaagcccaggagggcccactgaggaggaaagcaaggtgccagagcaggctgaaatgcgcggagctcatccaccacccagggttgctaccagcaagggccacgctcatgagcacgcacagcagtagccaccctgaggggccacttcatgctgctgtcagtggagctcagtggtgagctgggagtgttcccggagaaagtctttggaaggagcactggagtaggagtcagggaagctgagctgtccacctgattccaccacgacctgagtgacctttttcaagtcacttttcctctccccgtctcagtttctgcttgggcagaaggagcaacttgcagcctctctaagtccctttcaacgttcctcagctccgcgcttacagagggtggatctcagaaccaggaggacaaacagctgctcattgagtcctgagagtgcctgagtgggggcgtccaaggaggccgtggtgtgggcggagcagctggtacagtttgcgcatgggcagtggggggacgttggtcactttgtggtatcgttgcagatggccagggtcccctgcaccacggcgtctgcagcacatggctcaacagcctgaagccccaagacccagtgccctgctttgtgcggaagtaagcaccccttccactctgtcccctgtggggccgccgacccctgggagttccgggaggaaagggagggatctggggtttaggagacgctcggagccccttggcccataaagaaggcactggggtcacactggtgtggctgcctgtagcagggacagcgatgacaggtgggtctcaagagtccagtgagcttggccctttttcagaaggacctgggggaggtgctggtgcctggacagaagtgaagcagcctgcaggacgtgggaaatcaaataggagcttcttgtcctctccaccccctcacgaccgcctcccacaggcccagctccccagccatcctgtgtgtgcgtgggcctggggtgtctgaggactggccccctcttctcctgtcctcttcagtgccagcggcttccacctccccgaggatccctcccatccttgcatcctcatcgggcctggcacaggcatcgcgcccttccgcagtttctggcagcaacggctccatgactcccagcacaagggtaaggctggaggcttcccaggtgggaggggcaccagggggccagcgcctgcctaggagcagaactgcagccccacaaacggttcctgacctctctcgagggaaggcctcccaagtttgcttccctgtgcgggcctctgcgggttagaatggctgcctttccgtctcccgcatagtagccagggctccctctcctgggagtggaggtaacaggaaagtccctgcttttgatctccgattggctgagggaattctgcatccgcactttcagttctgtgactatggatgagtgatctgaatgcgctgggcctcagtttcctcatctgtaaagtggggataatgctattaaatagctagtgggagtgaagtgagaattccagttgggcttggagccctggcgccctctggtggccaacatggtaacaacagcccgggactcctgcaggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtaaatgcagcctcaaagcaggtgaagcattacacacacaagctccactgtgagccctgggtccccacaggcccctcgcctccccgagccttcacctcctgagctcgaaaatgctggtaattcacaaccatcagagtgatgctgtgaagagcattacaccctctcatacagcagaagcgacagacctggagaggttcaggactaacctaggtcacacgcgggttaaccccagagcccagcctgctgaaggtccccagcaggccccctgggacacgcgactgcccggggagaggtggtccaggctggctacgctcaagccttgcaaggctggagggcggccgatgcttccaccacggccatcagaggggctcttctgtccccagggccgcgttaccccctgagcctggggtgtcagaatagactctcggccttcacacatttgtcccatcagggcacctcttgggcccagtgctctgtgcccagtgctggggccactgggcatcctgtgtggagcaggagcagagagtccctgactgactcctggaccttgtatctggggagcccgggatccataccctgcagagacctaatgggtagactgcattgagaggctcccttttctggggtgtaggcagagccctgggcagggggactgccttcattgatgcctttttgaagcatggcaaattcagagacagtctgggatccccactggatggtcagcccctcgagggcaggactgtgtccagcatttatctctctaatcccagccgagccccaggggcatccatgcacctcatcctgagcctggccccttgcaaggtcctggctggaaggggactcactcctcaccccttagtgcccctctccccgcctccttgaggccagcaggcctgcctgcaagccttgtcctgagcagctgaggactgaacccactgtttcctctggtttcaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaaggtatagtagtgggtgtgtgggctgaaggtgccggccaagggcacaggccgttggagccaggaccaggggtggcaggtagacccaggggaatcaggcccagaaaggttctggaccccaagagaatcttagcagtggctgagatctgagctgggtgggctgtcagatggccctactgcacatcctggaccagttggcagctttgagaagtcgggtgaatgtgttccatttttccatctgtagaatgggggcaggagagtctccctggcctctccccaaacccccctttcagaaagtatctgtgtggccaaagcaaggctgtgaacacaggggagagcaaggctgccccccgtcagcctcgtgtgaacctcacacttcttatttacacccaggctggtgtctgctcaccctcatccccccagcaggaagggcttgcattttattgatgaagataatagtgatatttatcaagggcttacactgggcatactgcttgccaaggattctcatgtgacatttcattcagtcctgccgaggactttatgagggaggcacccccttttacagagggaagggggcctacggggaccacagcagtaaatgtgagagcctagagttcagtctgcctctctctggttccaaagcctgtgattgtcacttccatactctccctaagacacattcatacgttcaactgaacatttattgagcacctactatgtgctagggatagagcagtaaatgaatcaggcaaaaattctttacattctactggggctgacaaacccagacaagaaagaggtgtagtgcttcagagaaaaacagcaggaaacagcccagggaacgctggggagtgtaattttaaatagggtggccagggaaggcagagctggaaggtggcatctgagaataaacctgagatggtgaggaggagccctgtggatactgaaggaaacactctgggctgttctggaggggcagcaggtacaaaggccccgggggtgggagttaagctggcgtgtttgaagaacagtgaggagataacaggcatttccccaaatgtgttcagtgggtcggtagacagttggcatcaaaaagattccaaggtcgaatagcctgggacatgcttagttaaggcaaggcaaacacgttgctttactacaagacttctgggagccttcagtatgctgctgttcatcaggacccttcaaggctggaaggaaagaaaggacgtagcatttcccaaacatatttatctcagagctcacacttcctggagtatcttgggtgggggatgaacgctgggcaggaaatgggtatgctaagtaaagctttggagatggttagagggcccgcaccagagcaggtgctgagcagggttagggtctaaaccagattcaagcacaatctaagtataacagttgggaagacagatggctcatgaaggtccatgtgatagggaagctgggcaaccccaggggctcatcccagcctggacttgacacgttgctctctgtttttacctaaaagagccagaagcgctatcacgaagatatctttggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcaagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcacactgtatgcgtgtgtgggtgttttgtagggaaagctcttctcagagtggggagctggtgggtgtcacagcctggacagatccccgacagagggacaccccagccagtccatggctcctctgaaatggctgccaggtgtgccagcagcagatggagcttcgtgctggtccaaagacctgtggtagggcagggggcgcaggcctgcctcccacacaaagtatctgaaacggggtctggtgagggtgggattgtcgcataaggccagtgtttcgaggaaggccttgagcttcttcttggacactgtcttagaaagcgttttgctctggggccaccagtctcatgcgagactgtgccttggccagtacggatgtggtccctgggaaggcagcgtgtcgaggcgagtgtgggccacagcatcctcgcctgagggactggggaccctcttgggtttggagcaggccaaggaagccttcttaggagagtgggccccgtttccttctcctggtcagaaccaaaaaaggagctcagcggcggccactggggtcctggcaacacacggctcccagcttaggtttggcctctgcctcctgggtgccctggccgacttcacccccttgcccgccaccttccccttctagcagtagcatctcaggggcaggagaaggggcagtgccaacctcaggctccaggaaagctccatgccctgcgcgacagccgtgcatctcagcaacaaggccaggagtccgctcccggaccagggctttccagctttaatgtgcgcacctcgtctggggtcctgtgaaaacagagactctgacctcgcaggtcgggtggggcgcgggatgctgcgtttccaacaaactcccggatgcagctggtgccactgctctgaggactactatggggcctgaggaactggattcttactgggctgagcaggatgtgttggcatcacctggatgcagagtcgggcttcctggcagtggcccagtggctggcagaacccaacacatgaacactgagccacttttcctatgcaagccctaacccctaatgccggagagacccacaatggaacacacacccagacggtgcttcgggttggcttctcctgacccccctccccaagccacctcctcccactgggacgccaggtctgaggaggcagctctgaccctgctgtggccctcacaggctctgccccagcccctctcccatctcggaggcatggggctgtttcctggggtaccccattaccaccttcctgtgtccgagactcctgcccaaaaggctagagccccagcctgctttctccaacaccctcgtgggatttgtgagggaccctctgggaggaggtgtgaggtcaggaccccctgcccaaagggagtccatgctttcccatcccactcctctcagcagcaccgccgcccgattccacagactccaaaatgtctccaaatgaattaaagaagccacggtcaacccacatgaatgtgccaacaagcattttcatttctttattttaaggacactgggaaaggagccagtcccctgaagagaacactctggtcagttggtggaggccagtgggatgccatcaggctggctttccaggagggggtgaagggttgatgcagggtgcaaggtgagagttaggttaaaggtcagaggggagggactgaggacgtcacctcccaccaggagtggacagctggtggctt

SEQ ID NO: 11842 - DNA, 227979 bp, Human
  misc_feature (1)...(227979): n = A,T,C or G
gaagaaaagatggtgatatatatatatacacacacacacacacacacacacacacacacacacagacatatatatgtatgtatgtgtacacatacacacacattgtattctagtatagattgattatagggagccctcactttgcatcttaaaaatcaatttaaaaatgatgagttctatgaccttaagaaatttttgccaaagcattaaaaatgttttagtgtaggttattaatatatagggaaatgaaaaaaatagtacagctaatatttatttagtacttgataatttaaaatgttagaaacattgagagttaaatgtttcatttctttgagtaaaacttgggaataatttcaacatgtttgcttttcattgtataactgatgatatagagtatttcttttcttttgtgtactgtcgtactcctttttgagtttgtacaaaacgttggaagctgatccaaagttgtgaaatacctgagagttactttaatgttaattcctttgggaatcttcatcctgttcattacagccaccttccaatttcacttccagtgttgtcactttgtatttctttgctatactttcttttttgttggctcatactgtctttcgattatccacttttgtaaaatgtcctgtgatttttatccctctgagatgaggagatggcagaactacctgctttgctgtttgttcctgaactgaataccagatgtgcagggaccaatcaccgacaggctttcagagaagtgacatgattggtcattggtcgtgatacacatctgttattcacatcatgatttgcgaaccaaagagctagcagtgaagtttgtatttgatgcagttactcagttaatataccttggtaagtgaagtctgaaccacgttgtcgggggactggtattatttaacaaaactacggtaacggaaattcatgcgtattggaaccataccaagtgaggagtgcctgtattccagttataaattctttgtagtacatttaaagctgggcctagctccctttgctttacccattacacactgagcctgtccagtgtagccaaactgtggtgcagaaaatcaaatcagagttgaactgagagtttcaaagtcattgattcaaccttggagtcagctttgactttctcttttcttacccaagacctcacagagtagtttgggcactaatgaaggtatttttcagaccccatccagcatggggagttttgacttgatctgcagcctacgccctgaagaaagtttctgggttgtcacctttgtaatttttccaactctctcctccctcctccactttctcccctcttccttggcctgctcttttcctcctgtgtcccatcatcaagttccactgattttccctccagccttacgttactgcatgtttctttcagttcctgttgccatcatcctaattatatgtttttcaacttgaatttcaattgctataatagtttcctcactgactttcccactctactctctctcctttccagctaatcccgcatgccatcactggagtaatcttcctggaacactcttgcagctttacttaatcctctgcttgaagcctccaaaataacttactgataacagaataaaacccaaagcccttatcaagcctgtaataactttctttgtctaacacaagcctccttcttcgaatttatcacctgatctcttcccttccctctagaacctgaggtttcagcaacataggtttactcattatctcccaaatatgcccaccacctctcctttctatgcattgtcttcctaaaatgcactttctgatgttgtctgaatcttgaccagtttcaaaaacttatcctaaatgatctctgctgtgaagtctattttaacttcctagaaatgtcttttctcctctgcagttccaaaggatttatatttcatactttccagttaccgcttatttgctgatctgtgtttttagttatgtgttatttaatttctccatttagcttttaagtcctagatgggcagggactgaatcttctataccatgaggaatggcatttgacagagtgataggtataaatctgtcccttccctcattcagtattttctgtttttttttttttttttagcatttcttctagacattgggctatgtgctagcagtaaaacataacaaggtaacttcctgacctcacagagctctggttgagtgaggcatacagagaagtagtcagtcagttgtaatgccataagatgcatggaatgatggatagtgaatcagatttgtggcagcaagaaggtaagtgtcaagcctagatgaggggcaatgggaatgcttctagaagtgaggttcaggcagagtctgaaagatatgtaggaatcaggtagttgacggaggccagatggaaagaatgttccaggcagaggactcagtgtggataaagctctggaagggtgagagcacactgaggaactgaattaagttccatgtagctgtattgtagagaatgaggtaagattgctaagtgtgatgagattgcagaggatccctgtaatgggcaaaaagttgacatctttggtgaatgttcaggagggaggacttccaggaccagatgtttgagtagataaaatgagggggcagcacccaggtgtttcttaaagatcgcttggtggatggaggtattggagggaagacgatgagttcaattttgaatttgaggtgcctatgaaatatgtatatggtgacacatagttgtagacaatttgaagctcggaagaaagctttgaccagaaaataaaaatttgggtgacatcagtgtatgataggatgaaatcatagagaaagagtgtgtagagtcagtgaagaagacttcaagaccaaaccttaacacacatcagtatataaagaacaagtaaagagagcagagtctgcaaagaatgttaagatggatcaggcaggaggaaggagcaaaataggtgagtgaggtgtcatggaaaccaagggaagactgaaatccatccattgggtttagaaatgtggaaaccattcatgaccctagcaagaatagtttctgtgtagaggaggggcagggaatgggaaaacataaaccggcccaagatagattgtagcgcattgagaagtcaacaaacaattatggtggaaagtttagttatggaggagacgatttaaagagggtagaagctggaaggaaatggagctgaggggcttttattataatattcttcaagctgctggaaatctgtgatgtttaaaggctgataggaagaattcattagtgataaagaggttgaccataagctaaaatagccagagttataactcctcttaaaattctttgcccagtctgtcctgttacctttcagtattctaaataagttaattccaaactaattttggacttcactgagatcttgttacacaagattgcaaattcctataaagtatgattcaaactattctacttatttgttctgggtagcatttagtgtcttaaatagagaaaattttcaacaaatattatttttattactgatttgtttctttattttttgagcaaatatatttaatttttaatttttgtgagtacatagtaggtatatatatttatggggtacaggagatgttttgatacaggcatgcaatgcgtaatcacatcatggagaatgaggtgagcaaatacttatttaatctccattgtatgccagacatttttctaggtgccaaggatgttaaggttaccaggccatacacactaccaggccatacataccccttgttctcgaggagtttatcatctagggagtcagttaatgaaataattatggattgcaaatggtacttaaaatggcatggtggtagacaatcatcttgagtggctactgtatatacacactcttttcctatgaacttttctttccattgttggagggagaataattacaagctattaaagagttaaatgacttaagatggaaagaaaaaggtagtcagtaacggagactacttttggcatagcgagtttactcctctgtttaccatttctaaaggtcatgggactctgatgcctataatgggctgtatgttttgcaggttttgttggttgatcattacttagcctctgagagactaaccaactctccatgttttctcttttcccttttagtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaaggtaagcttttttcattccgcccatttgccagacctctgttaacctgccaaacccacatagaagtcaaggatctgcgggtggccagggctggtattgaaacagaaaggagtacatgatttgtggcctgagaaatggcagtagagacagaatgtgggcccaggtatgtagctgcagtactttctaggccatagagagttagtgtctaggaaataagaaaataaaaaggagcccattcttctctagtgattctttaccaccaagagctaataaatgtgcatggtactgttctgacaaggcctgggaaatagaaagatgagcaagacagtgttctggcccttacagcattaataagctagtggatcgcacagtacctgctggtgaacttcacaattgaagaatgcttggttttagttgtaaacaatcatttaacctcactggacttcaatttgttcgtctgtagaggaaagtaaactaggtcacttggagctcaaaaattctatgacgaattcatccttttaaacctggcatttttataaatgcacacttttaaaaagggaatcatagaagtttactggctctaattctttaaaacctgagtccttgcatcaggagatgagattttgtttgaaagctacggaaagtagcttgttatagatataaaataatgcactttggtattttgtgtgtgtgtatgtcacaagaagcacaaaaataacaggtactgtattatttaagggtaagagaattgtgccttgtaaaactgggttttctcttttaatagaaacatgtaaatcctacaatttttatgacagaaattttatgagaaattcaaaaataatcaaatgcttgatctttctgattaacatttgataaaatttacctgcttagaacaagcagcatgaatttcacagctttatgactttggaaaagaatattttagtctcatgaatgtattactgttaaaagttttaatttctctctataattgcaaattttaaaaacatataaattcaggcttaatttttattttgcctgtgcccttaagaattgtgatggctggctgggcacggtggctcacgcctgtaatcccagcactttgggaggccaaggcaggcggatcacctgaggtcaagagttcaagaccagcctggccaacgtggtgaaaccccgtctctactaaaaatacaaaaattagccaggcatggtggtgggcacctgtaatcccaggtactcgggaggctgaggcaggagaatcgcttgaacctgggatgcagaggttgaggttgcaatgagctgagatcgagccattgcacatcagcctgggtgaccagagcgaaactccatctcaaaaaaaaaaaaaaaaagaattttgatggctatgcagcaaaatgctacacatgcatgcatgtttataaaatttactttcatgttttaaaacttttgatttgcctgttagttattcaggactaacaagttttcctcccaatctgttgtagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacaggtaaacatcatcaccgagcctgctttagcagtgtcttacagatatggtatcattttaacaagaaagccagacttgataaaaatgcttttttaaaaaaaaggctttgacaaactatgacttgtggccatatttttgtaaataaagttttattgccacactcatagccacacttattcatttacatactgtctatgcccattttcatgcgatgactgcagaattaaatagtccagtgagatcatatggtctgtggaacctaaaatatttactgtgtgtctttttacagaaaaagcttgccagtccctgatgtacagaatacatttatttatttatttgtttattgattgattgattgattgattgagttggagtctcactctgttgcccaggctggagtgcagtggcacgatcttggctcactgcaacttccacctcccagcttcaagtgattctcctgccttagcctcctaagtagctgggattataggcacgtgccaccactctcagctaacgtttataattttagtagagatggggtttcaccatgttggccaggttggtctcaaactcctgacctcaagtggtctgcctgcctcgtcctcccacagtgctgggattataggcatgagctaccatgcctggcttccagaaatgtttcaggaagtccatgattacctgtttctattttttcagttaggatgatctgtgtataaaatgtgtcaggcgtgagatatggtacagaatatatattccgcaaagatgcttgtaaatatttttgccttttgcagtagttttgttcatgagttttgaattcattgtgcaataataattcatgtcatctttgacaggaagtaatatttcatgttatcttttattttcttataaaaattcaggccgggtgctgtggctcatgcctataatcctaccactttgggaggccgaggcaggtggattacctgaggtcaggagttcgagaccagcctggccaaacatgatgaaaccccgtctctactaaaaatacaaaaaattagcccggcgtggtggcaggcgcctgtaatcccagctacttgggaggctgaggcaggagaaccactggagcctgggagatggaggttgtagtgagtcaagatcataccactgcgctccagcctgggtgacaggagtgagactctgtctcaaaagaaagaaaaaaaaattcataacttgcaaggtgtagtgcatgagttgtttgaagtgtaactttaggcctacatttatatcataaagtgagagaaaggcaaaattttctttaaaactcatcattgaatgtgcatagcgaagacaacctaaaagcgttggttcctccactccattatgtggtaatgatggaggcttcgttctgtggtttccctcctgtcttttggttatgggttaaacccctcatgagaagactagatgagatacatttattattattcctctgcgatgtcttgaatattaaaaatatatcgtgtgtgtgtgtatatgcgcatgaaatacttgggagtaatagaactaattgtcactgctttagaaacctgggaaacacttttaggtagtaagtcaatggtaagattgtcacctttcttctaggagaaggaggggagattgtagacctgaatggaaggcagcatatgggaatggaaagagcatccttgtggagttgtaagaccttgattagagctgtgagcccagcactcggtaggagggaagtggcttccttatctgcaaagtagagataagatgtggggctcatgagactttgttaagattaatcaagataatgtgagccctgctttgcaaatattatagaacgatgcaaatattagcttagagaatatttatcaagatgagtcaaacttaagcagccatctactatgactgtttttatatcatgtgctttcagtaagataggggacagcatcgatcccacaaacacagccctcattggcctgtggacacctgaaatgcgactacaggggacctaacgtggcttttcattccccagttttgcaaatgcttttgggagaaggaacatcagtctaaatttagcttaaaagtaaagacaatgtttatgctaagggtagattttgataaggacagtggggctgaagataaactttatacacttcacagctttgcactgaactagtcttggagagggaggacaaatttcgtgccatttgcattgtttattcattccagcttaggttggtcatggagaaaggaaaaagcagatctttttaaaattgtgtgcccagtacctttctccccatttccaagttggaacacagatgataaaaagcaagaaaatgaggcataacaaacttgttattcttgtataatattaggtgattgttaacaagaaaagatgaaaagatactattgacttgtaagcctagagtgtacaattgaaatgaattggctaattgatggagttacccaaataattaaaactctggaatacttttgtcttatctgcatacatctctgacttttggtctaaaagatccaaacagtgatctcaattcttaattcattttgcatgtgtactcactcatacacagcttcaaaataagacctgttttttggaaagcattctcagcatatatttattggtcttcctgttcatgaggaatgttgctggatgctaaagactgcccaattaatttgtgcaattagggtgaaccaggcatttaaaaaatacattactggcaaataatcatagtgtgtaggtgtatcctactatcctacaaaggattttgaaaacatttgtgctttcttgctgtggttggtttgcaaacgtagctatagccaggaggtataggtagattttaaatggcagataatccaaaacaaaaacaaaaccctggataaatgctcactgttgctttgctcagtggagccgtcttattaattgcaagtgtcaaacattgagactttcaatgcaatagttaccaataaacatctatgtttatatgttgctatgagaggtcatatacaaaataaatttggcagagatagcccttgtttctgtggcacattctaataattaggtagtaaacttgggattgaacaccaagatgaactgtgatcaacgtatttaaattcaggaaagctttgtagggtagaatttcagaactgtttggagggtggaggaaaatggatgattgatgaggaaaccaagctcacagagcagaaagggagagtaattgaacagaggaaagagaacagtacaagaaatgggcagggaagagttgtcagaagagatcagagaagtgaaatagcttgggattcttggcaggctattgcacaaatattaagcctcttaaatctgaggcatagtgcagtataaatgacttgctggcaaggtcagcgtgtcaggaagcccctttgactaagtgatcaactcagcgtcattaatagtggggcagcctgaccttatgtgcctcctgctgtgagacagtatagagtgcagaattacccatgaagtgttcttgccaaatatatctaacctgaatctaatcaaacccttagacttaaccccaagtttacagggaataccaagggtaaagaaacaagttaaaaacatcacactcagacagaaaaaacaatcagacattgacaacgtagggcattgttgcctggtttcttaaaaaaaaaaaatcagagtataaaagaaagtgagatgatgtttgtagaaagagacacaaaaaataagtgtaatatattcaccttaattaaatcttgattttttaaaaaaaagccagatctaagagatattttgggaatagttggggaaatttgaacatgagctctgtcttagtccattttgtgttgttataacagagtgtcacagactgggtaatctataaagaaaagacatttatttctcactgttttagaggctgtgaagttcaatatcaagatgccagcatgtgaccagggccttcttactaagtcaccccatagcagaaggacaggagaacacaagagagcaagggggagctgaacttgcttttataacaagtccactctggtgataactaacccactcccaagataatgacattaatgcattcatgagggaagaccctcttattaggtcccatactcctaacactgtcgctttcaggggattaagtttctaacacatgaactttgggggacacattcaaaccataggaaatgtcattagatgatattttggaattactagttttcttatgtgtggtaatagtattgggattatgtaggaaaatatccttattcttttttgtttgtttgttttgagatggagtctctcactctgtggcccaagctggagtgcagtggagcagaggtgacactgcaacctctgcctccctggttcaagggattctcctgcctcagcctcccgagtggctggaattacaggtgtgcaccaccacacccagctaatttttgtatttttagtagagacggggtttcaccatgttgcccaggctggtttagaactcctgacctcaggtgatccacccgccttggcctcccaaaatgctgggattacaggcatgagccaccgcacccagcaggaaaatgtccttattcttaatagatgaatgctgaaagttttaggggtgaaattccatgatgttcgtagtttacaggcacactttcttttactgcacctcacttccactctttgtagatagatattgtgtcttttactaattgaatgaaggttctggcagccttgcttataggcaagcaagtttttctgacagcatgctctcactttgtgtctctgtcacatgttggtaatttttgcaatatttcaagaccttttcattgttgtatctgttatggtgatgtgtgataagtgatttttgttactattgtaattgttttggggcatcacaaaccacaaccatataagatggcaaacttaattgatacatgtgtattctctgactgctctaccaactggccattcccccatctctctccctgtcttcaggcatccctattggctgaaacacaacaatattgaaattaggctaattgataataacacaatggcctttaaatgttcaagtggaagaaggagtcacacatctctcactttatttatttttatttatttatttatttttgagacagagttcttgctctgttacccaggctggagtgcagtggcacgatcctggctcactgcaaggtctgcctcccgggttcacgccattctcctgcctcagcctcccaagtaactgagacaacaggcgcccgccaccacgcccgggtaatttttgtatttttattagagatggggtttcaccgtgttagccagggtggtctcgatctcctgacctcgtgatccaccctcctcggcctcccaaagtgctggggttacagacgtgagccaccgagcccggccacatctctcactttaaatcaaaagctaaaaatgattaaccttagtgaggagggcatgttgaaagccaaaataagccaaaagctaggcctttgcatcagttagccaagttgtgaattcgaaggaaaagttcttgaaggaaattaaaagtgctactccagagagtacatgaatgataagaaagtaaaacagctctgttgctaatacggagaatgtttgagagaggtctagaaccagccacaacattctcttcagccagagctcaatccagaacaaggacctaactttcttcaattctctgaaggcttggagaggtcaggaagttgcagaagaaaaatctgaagctagtagtggttggttcatgaggtttaaagaaagaagccatctgcataccataaaagtacaaggagaagcagcaagtactgatgtagaagctgcagcaagttgtccagaagatcactgataaaggtggctacactaagcagccttatacctgaagaagatgccatttaggactttcatagctagagagaaagtcattgcttggcttcagaggacaggctggctctcttgttaagggctaatgcagctggtgacttttagttgcagccagtgctcataggctgttctgaaaattctatggcccttaagaactatgttaaatgtactctgcctgtgctatataaagagaatagcaaagcccggatgacggcacatgtgtttgcagtttggtttaccgaaggttttaagaccactattgagaactgatgctcagaataaaagattcctttcaaaatattactgctcattgacaatgtacctggtcactcaagagctctaatggagatgtacaaaaagatgaatgttgttttcatgcctgcaatcacaacatccattctgtagcccatggatcaaggagtcatttggactttcaagtcttattatttaagaaatacattttttaaggctattactgccatagatcatgattcctctgatggatctgggcaaagtaaataaaaagctttctggaaagagtttgccattctagatgccattagaaacattcatgatacatgggaggaggtcaaaatatcagcattaaagatatttaattaaattagatacttgaaaatgtcaaatcccacccttatggatgactttgaggggtacaaaatttcagtggaggaagtcactacagatatggtggaaatagcaagagaactcgagttagaagtggatcctgaagatatgaccaaactgctgcaatctcatgttcaaacttgaatggatgaggagctgctgcttatgaatgagcaaagaaagtgctttcatgagatgaaatcgactcctggtgtagatgctgtgaacattgtgaaatgacaacaatggatttagaatacgctataaatttaattgataaagcattagcaggacttaagaggactgactcattttgaaagcagttctagcatgggtcaaatgctatcaaacagtatcacttactacagagaaatatttagtaaaaggaagggtcaggtaaagctgcagacttcactgttgtcttattttaagaaattgccacagccaccccaaccctcaggaacccccatcctgattggttgacagtcatcaacatcaaggcaagaccctctaccagcaaaaaggttatgactcacagaaggctccgatgattattagcatttttaaagcaataaagtgttttaaaattaaggtatgtactttaaagcatagcgctactgcaaacttaatagacgacagtatagtgtaaacatgacttttatttgcactgggaaactgacagattcatgtgagtcgctttattgtgataataactttattgcagtggtcaggaactgaacccacaacatatctgagatattgcccgtagtttcagaggtattttacacacaagtagcacgaacttgactcttgagcggttcatatgcaggtgatcattgtattatcctttgaatatctcagtatattggaaaatattttagaaagaagggggaaaatattaaaatttcctagacttataaatagaatagtatattttaaagccgaatttaaaagctttcactgtaatacatttagagactttttagaaacaaacttaaagtttttaactgtttaatgggagtgttgggtgagtgtgaggtgacatgaggccaaggaagagaaattggccttgtgaaatgaccaagggccaatctaagaagtcaagttgaaaaaaaaggagatgactataggggattttgtgaggaatcaagcatcaggattgcgttacaggctgttgtgaagacaaggatgatgaagaaatgaacggttctgaattttcttctaaataaataaatgctaaataaatgctaactaaataaatgctcaccagagttgatttcttgacccttagcagggaggattgtgagaagatgagcaatgacatctttgttacaagcagcctcatccttgattaatattaggaagggtgtactcttaattatcagtcaaggaagtccagggtgttttcgagatggaatgctagagaattaatggagaaaattcagtgatcagtgaatagatttgctgatgatagcttaaattcatgaccacagaggacatttctttggattgcattataatgagaaaagagcgggaataatggagttaaaggtttctgtaatgttttctcaccttgacagagaatgccaacctgtagggaaaaaaacatttctattgttttgtttttgtaaaaagttacgtttagtatttcagagttctaaaaatatgtttaacaatcaaataaatcattggtgtttatgtgaattaggctgtctatataggcagtctctataggcatcactaaatctcctatattcaaagaacagaaattgatctcatagaactatatagggtgacagacaggagtggttttcttgaatataaatcaagtatgaagtagttggccggtcctaattttggcagagttaggtttctgtgctacctggagtaagttgtggtagtctacatatatgtgaaaacatttgcaagagtttgctcactgactgttagaatgacaattccagtggttacaatcaccagccacttcagggtaatctcatttttcacaggcttcaaacccgaacatttctgtggtagttatcatctctgaggagaggccaagtttcagaaaatacccctccaatttatttttgcatcataggaacattgaatatgttcatcttttttacataaaaatcaattgtataagggtgtcctttgtttttaaattggatctctttaacagtgacctaaattcaaagcttgtttggcatctgactttttgattgtttcaaacatgttttattgattgcccagttcctggaaacaaacatgtagtgacctagttatgccagatggtatgaaaaggccttctatgggaagcatttagaatcacagtatagagttcagggtccagcttccatgctgaacctgcccactgcctcgttgcacaagcctgtgctctttgttgaacccaggaacctgcctcgtaatcagacagaagcgttataaggggagacaaaaaattcaagtgcttcaagatttcctgtttcaagatgctgaaagatcagaaaattttacatataaatacctgagttaattaaaaagcaggtattccaggactctggaaaaccctgatttatacagcatatgttttaagtacagcactctaacacagataaagatgatcaaataacacatgaacccacttttatagtttgcaactataaaactcttagaaaatattttaaaaaccataagaaacaaacttttctgcatctattgagataatcaggtggtttttgtctttggttctgtttatatgctggattacatttattgatttgcgtatattgaaccagccttgcatcccagggatgaagcccacttgatcatggtggataagctttttgatgtgctgctggattcggtttgctagtatttttttgaggatttttgcatcaatgttcatcaaggatattggtctaaaattctcttttttggttgtgtctctgcctggctttggtatcaggatgatgctggcctcataaaatgagttagggaggattccctctttttctattgactggaatagtttcagaaggaatggtaccagttcctccttgtacctctggtagaattcggctgtgaatccatctggtcctggactctttttggttggtaagctggtgattattgccaccatttcagatcctgttattggtctattcagagattcaacttcttcctggtttagtcttgggagagtgtatatgtcgaggaatttatccatttcttctagattttctagtgtattagcgtagaggtgtttgtagtattctctgatggtagtttgtatttctgtgggatcggtggtgatatcccctttatcattttttattgcgtctatttgattctcctctcttttcttctttattagtcttgctagcggtctatcaattttgttgatcctttcaaaaaaccagctcctggattcattaattttttgaagggttttttgtgtctctatttctttgagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgcttcgaatgtgtcccagagattctggtatgttgtgtctttgttctcgttggtttcaaagaacatctttatttctgccttcatttcgttatgtacccagtagtcattcaggagcaggttgttcagtttccatgtagttgaacggttttgagtgagtttcttaatcctgagttctagtttgattgcactgtggtctgagagacagtttgttatcatttctgttcttttacatttgccaaggagagctttacttccaagtatgtggtcaattttggactaggtgtggtgtggtgctgaaaaaaatgtatattctgttgatttggggtggagggttctgtagatgtctttgacaaaattcaacaacccttcatgctaaaaactctcaataaattaggtattgatgggatgtatctcaaaataataagagctacctgtgacagacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcagttaggaaaagaggaagtcaaattgtccctgttggcagatgacatgattgtatatctagaaaaccccatcgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttccaagataataaaatacctaggaatccaacttacaaaggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatgtatagattcaatgccatccccatcaagctaccaatgactttcttcacagaattggaaaaaactactcaaaagttcatatggaaccaaaaaagagcccacattgccaagtcaatcctaagccaaaagaacaaagctggaggcatcacgctacctgacttcaaactatactacaaggctacagtaaccaaaacagcgtggtactggtaccaaaacagagatataaatcaatgcaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatctcttctttataccttatacaaaaattaattgaagatggattaaagacttaaacgttagacctaaaaccataaaaaccctagaagaaaacctaggcattaccattcaggacataggcttgggcaaggacttcctgtctaaaacaccaaaagcaatggcaacaaaagccaaaattgacaaatgggatctaattaaactaaagagcttctgcacagcaaaagaagctaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatggagccaaaagacacatgaaaaaatgctcatcatcactggccatcagagaaatacaaatcaaaaccacaatgagataccatctgacaccagttagaatggcaatcattaaaaagtcaggaaacaacaggtgctggagaggatgtggagaattaggtacacttttacactgttggtgggactgtaaactagttcaaccattgtggaagtcagtgtggcaattcctaagggatctagaattagaaataccatttgacccagccatcccattactgagtatatacccaaaggactataaatcatgctgctataaagacacatgcacacgtatgtttattgcggcagtattcacaatagcaaagacttggaaccaacccaaatggccaacaatgatagactggattaagaaaatgtggcacatatacaccatggaatactatgcagccataaaaaatgatgagttcatgtcctttgtagggacagggatgaaattggaaatcatcattctcagtaaactatggcaaggacaaaaaaaccaaacaccgcatattctcactcataggtgggaattgaacagtgagaacacatggacacaggaaggggaacatcacactctggggactgttgtggggtggggggaggcgggagggatagcattaggagatatacctaatgctaaataacgagttaatgggtgcagcacaccagcatggcacatgtatacatatgtaactaacctgcacattgtgcacatgtaacctaaaacttaaagtataatgataataaaaaaaaagaagaagaaaaaaaaagaaacaaacttcaagattaaggtctttatacatattctacagaagaaaataaactttatgtggattaggaagaaaggaaaggactggtagttgatgtggaatcctgaaatcattgtgaaaactcttttttcctttaattattggtcatataaataataagccttagggcaaaattgggttaaagtgacacaagaactgtttgggattctgttagagatgccagaagttgttccagcagttctgtttggacaggaaaaatggaaacagaatggaccattggagaacaagattatctaattgaagataggtctcttttggcagatatgttcagtaacatcctaagctctaaagcttagcactggaacacacacacacacacacacacacacacacacacacacagagcattctaaagggccaaatagatatacttagcttttgtttaaaaaaacttaaaagaataagcttaatggagaaattaacaggaaaatatgagctcattgaagtggaaagtatcctaattgcatggctgaaattacttttttttaaaagagtttcaatacttttgtcacaggactttgaataaagaaaaatatttcttggtttccactggacaaaagccagtaagaagctggggaaatagatgtgatgcctgccaactccacatgggagaaaaagatgggtagatggttgggtcgatgcagatgagatgggcactttggaaatcttttctcagtgatgagaaatggtgttcatttaggggagctgagacattgagttctgctcagaaacctgctcttgaatttccgcagtatctctcctgtcctggcaacgtgaatattactgggatgaagcctaaatctatgattacaaaacaaacaaacctagttttatcctgacagaagtaatgccagaattattgtaacacttttcacactggttattccctaaactgagtccataaactatgtaaatagattagaagtctaaagaaaaaaatggttataaaacatcttacttatgtggaaggggaactgagccaggctgggtcagtagagggcagaggtgaattgtggctctctcttcctccccatcgcctaaggccacatgcccttatggatagggccctcccaggtgatcttggaccagtgcagtggcctgccttcttttggaggagctgctgggcagtgactggggaaggtgaggctgaggctactagacatctgtcttcttgctgagcagagagctcagttggagtgtgtgctgattgcatttattgaagcttggcttccttgaggtggaataagtcattaacaccaggcacttcctatgccatctgggcttttcttcagtgtcccactcaagtactcctttggcataatctaagaaatatttaattgagtgttactgagtctcttgtggctctaaaatggctgctctctgtagccatccgtgccaaaccttacctgcgtcaacagctgaaggtatcactgaaggtgtcctacacatctcactgataggtgctgggacttttaagtgttagctggtcttgttccagcaacctctgccagattgactttcgcgcaggggccctctagcctggagtcaagaaagatcagcagagacaggggtaagatccaaagagggaaaatcaccgcatgtgagagagaacatgtctgcatgtcactgggctcctgccagtggagaggagaactgctcgttttacttggattgagaatgtagggctgggacattaggataatcaaaatatagattcttagaacttcagagaatgggttgtgacccagacgttacccttcctgcggcccagtatctggtctttacccaggtagatgtcttctgggaaccaaagaggctgtcagctttaagggtccacctgcccggacctgtttaagagaagcaagtatgtgtttcttcattggttctccctaagcccctcctctcagattttttttcattttattggcaattaaaatgcctttatcatgacgtggaatatcaaattaccatattttatacctctagggctctataaaataatatacctattaataattagactcctgttcctacataggaataagcattgaaaataataattatggagcagctcagagtggaagcatgttgagctacttctgatattggcaaagtggtaagattttatggtcactgtgtttgaagatgacagttctgagcatgttggaaatagttttaagagacgatggcttgaattgatggttgattttggctctatacattttaagaaatggtttcaggatttatagctggtatttctgggctctgatggtctgatgtggctctgtgctatccctcagaattgagatttgctaaaatgaggaagaatcatctggtttactaaaaaaatcagtcctctgaaatctgccccataaagttgtagtgagagaagcaacattttttgccgtatattgaagaggacagagttctctcctgaaccttctctaagaccatgatagtactgtttttttcctttctcatccttccattttttttccctcttctgtctcctttcttaaataaaataatttatatatagaattgaatgttctatttcaacaaggtcactgtatgagactgtgcatttactctagtgacactgccattgggcaaatagcttggacacgtctgtgaacaagatttgccaccgttgagaatatttaaagtatgtctctagccttgaagaacattctaaaattcaaaatattttgtatatttctaaatattttaaacaaagagagcaatgcctccaagatgatcactttgcagaagactggtttagaatctgcaagctctaacggagttgttaaagaatatggtcttaacattctgtggcttcaagataagcctctttttttttttctttttctttttttaagagatagggtctcactctgttgcccaagctggagtgcagtggcaggatcatagcatgctgcaagctcaaactctcgggctcaagtgatcctcctgcctcagcctcccaagtagctaagagtataggtgtgtgccaccatacctggccatggggcaagcctcttcgtaagacaatgcatttttagaaaactgatagctgatttgaccttcaaaacaatcaggagaaacatgaaaagtagacatttatgtctcccatttatttatgtgaaatttgaggctcagagattgggactagcttgtgttggtatttccaagacaatagctctctttccattttagcaaattcatcatatcttggccctcagtttcttcatttttcaaataattggattggctaaggagactaccaaggtgtctttgagccctccaaacctctatgatgatttctacatctttgctcttttctgcaatcttagacaccactggtgctgacatatgcacaggccatatggacagatcaatgtcaaacagagtgaatgaataacctatacttgtctctcaaatgctactgacttagaagactcgtctttagtatcagtttctctgaaaagctttttagtacttcttcaacccacacttctctctgttccttaaatctttattgcatttagaatctaatcagacaattttaaatttaaatattttaaagttgttgcttttgtgcctcgtttctcttcctcaccagcttgcgctttttataaggccaggatcacttatgaattgatcttagaactaggcacacatgaattgtgggtaaatatattagattagtctaggttgtgcttcagtaacacattagcacaacaaagtttacgttttgtgtgcattagacatgttagaggtgagcagaggactctgctctgcatatttcagggacttgggttgatagtggttccatcatgttactgccatgttatccagaatatatggcttccttaattcctacagcagggaacgagaggttctgcaaaggaccacactcattccctttcccatagccccctgttcagaatgagtcccatggccatacctattagtgctattgatggaattatgcctcccatccccaaattcatatgttgaagccccaaaccccaatgcagctatatttggagacagagcctaaaaggagataactaaggttaagtgagatcataagggcagggccctgatgtgataggaccagtgagcttgacctctctgttgctttccccacacacttgcacaaagaagagtccatgtgagcacacagccagatggcagccacccacaagctaggaggaggggcctcaccaaaaatccaccatgttggtaccataatcttgggtttccagcctccagaactgtgaggaaataaaaaaaaaaatctattgtttaaaccacccagtctacggtattttgttatggcaatctaacacatagttttggagctgggaaatgtggggaaacaagtggctctttggggaacaatggatgtttctgccagaagagtcagggcagtggacaagacagacatggttccctgcacccagggatctaaatgaacctgttagtgttatttgtggctttcagtttttctacatgacttgcaaccaaaccacaggtaattattagttttgagttctgtgtacttggaagagacacagaaaaaactgaaagcttaaccaaatgaggcatgcattacaatttcacatagtgctatgaggcctaaaatgtttttggttcctttgattatctctttatagacatgaagcttaatatagaagatttatctcaatatggttgtagaaataagcattggaggccaggcacagtggctcacccctgtaatcccagcactttgggaggccgaggcgggcggatcacgaggttaggagatcgagaccatcctggccgacacggtgaagccccatctctactaaaaatacaaaaaactagccgggcgtggtggcagcacctgtagtcccagctactcaggaggctgaggcaggagaatggcgtgaacctgggaggcggagcttgcagtgagccgagattgtgccactgcactccagcctgggcgacagagcaagactccatttcaaaaaaaaaaaaaaaagaaaaattggagaagataggcatttatgttcatcattttgggggtgatcaggttgctatggtgatagtaatcatggctatatgcacatctttattccctctctcaacatgagtctttctttttagacacattcctagtaattaaacttaaaataaattcgatctactcaccatctagtactaggatttatcacatgatttgtgttgttttgccccaaggaaaggctaacaggaattatgatgtcagaatataatcatgataatactgtacttaaattttctttttgcaacttaagagcaaaacacacatatcacagcctggaagaagacttgactgttgaaatgttcaaatcattgtagaggtggagaaaataggcagcacagattctatcttttctttagaaaagatgtcaagtagaatcataagtttcatgcttaagagggttttttttcccttcatatgtgactttaaaaaccatttttgccttagtgtaacttttaaaataccgtttcataaactaaagtagttgtctggaattccttgaagcccatggtttggcttcagcaggttttaaacaaatacactgtcagaaatcgatgtggatacatttccagcagttaaatgctctagtcacagtagatactttgtaaaatcaatagcctgaaatatcagaggattatagttgtatcagattccccaaatgcctaacattgttttaattactctaataaaagaaagctgagtggacttaaaaaaaagaaagaaaaaaaccttgcctataaagaatgttctgctcaagccaaagcaaatttttttacaagttctcttagaaaatctggaagtatttatgcattttcctcttcttatgagacaatgcctgttacccagccagttctgcattgtacagtgctctttataacaacgacccttagaacaagttgatcaaatatgttgctctagttgcactagcgataggggttagagatttagaactttttactttttgatgcatagaaataagcatatttaatgatctagtactgggacactaaagagtgttcatgagattttctagtttaatttggagccatagttgattcaggggctagaagaacaccattttgctcagaacattgtcaggagtcacttttccagagtggagatgtgtttatatcatagtgaaaagacagtttaagaggagcaaagaagaggaaagacgaagtttggattgatccaacaacctgttacatgtagtcagtacttttcccataggggacttcattctgattcttatgaaaagaagttcaagatttcaaaaaaaataggattaacattcctcatccagattcatagtattgatggtgtagcttttgtttactagaataccccaaggctttgtgccagaatgttagagtaatgtgcttctgaatgtggatggaggtgaggatggcacctgcatgggtggaataatttatgggacatacctgtacagtgtaggttgatggattataatgtgactttataatggtcacagcccagtacacccaagatctgcatttccatgaccatcttgaatcatttctgagatcttgcctattgataattatatcattcattatagctacccaatataatctagaatcgagccatttaagagctgtaactcttctcaggaaggtagagctgccctttgtgtgtacaggttagcaggaaagggctggcatgacgtagggtgaggaaaaggcagcccattattatggttatccttgattaggttggcctaggtcagggtatgaggataccaccaggcaggctgtggcagcatggaatctaatgtatcaacctggcaggcagggggcacctgaggaacaccgaccttcataggattgccctgccacgtagctccttggctgccctcagccctgccctggagctttcataaaatcatagaacttgggcacttaaatgagtattagcaagtagtctgtccttacaattttatgggttgatgcaactaacatccagagaggtagatcagtttgcagttgagtttgtgtgggaggtggggagtaaaactgaagattttagtgtctagtccagtcttgctactattttttttttttttttttttgagatggagtctcgctctgtctcccaggctggagtgcagtggcgcgatctcggctgactgcaagctccgcctcccaggttcaagcaattctcctgcctcagcctcccaagtagctgggattacaggcgcccgccaccaagcttggctatttttttgtgtgtgtttttagtagagactgggtttcaccatgttggccaggctggtttcgaactcctgacctcaagtgacccgcctgccttggcctcccaaagtgctgggattacaggtgtgagccaccgcacctggccagtctttctactattgcaccctgactcttaggccatttcttctagggatggaggattcacaagaaaccattgctatctaaacctgaaaggacagctatattctctgggacctgacttagttagagagtcgcatgctgtgtggtgttttgtgattgggccatggatccttgaggggaaggagcacagtgagctccattgctgttgcttcatggtcttggttctctggcaccaaaacatagcaccatgacaagtacgatcgtgatgtccccaaagtgaaatcatctgccgcttgaacgtcaatatttacaagttgaattattggaattccatgataccatgttgtgcttcttaagcagagttaaaatgaaatctatacaatgacatgccctccacagcattaattcactgagtatttctttactagccagagcacttttgagaaaacctgaatatttttagcaaggtcttaagaatatctttttcttttatttctatatctaacttacgtgtttattttatacatctcttatctgtaggctgaatctgggatattgtatatcgaataactactagattaattgctcttttgttaaataagcccaggtttttaaaggaggagcctgggggaagagatctaatacaagcccagtggggcttggccatatggctgtctcacatacagtccgtctcacatgtgttgtctcagtccactcaagagctccatgaaaaacggatgtctctagtgccattttatagaagacaaaataggcagagagacgttgagagttttgcctatagtcatggaggtggtaattggtaaagtgaagatgtgaatgtttttctattttcaaaagctgccctcttgccatttacccagttgtgggtcatccttacattgcttttcactgagttcaaggggaatgtggttgtgcagaaaagtctgtttcctgttcataatgtgctaatgctgcaaggcaagtagatatctgggagtttgctttgtgttcagaagtctttttgctgtggctggacagcatttgttgagataagatattattcgtgctgaacttaactcctttctgctgtttgtttgagaaaaagtacagtcaatgggcctccaatcatctaatttcaaatttttgtcctcttgttattcctgattatgtttatctccagtatagtttcttccttttcctccctgtgaatgatatactttgtcctggtaattcttttttacatttcaggggaagtactagatatagaacactttacctttataaaaacattatctctttctccttttcctcctcttcatcctcatcagtctttctgtacttaccattgtttcaaagatgctaattatttaattggaagcaatataaacttttttgctttgagaaaaggaactatgatgcttcttttcccctgtttcctggttgatttttatatccaactgtacatctaatctcaaatttggaaaaccctccatggtttagctccacatcttctctgactctgcacacccactctttgttccttcgtattgacctgccttcccctgtctttaccctcctccgttgccactggcttttctcccagctggtggttggtgttatgcttagctagagctgttccatctctttggaatctctctccccagtagagccattgagtcacttccttgtttcagttcttgcctaaacacagtcctacttactcttgcaagagttacaatgaatcagacttctgttttatttcatgttttccctcagtgcagtctctacaagtattttttgaaacctgtatcactttaacgttttgggttctctcctttggctctaaaagatgttctctactgaaacttaaaatattttatactttattatataatagtccttcatagcataataaaatgagttatatacatgtaatgaagacaattaataagagtatttcagtttatcattttttagtgttttaaatagtaagattaagtagtaggttcctgacatgtggctatctttatggagtggcccttttaatagttaaatatctgaagacttttaataaatgtgtcctgagagtttatcaaatggctagtactttaatgctggttataggttttacccacaccaggcaccagttgaggaggatgattggggcctggagtccagcccatgctctgctcatccaactccatgtcctgatgcaggtcacatcctacagctgcccttttctaatccccacacaggggttgatggagtcccagtatctgggattggacaagcatcatttaatctcacaatcctttggggttgggattactggctcagagaggttggatgatttgctgaacttctcactgctagtaagaagtttctgggatttcaatccaagtctaatgactccagtccagcactcttttcttaccaccactgctggatcctccttccccaggactctgcacagtgcagcaaacactcttggaatgagggtacgttgtaggcactataggtaccagcgattttaatacgtgaaaattaaatcttataaaaccttatgaaaccatattccaccatctatcacaatctcttcaaatcatcattcagcctctgaagcaactccagtggggagtttttaattgacaaaaattgtaatccttggttaccagataagttttgaactatctttcctctcacattgataggcagatgtaaaagtgtctatgatcacagcccaactttgaatatcagggaagtgctacagtattacctcaaaaatgagattaaagtctgaagatatgtgttcccagtcaggccaagatttagatacatacattaccctgcaatctgtaatttttgatgactagcttcaaaattaaaggtttttttcactattgcttataataattttgtgttgtaaatgtagtaacatggatatttgtggaataattgtaatgattcttgaacagccttaccttctgcatcacagtgttcatacagatgtgcacataggaagggttgaaaagttattttcatgcactcagtgttccaggaatcatgaccagtgcactgctgaatcaaggctgggagtagctttgtttgtttttcttccttttgccttatttgtataagtgctgtagttagaggcccaggcagcatgagcaactctagagatgtggaaatgagggaggaggagataagacaaaaggaggtggttaggaggccgtctgcctagacgcagtcctattatagatgtgagagcagcagaaacacttgagttttgctgtggtgtgtagtaacttgtatttcctagatgggataatgtaacctatcagtatgtagtgaccacagaaccttagaccttgcagaaatcgtaaaggtcatctgcttcatatcctgggcatccctgagagatgggtttccatggtcagctcctagtgaagtcagcatcttccactgttaaggagcattaactgttgaaaagatcttctgcttaatgaggttgaatccactctttctatgatttgtagcctttagtcctgccaatacaagttaagcatcccaaatccaacaatctgaaatccaaaatgctccagaatccaaaatgttttgagtaccaacataacactccaaggaaatgctcgttggaacaatttagattttgtacttttggatttgggatgctcaactggtattttcaaatattctaaaatctgaaaataactaacatctaaaatacttctagtcccaagcgttttagatcagagatcctcaacctggaccttcatcgtgcaacaggcttcctcttgctcagggtatctgaacactgccatcatgtctgcacgtagtctcaccgttccgcctttcctcagttgatccttacaggacctggttgccagaactttcatttctctgcttgcactgcttcatctaggtcatgcatgggctgaatcctgggacagctgtgtagggttgtagtgtcccttaatctgcagcccaaggttgtgtgagctttttgaggcactgtagcttgtttgacccaataggatttttgttttggatttgatttagctaaatattgggttgtaaatttagcacatttctccaggattacttattcgtaagacacatcctgaaatgataaggctttccatgttaatgtagtgaataattcacaaaggaggaattccatttgtgtttttaacttgtaaaacatcacctcaatctgtgcgtaaaaatatagttagcgtgagcctatatctgtgtgattacatctcaccagaaagcagaacctaacagtcatagacaaggattttctgaatgctgatctcatcctattccatgtgattctcttcagtgtggccttttggtgtgggagagagaagatctttcctctaccttcttttcctgtaggcatttcctacatccaggtgagaccctatggtgttcagtggtctcttgggtgagagccctgagtatggccacagagatctctcagatggagtttctggctgcacatcgaagcctcttcatagttaaataactgaagggcatatgtagaactttgagtcttgttataactgtgacttcatctcttgtagcttattcttatactgtgcagacccagtttcaagacacacacagtgttgtggtaccacctacactaccatttatttaaacaatttggatggcttatgctgctcttggctgtggacctgcaaaaacaaagccatgggataaagcggcctgaatcatgtaatgaaaaccttgtacctttctggaggccctgttgagaaaaaatgatttatttttgccctaccaaataaaacattctaggaatccaaggtgaaaattggattttaactgctactaacattttaagcatataaaatcagcaagtgttgagtgtttcgcttgattaggagatgaacctaaagagtccagtacaagaatgatctgcatatgatgtgaactggtgtcttacataaattttataaaactggaaataaaccctaagcatgctttggcagccaggttgcaacggtggggacctctgtgtttttacagaatcattttgttcccagtcttaggcctgggtcattgttcgcctttcctcccttcagtccttcatatttcagggttacacgttttgtgattaagctcaaggagtatggaaactacctgattccagccccaaatatgtgcctgtcttctctaaggttcccgtttgttctcacgttggatctgtctctccctcttcttctccccactctgcgtgtacgtgcctgtgcatgtttgtttcgtcatctctgtgactacctacccacctaccactttatcactctttttttggtccagtcttcccccgtgtctgagactgttcatctgtggccctgccgctgttccaacctcggggactttccctcactgcacgtggttaaacactttgctgagagccctgtcttcaaacagacttccccaggtcattgtgttggtatctggcacacaacgtcactcattgtttatccagttgtgttgttttataagagagtttctttatctcaaggaatgcgtgtcacgtgtctgcaggagttactgccccggtttcaagagatgtgatggtcttgggctttactgacttacactagggcttttttcagtgccttccccagaattacgtgttttttcaagttcatctaaaaaaaaaaaaagcaattgttttggtatgcctagttttgcttaactcagaatgtctttaacacctgcttttatattagggaagttcattttgtctcgtagggtcgtttcttatggagtctggtactttcgagagggcaattagactaacctgtttgattgacaggaccgtttacaatctactccactcacacgccttctactccctggggaatccgacaaacatttggggcctcaaatgggacatctggagtagggagcttttatctataataataataataatgataatggtaatgatagctgacacatgtaagtgctcagctataatgttcagcattgcacatgccttttttctttcatgtttcatgaccctaggagaaagatactattatgcactctacgttatgggtaggaaaatgtctaagataatgcgtgtaagaagtcctacagtcagaattcattctcaggcctctctaactcctgagtcacatttttaatcactatcatatactgctgttggagagcacacagcatcctgttgaaatcattaaaaataataaaaccttagaacatcaaagctatgatgtaactaaaacttagctgagccttctgtggtttggtcttgttttacaatttggatatgtagttacttagcgcctcagtcagaatgttgcatgcttggacctggcagaaaagaaacgctgcccctggaggcctgccaggtgactggtgtctactacttgctgtccttctgagggccaccacctgcctggaccttctgtcaccacactctgctcactagcctggggtatggatgctaaacttccattggttttcttttgttttttgttttttttttttgagatagagtctcgctctgtcgccaggctggagtgcagtggtgaatctgggctcactgcaatctctgcctcctgggttcaagcgatccccctgcctcagcctcctgagtagctgggactagaggcacgcaccaccacgctggctaattttttgtattttagtagagacagggtttcaccatgttggccagaatggtctcgatctcctgacctcgtgatctgcctgcctcggcctcccaaagtgctgggattacaggtgtgagccaccatgcctggcccctccattggttttcacatagccattgcttgcctggatggcctacaactagcttgttccttagttccctaggttgtttgttcctttcttcatgcagcgtttcctgagcatttgcaacgtgtactgtgtactggaatataaacataagatacatacgcatttaacaaaaatgcatctcagaggcagtagactgtatagacagtgctgtggggtaaaaaggagggaggaactcattggaattaaggagataggggaggtttcatagtgatggttcttcagagctattaatacatctcatgggttgaataaagtttattctgggaaagaaaaaaggggagggtgttccagccagacatgctccttttggaaggacgtgatttgttcagaaaataaagagccctttggtatgtctgcaggatagaggtggatggggacaagagattgccttaggtgggaataggaaggaccttatagatcattctagagtgtgccattttcagacaatggagagtcagtgaaagtttttaatcggtaatgtgaccagatttgtctttggaaagacaactctggaaactgttgggaggatttttgtagaggctgaggcagagaaaggcagaataaccccttggatgctctgtgtttgcacaggagacaaaaatgtggggtgtgttagcctgcatagcaggggtggagagtcagctggtcctcccctcaggctggcctttggatgggtccacagagcaggatctgttttcttaggcacttcctcaccccattgaggtggtctaacttcaggcccctgcctctcagctttttctcacttcctgtggttgaccaggagtcttacctggtcttaacactggacaaccagtgttgcaccagtagcctctaagtcctactcttctgcctgctcaagctggtctcgcttaaacatgctggcaccttcctagcttggctgacctccctgggtcagaatacttggctgcctggagccttcgtctctgctagagctgatttggcccagccagtaattgtttcttctgtcctgtctgtgcccaggccttggggttataggaagaccagaagcctcctgtaggtgggacctgtgccatcttctcacattttacacacatgccatacccttaagagttatgttccctgatggtccacacaagagatttaaacagacagatacaactaaaatctaaaaagcctatattgatcttacacactatgaggctcttattaagaaaaaaaggcattggaaatttaagttttatgaagtactctgagcagtgacagattttcttagactagaaaaacatcaaggtgctcccatttggaaatgtacttgttcatttttgtgttgtattgatttctgtccaggtattttctttccaagttttatagtttttttcctttctaattgtgtcgataacaagggaactggtttatagcgtggctgtgagggacagcagtgctctggggctgggcatcctgcactcaattaaccttcatatttcacacctaatcattgcagtgtggcaaagcgctccctggcctttcaaagcaagaggactgctgtggaactgtgggtacctcctggggctttaacaaatgccagaaatgccccaagaaaccatgtaagtaatgtttcctcactcctttgcaggttaatgtagcatatctgttttttatgattactcctttaatgatgaggcaatattagactttcaaagaactctcctactgaattctagaatgtagtactatgatgtgcatttccagaaaatttgcaagtctgaaaaagttttcatgtcaattattttgtaataagcacagttattaattatcctctttagttggattacttatggggaaaaaaagtcttaagtggtaatgagttaaaatggactttttgtctcaggggaagagaaaataagatctcttttaaaatggtaaataaatgtttcaaaccctgtaaaaagtacagttgttatttcctaggtttaaattccttaaatgagatttttattaatgtccacaacttatgttgtagtttttgttatattatcggttttcaaatttcattaaaaggaaagctaaaatggagaaataattggttgttgatttgtaaaagagaaatttataatcactaggacacaattctttcccattttttctgacactggttttatgctgtcacagacctcagcaacattaatctatattaacacccccaggctttgatttgcttttattgttcagaacatgttgatttgaataaatcagatttacacctttttaatactctattcctgacaataatttgtacctttagtttttcaatgtagtattaactctggataactgatttctaataaatacttttttttctttttgagacggaatttcactattgtcgcccaggctggagcacagtggggcaacctcggctcactgcagcctccgcctcttgggttcaagtgattctcctgcttcagcctcccgagtagctagggttacagacatctgccaacatgcccagctaatttttgtattttcagtagagatggggtttcaccatgttggccaggctggtctccaactcctaacctcaggtgatctgcctgcctctgcttcccaaagtgctgggattacaggcgtgagccactgcgcctggccataaatagtttttagagacagaggtgactgggtttaagttgagctttctgacccttattcatcatgtttttgccaagagagcaagtgatatttttgtcagtcatctttctttgcctcatataactgaagtttttataatttttttattctttgtactgcaagaaatttctcatttgctttaaatgaataatttttgtttactcctcttatctgttgatttgattgtattctcaaatgccttttaaacctctatattcaatctaggatttgccatctgggcattagtattccatatctctttcttacattatttgttcttctaccagtataacaattcattttaagtaattgtctctcatttggacttctttgtctcacaaacttacagattttctaaatgcctaaagcaagtaattttatttattttgttgatactactcatctctttttagaagactaacttgtggaaatgcccaccgaagttcctcataattaatgaattcttcatttacaaaaataatccatgtaaataaggacattttcagtactgagagaattttccaagcagatgttctaagctgattcgatgatcatttgcaatgcaaatttccaggaagtaggttgagtgtgatggttcatcgtcactggaagatccatttgcttaaaattattttggcaacctgaccaaagggatagctatgatgcatttggtttgatttaaaaattttagtgtttgaagttaggtagccctgagttcgactcccagctctttcatttgctattgagtcttagagctcattaagcaggaatctatacctaaaacgttgaaaaggcgttgccatctttttttttttaaacctgcctctttgtttaccatgtctgtctgtctgtaggaatattgaggaggatgatatattttccactgtttggtctaagaattaaggatgagggaagttaggttcatagaactttgttttggtcctaagtctatgttctctaatattaaataccttccccatctgtcttatttttctttttcattttcatttacccccttctttgtgtatcttttgcttagctgcttctcttctcttgtgtccaaaccccaaagtagcagggatgtgatagacattaaaggtaaagagattcctactgtccttttattttttttttaatccctaacttccactcttgaccttttgtcgtttttgtctagaattgcgtcatttttatctaagatgagttcactgatgtctgtggtttgtgagctctgtattttaatcttgataaggacttagttgaatgtgaaagtgcaaagttgctgtcacttttaactaaatgttggtgaaaaaaatccatatgttggctcatttaatgtataaaattgaagagactgccttcacttcaggaagggcaatgtggactatgaatgaagtaaactgttaacatcttgacatttattctgtttgtgtcctcttaagtgactcactcccaagaaacacactcagggtcacattcttcctgtgtcatttaaaaagttttcctttccttggttgggactcctctctaaatcatattcagtttggaaggaagcagactttccttggctttctacgctatggttttgtgttccacacctcttttttttcactcaaactagttcaaactttagttttcaagtggcttttatttaacatttgaagtttttgtttagccacatacagaaagacctttcattgttgatcattttttttgctgtgaatacttaattttaaatctgcaaatgatttcttaaatagtttgtgacccattagaaatgtgcctagcatgaacaagtcacttgtcctttaaaacttttgagaagaaaatgaacataaaatcctaagctgaggaggactgtaagagattgcctggtctggctctctgccttcaagtagatgactgctgaaagttctaaaacaagttcatatccatctcttttgactttgaggaatttgcagccagagatcccacagtctctgcaggatgcctgctctagaggtctatgggacaagacagacctgaggccaaggagctgaatggagggactcccacacgcccatatctcccgtcttttaatttgcctttcccagatgcctcactctgatcttctcttttaggcattcgggggaatctgaagagaggggaaatacagcaaagaaaagaattgaaggagaagagggacaccccagtacatattcaccctgttcctttagtggtgacagataaagagcatatggggaggctgaaataattttattttttaagagaaaatttccctttttattttctactttccccttttactcctctttcaagtcttttttagtggtttaatctttcatcccattttgattatagcttgttttctgttgcacagtagcctcttaatagaagaattccttactgcaggacatagcaatggcatttgacactttgggagtgcttatcacacttaggccctgtggtaggcatttttcatgaattatctctaaattgcagaagaattcttccctgctcagtagatgggaattaccctcattgtatagaatttctgtgtgaaacccaagaggcttgtttcccaaggtcacagctattgataggaagaggatttgaaatccacttctgccacatcccagaactttggctgcatccgctatgccaggtgctctctcaagtctcactctagagtatcagaatctcaggaaatagggttttgttgagaagttggtgattgcaacatttgtattgtttgcatattctgagtgtagcccttttaatttcctgacttcctctcatcacctgcctattcttctctggttcataatggtgagaatcatctcatgactgggatacccgatccagcaattaggatgagtgtataatttattgtctaaagtgggacactttggggagtaaagtactgttaattaactttgctggaataacagacatcacccagaatgttccaggacgtgtagtaaccctacctacaatggataagaaaatccaaaacctaaagcacatcaatggggaggaatagatcctttgtgatggaaatatgtaatcactaattagaagaaaatgtacaacaatcttaggattgtttcagttaacgtaataaagatttactgataatttcttgggactttattgcaaaataagtatcctgaaaaataagcagaatgggaaaaaaattatggagatatacattggtattggtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgatggaatgcctaccgggttataagcgggttaacaacaccttttgccaaggtaagactaactgaattcattgatgtggactcaacagttgttttggctttttagaaacttcagttgtttgccacggcttgctcattcgcccagcctgtcacagtgaaccacctcatgttcactccttttggctaaggaaatgtaaggaaataagtttaaaatatggttattggaattgctttactaccactgaaacttgatgcaagtttttaatctaaaagagtttggatagaatttaaaagagtttggatcacattagagagcacactgtggtttccatgctagtcacctcatatcctttcatgggcgtgtgcacacatgtgcttgcaggcacccacatgtacttagcagttctacttcattgccaatgcatggttgggcaacagaattcccttttctcctctcatcaaaatgttgttggtcatctcaggaactagatatcagagtaaacacattttgcctaggcaataagaaaagctatgtagctaagtgtgaaatgccctgagtacttttgtttggtttatgttgaacagtacagcaaagttgtacaagcagggggaagctaggagattgtctggtacagtgtctactttataaatgagaaaactcaagcccagagaggttaagtgactttcttgtggcagcatagagctgagattataacttgagtttaccaaggcctagtttagtacccatatatgatatcatattttgttttagttactttatgggaagaccaatgcttctaatttccctttacatgtctaggatgaagatgttgttattagtaacttggaaatatgtatacattgaaactgagaaagcagagagcctcccagagtctgatagaaccaaaagccatgttgagaacatggcacatgtcttctgatttgtgttctgaggctctgtatccttcaccaccatatgtatttaggatacagtagattaaggtcatgttacagagtataggttaaccccctattcaaatggctcatgtcaaaggaatatcttgattacctgagaattttctcaagtagattgtctatcaccctattcaaatggctcatgccaaaggaatatcttgattttttatctgagaattttctcaattgtctatagtgcatctgtgtaacttttatgatatgtagagtctttggtaacataaaagaatttatttagaaatgcacatacagtctgtctttgaaagactttgtcttaaaaatattgtaagccctcatgtgtcacagaatgttgagaaaattagaattaaccacttaaggagaggacacccatgacacattttgagaaacatctgctaaacttagtaacatgggaatagtggattaatctacattattttagagtcagaatttaaggtatcattgaattaattagatggatgaatgagtaggttaaattaaataatgaatagattttaagatgcatgttttacaatataaaccaagttattgttttatagatttggataaaagtctatagccttagcacatctgtaggatgcattagtagaaatggaatgaacagggcagtggaagtaacaaccttgtacactgtgcccctcagactgatttggggtttgggtgttcagtgttcattattgtcttttggttaataaagtcaaccaagtttgtgaaggacctagaaacatgagtgtgtttagcacgcagaagtacagactgaagagaaatattatggctgccctataaacacgccttaaaatgtttgtaaacaggccactaaatgattaactgtcctacaaaacaagacatacctaataacaggggacacttcaggaaactcggtgtcgaggggctaaaacttatgtgaaaggctgagacgtaattcctttcttctcatgcacagtctctgtcccaggggactgatggtaatgatagcatcatagaactggaatgtgcctatgggccatctaaccttatatgctgttcaggataaaaatactcttatcatatccctggccaatagttattaagaagctatcagatcacctctgtggacaggaagctcagtacttccaaagacatttcatttcaaggttgttggggaactctattccacagaaaaggctttcttgtagttgttccgttaaactagaggacagaggagggtccttatttatccttcactaatccaatcctgcatagctaattgttagatacattttccagaatgtcagatgctcctaatttctcttaatgtcaaatggataaaatatacatatgttctcttggtatggtgtgtttatttgtttgccattttttaccattcatagatatttgaagacagaaggcttactctctcttagatagttttatggtgttatttcttccttacgtatttagcgtaattcacaggagaagacatttggtcctgaagttttcttttagaaagtgtttcggttatggagcaaattaatagctatactattattcagatttcccattactactttgtgtcagttttaataatctgtattaccttagaaagtgtcattttatccaaaatgtcaaatgtattaatatgaaatgttttcctaatatcctcttttctttttaatttatatagcaacccccatcccttttagttatattgctacctgtgctatatttgtttttcttgaattaggcttgccagtggtttatcaatgttaccaatttttcccccaaagaatcagttatttgttttgttgaaaacatttgtctatttcactaatttctgatctttgttttcttttcctctacctttttgttcaattgctactatttctaatttctttagatgcatacttaggtcattgatgtcagcctttcttctttttctgaaatgtaaataaaaggctgtaaatttctatcagtctagattctgactttaactgtgtcccttaattttgtgtcattttcttatctttaagttcaagttttaaaaaaatttccttttattttttatcagcatataataattgtacatatttatggggtatgtagtgatgttttgatacttaaaatgtatagtgatcagatcaaggtatttagcaaatctatcatcttgaacatttataattggaacattcagtgtatcttccttctacctatttgaaactatataactacaaaacactagaacttattcttcctatttaactgttgtattagtccgttttcacactgctgaaaaagacatacccgagactgggcattttacaaaagaaagagatttaactggacttacagttccacatggctggggaagcctcacaatcatggtggaagccaaggaggatcaagtcacatcttacatggatggcagcaggcaaaagagaacttgtgcaggggaacacctatatttaaaaccatcagatcttgtgaaacttactcactaccacaagaacagcaagggaaagacttgtccccatgattcattacctcctaccaggtccctcccacgacatgtgggaattcaagatgagatttgggtggggatacagccaaatgatatcagctgtcattttgtatcttttaacaaatctatctttaactttacctcccctctacccttcccagcctctagttatcttctgttctactttttacttcagtgagatcaacttttttttgcttccacttatgagtgagagtatgtggtgtttaactttctgttcctggctgatttcacttaacataatgtcctccaactccatccatgttacacaaatgacaggatttcattcatttttatgactgattagtattctgttttgtatatacaccacattttctgtatccattcatgtatttttggacacctaggttgattccatatcttggctattatgactggtgctgcaataataagttcaatttttaaaaattattctgattttgttattgacccatggattatttagaaatatattgcttaatatgcaaatacttgtgaaatttttcttgttctatcagttgttgagagaggtgttaaaattgcctgctacgattatggaatggatttttttctttcacctctggcaaatttcagtctgtgtttttttacctttacaatgggtgtcttatagacaacatgtagttgagtcttgcttcttttctacattctgatatctctgcctcttaataggggtgtttattgcagtataatctaaagtaattgatcctggcataccccaaagttggggcctagcctgagagggtttttggctctgctcaggaaagaattcaaggctgagccagcagtgaaagaaagcaagtttattagagtagcaggtacagcagaatggctgctccataggcagatcagggctatcccagaggtggggtggcccagcatagtagcagcagcgtacagcaacagtagccatccggagcagcagtccctgtaaattgctggctagctatatttaatactcactcttaataatatgctaattaaggggcaggttatttcgaattttctagaaaataagtggggagttcttggaaccacgtaagataacttctgggtcactgtcgtggcatttgtgaactgtcatagtgctggtaggagtgtctttatgctaatgagcagtgagggtgactagaggttgccttcatggccctcagttggttctggccattttttctgctacagcctattttgattagcagggtcatgattagtgctcagaaaataagtcctgctgatctcctacctcataattattgatgtggttagatttaggtctatctaaacatctttgtctgatcaggaattttttttgttcttttctttcccttttcttagaattccattttatctattggctttttaccaatatgtttttgcatcattttaccttttttttttgtcttttttttgagacggagtcttgtttgttgcccagactggagtgcagtggcatgatctcagctcactgcaacctccgcttcctgggttcaggtgattctcctgcttcagcctcctgagtagctgagtagcaccaacacacctgactaatttttgtgtttttagtagagatggggtttcaccatgttggccaggctggtctcgaattcctggcctcaagcaaatcacccgtctccacctccagaagtgctgggatcacaggtgtgagccactgtgcctggcctttttgtattattttaaagggattactctaggaattataatgtatgtagtaactgatagaccgtttgtattataattcctagagcaatcaggaatttgacagtttaagttttcatagcctatttagagttaacatagtacctctaaacagaaaatatagaaatcttgcctccaagtagctcctctttttggcctgaaaatcaatcccctacttatgccccatgccacacccttagtgaaaaccaccatgacagtctcccagacagtagtaggatttcctcttactctgtgttggaattatttattcacattatatgttgttgttcacctctttcttttcctgacaggctgatttctcagacatcaaggacccagtcttactcacttttgtgaacccagaggcccaatttttaaaaaatagatttgatgtggatgaagaaagggttcatttgttattgatgagataagaagctctttttttttttttttttttttttttgacagagtctcgctctgtcgccaggctggagtgcagtggcataatcttggctcactgcagcctctgcctcccagattcaagcaattctcctgcctcagcctcctgagtagctgggactataggcgcgcaccaccatgcctggctactttttttatattttcagtagagacggggtttcactgtgttggccaggaatgtcttgatctcctgacctcgtgatccgcccgcctcggcctcccaaagtgctgggattacaggcatgagccaccacgcccggccaagaagctcttattatagctttattttatttggtccagtaccaatgacttacaaataaaaccaacatatttgtagtgattcatgataaactatgtttgtaagcccagaagtcataaacttataaagagggaaataaataatgaattaatttgattttaataactaaatttactgtgtgccagatgctttgtttaataagcactttatatcagttatctccattagcctttaagttttctatttaaagtaggcactattataccccattttacaggagaaattgagacctagagaggctaagtcatttgtgcagcatattgctaataagtgctacatgcaggaattaaaccaaggtagaatgaggccagaacttatgctatcaaccgtcttgttctgctttagggaaagggaactaacctttattgatcatttactatgggttagtccatatgctatgtacttggtttaatcttcaaaacaatcctatgagatttgggcattattattctcaattagacattgagacacagagaaagtaaataactttcccagggtcacaaagatagttaataagcccaaccagggttataccctttttttttttttttttttttgagatggagtcttactctgtcgccaggctggagtgcagtggtgcaatctcggctcactgcaatctccgcctcctgggttcaagcgattcccctgcctcggcctcccaagtagctgggactacaagcacacgccaccacacccggctaattttttgtatttttagtagagacagggtttcaccatgtttgccaggatggttttgatctcccaaccttctgattcacccacctcagcctctgaaagtgctgggattacgggtgtgagccactgtacccggccctaaccagggttatactctcataccacctatggccacctttaccaattatatatttgtttatattttgtaaaatatcactaatgcagatactagctaattagaagttatgccatctgttgtgagagctaatagaagtcaaagcaattaatattaattttgttttatttcattaaaaagtgatggttatcagccagatgtaatggctcatgcctgtattcccagcactttgggaggctgaggcagaaggattgcttgaggctaggagtttaaaaccagcctgggcaacaaagcaagaccctgtctctacaaaaaaaataaaataaaaatttgctgggtgtggtggtgcatgcctgtaatcccagctactgagaagctgaggcagaagggttgcttgagtccgggagttcgaggctgcagtgagctatgatcgtgccactgcactgaagcctgggcaacaaagtgagaccctgtctctaaaaagaaagaaggaagggaggaaggaaggagagacggagggagagaaagttgtacaatacatttcttttactggctgattaatgttttgaataatttatattaataaaaataccactttagaagtgatagaagtgcaaatttgcaagtaatcacttgctatctattttgtatgttagaatggagacttattcaagtaattgcatgagtttttttgcattttcctctgtcggtacggctgactgacccttagcaaactttgttcatactgagcatattagatggttctgccttagtcaattcgctgatggtctactggtaacaccaaatcctggcttaggtctctggaggatatttgtaaagcagtgttatactttttggcaatgattctaaagtgaagtaacacacaaaattctatttcatgggtcctcaaggaggcactgctaaattacattacaaaggcatttgactcataatatgatttcattcagtaaatctattgaaattactattgagagaagggcttaatttcactccctttgtgatattgatggtcagtaaaatgaaatcgaacttgctcacattacatatgtacattcagttttcctagaaccttgaagctttttgattttgttttcctaaaggttttcaaaaggagcccatttagcatctaattgcttgtgccttccacattgttcttacagtctaatgtcttctcagtttacaaagcacttttaaaattaaagtggttaataactagaattacattatttccttcaactaagtgaactaatgtcctgaaacaacttttactaatgtgcactcagtaacaaagaaccaactgtatacatgttaatttgaggagctttcaaataattgccctcaaagttgttttttttcctcctctctagtggtgctgcaattatcttttcaaagggatgatttattacatatacacacatggagctccaaaacagccttgctactctcagcattatggaattgttataatttgcttcatttatcataacaaacaatatagttatatgctctgatggatctagagcagcatttgtcatttgattattatgctataaaggtctgatgtagaactagaattaaatgaaataatactaagagctcctacgtccatgctgcttttctttaatactcagtccttccctgagtggaaatactgagtaccctcttttgtccatattttgccataagtgggttcttaaaaagttagatgtaaatctaagtttcaaaaatagaatttggttctgaaagtacttggggaatcagtctgttgagtgattttattaaaagcaagtatctcttttgacataccaaagtcacttaccagtttcagtttacaaggataaaatcaacttagtattatttgctacatttttggcacgtactgtgggcaataccacagtacctcagtacgtgctgaatgtaattaaaagacatctacacttttataattcagtgtatgtatattcgtttttcatagatcatctcgaagactttttaaatgactcagtattccacaaacattaatcgctggggcactcctagctatagactgaaagtatgtgtgatgaatgatgggtaagacattgttcctgcccttagaatttagtgtaatgaaatcactttgaatgagcaggatgcaatgtgctttatttactcttcgaactagctgaattttagctggctccctatgagcccgttaaaggaaataggaaagagctagccacataactttctttcagcatcgttttattatactcgttctgctttaataaaataaatttatgaaaccgatacattgaggcacaagaatactcattaccaaaactttcagcctaggctccttttagataaaaagttcctcggagtgcatctgaaatcacattttgtttggacaaaagaagagataatgtacctgttttcagggggcatatctgttattaaatgagactccacagtcttgatcaatattctgcataaggactttttggctacaaagcgcttgtctggactgtagcttgcatttcagacctcttcttaatgattaccaaaaaaatactgagtgtgaactgcagtactgtgagcaggtaaaggcagattggtctttgaatgctttgagaaccctagataaatgagcactagaaagtgcaggtgagacccccaagaaagcctgcctggctggagaaaagaatgtgtcttgtagcatagtgctggattaaaacagacatgtagaatgaggtgaaatgattgagaatcttaaggcaaagctcttataattaatcgaaccatttgcatgcaattaattatgggctttgtgatacgtgctgggaaaacacttactggatttgttctgcttttaacataatgttaaagaaaaatattgtttataacatttgttaaagaacagtaagacagattttattcaggtaactgttgtaacaggtataagaactactgcagtggagttttggggtaggggagagagattgggctcaactctgaaaataaggaaaagtaaaagtgtatcaccaaggagtgagggtgagagtgtgatatcagtggatgaaaaattactaagaggacacatgaggggtaaggggggattctggctcaaccatcctaggagggtattcttgctgaaggcagatcagggtgaccagacattacctaggggttggtggaagatgaggaacccaatcagatatccagcatgggggattctggctaaactaacttaagaggatattagctaaaactggacaatgcagagacaaatacagaagcatacatgaagtcagagctagttgagaagagggttcagaggagcctgactagagtttgatcaaggagagcatctttgtcgatggaacactgaaaggccattatggcaacctcttggatatttgaaagaaaatggatttgtggcttagaccagagtcattattttacaggtattgtcaaaggtgtacctaatggaaataaagcctttttccctcatatagctaatagttaaatgaatttactgtcatttttctgatggcagtatttcttgtatcctgtgcttgtttcctgcatttgtttcttcttttggggaggatttgccaaataaaatccagaacccagttaaatttgaatttcagataaacaacaaataggtttttaaagtaagtacatctcaaattatttatttgaaattcaaatttgactgctatcttgtatttttatctggttaatctgtattttgaggttatattctttaacagatcctttagtgagggtcactaaagtatatactttatgtgtctgaaaatatctttattttgcactcattttataatgagactactcgtgtgtacaattccaggttgatagttgttttctagtggtgcttgactacattataccaaagtcttctgacttctgtgttttgacacctcttcctttgtagataatgtgtttctctcttttgagataatctcctaattctttatgttctgtagttttatcattatgtgtctatatttagatttatctttattttactcagtgtaatgtcactctgaaaactcatgtctttcctcaaatttgaaaagtgttcacctattatgtcttcaaatatcactttccaccatgcttttctgctgaaactctcattaaacaaaagttggagtgtgtttttcatggctcttaaaaaatcttttgtctttttattctctttttcgctgcattttgaatggttatctcagttccattttccaattttctaatttctgctttactatgcccatctaggctttatctcatttgttacatttttaattttaagactgtttttcatttccaaggtttctaataaattattgttcatagctacctgttcttgttttatattgtttaagtattcatttaactggttaaggtatgctaaaaatccttaaagaatcttggtaagaccatttcgtaaaattattctcatctagagaatatttgtgttcaaatcattggcttcaattagtttcttagcaaacaagcattaaaatttttaattgggttgataagctcactttgaatcagaagtttattttcatcctccccacccttttcctttttctgtctagcaattttatggaaatttccacttggagtttggggccgttggtctagagctagattataatgatagcttctgacccatggagcttttctttttatgatactgtttgcataagaatgtgataattttcctttttctaatattagtaaatttactttttgttcatgattgccttacacaacttttcaatctacttatttatatattttgctaactttttttttatttttattttttatttgtttatgttaacttttgttgaatgactattcagtggagccattgtgttaagtacattggagacaaccttgtgagataagtagtggtttgtgtgtgtctgtgtgtgtatgtgtgtagctccctcttttctagagcttatcactaccctttcaacttcagatcaattttatcttacgaactttcaaataattcagtaagtgttttctttagtgtctggcttctttcactcaacagtatatggccagcacaatttttatttttagaattctgccttataaagtgaaaatatccattgatgtttttatttaaacaccttttcccctcttccatcttgttcttctctgacttctctgcttagaccccattgccccaaagttacagctttgtctctaaagttgccttcagttgcattatcataagtgagttgctatgtttatttctttctagaaggtttttgggaatatataagagagtgatgtgggcataaagatgaaacttagacgagatcgggcacattcagggtggtatggctatagacacgagcattcctatacaccaataatagacagacagagagccaaatcatgagtgaactcccagtcacaattgctacaaagagaataaaatacctaggaatacaacttacaagggatgtgaaggacctcttcaaggagaactacaaaccactgctcaaagaaataagagaggacacaaacaaatggaaaaacattccatgctcctggataggaagcatcaatatcgtgaaaatggccatactgcccaaagtaatttatagattcaatgctatccccgtcaagctaccattgactttcttcacagaattagaaaaactactttaaatttcatatggaaccaaaaaagagcccgtataaccaagacaatcctaaggaaaaagaacaaagctggaggcatcacactacctgacttcaaactgtactacaaggctacagtaactgtatatgcagaaaacagaaactggaccccttcctcacacattatacaaaaattaactcaagatggatgaaagacttaaatgtaagacctaaaaccataaaaaccctagaagaaaacataggcaataccattcaggacataggcatgggcaaagacttcatgactaaaacaccaaaagcaatggcaaaaaaagccaaaattgaccaatgggatctaattaaactaaagagcttctgtacagcaaaagaaactatcatcagtgcaaacaggcaaactacagaatgggagaacatttttgcagtctatccatctgacaaagggctaatatccagaatctacaaagaacttaagcaaatttacatgaaaaaaatcaaacaactccatcaaaaagtaggtgaaggatacgaacagacacttctcaaaagaagacatttatgcagccaacaaacatgaaaaaaagctcatcatcactggtcattagagaaatgcaaatcaaaaccacaatgagataccatctcacgtcagttagaatggcgatcattaaaaagtcaggaaacaacagatgctggtggagaggatatggagaaataggaacgtttttacactgttggtgggagtgtaaattagttcaaccattgtggaagacagtgtggtgattccttaaggatctggatccagaaataccatttgacccagcaatcccattactgggtatatacccaaaggattataaatcattctactataaagacacatgcacacatatgtttattgcagcactgttcacaatagcaaagacttggaaccaacccaaatgcccatcaatgatagactggatgaagaaaatgtggcacatatacaccatggaatactatgcagccataaaaaaggatgagttcatgtcctctgcagggacatggctgaagctggaaaccatcattcttagcaaactaacacagaagcagaaaaccaaacaccacatgttctcactcataagtgggagttgaacagtgagattacatggacacagggaggggaacatcacacactggggcctgttgggaggtggtgggctaggggagggatagcattaggagaaatacctaacgtagatggcgggttgatgggtgcagcaaaccactatggcacttgtatacctatgtaacagacctgcacattctgcacgtgtatccaagaacttaaatataatttttaaaaaagatgaaacttagaatatattgttcttggtatatgttttggaaataatagtagaaaaccaacaggtaagaactaagactgcggtcaaccagacttgataattctgttcttcaaaacacttagaaatgtttaatattccttttgtttagcctgccagaggttaatcataattttctattgtattttcatttaatctcagaaactgtcatgtacttagtttgatgccagatcatgttttacagtggtcaatggctcagtgggaactgatagataatttactgatttgaaggtgttaactgttctggtcatcctcttagaactactgctgcactttctagtttaaatgtgcacagtattttcagtaagaatttaaacagtttttgatctggacctgagcaccctatttcagcatttgcaaatcaaattgggacccattcctgtgcattttagaattatttttctggtgtgtcctcttactatgctgggataggtttcaaaaaggaaatgtctgtttattttattaactcttcctcaggaaagacagtggtgaagtgagtcattagcacattgtatttttcaatagctctttgaccttaatctctgtggctataaaatgaatgggaagatgcctactgtattatgagtgatgaagaaagcccatgatggattcatgttactgtgaatatttcaaggagaagttaatgtaatatctgtagactacagtcatgaatccaagaccaacagagtaagtgtgtgttgctagcagcgtcgtccatgtgtagcacacatgtgtcaagaaataaatacaagctgttctctgggctctgataattcctttatcatgttaccccgaagacagaagaattggaaggaaaggagttgctgccacagtggtttgacttttttcagtgagtccagtgattgaatccatcctatggtggatggtcattttataatcatgggacagttacagggtggtgggtaggcttttaatggcagtggggcctagatagaagcaaatataatcacgaagagactcatacaatagtctttgaagctggccccagagagcagcatttcacaaaaatgtttccacagatgaccagttcagaaggatgttaatagattgtgtgttaaaaagggtcccacagccaaatgtgcagaaaaaccaagttaaacacagaaaaacaagagattttgccaaaggactcttcgggttttaaatatgcttatgtatatagaataggcagtgtttctcaaacatatttggctgcagaacccctcttttagcagaggtctcacaaagtctgtgttttgtgtaaaataccttgggtaaaattgctctagaacattggttttcaaatatttttttcttaatctcctagaataattttgaaaaagttatgtgttcacatatctttaagctgacatctacattttcattaaaaagtcaagtggatacaataggttaatttctggcacatttatattgtatgtgtgcattaaataatttcatcaaaactttggagctgcagaattggttcatgccattgataaacagtctctgccatttaacctaattggtaaagccagatcttcttatgaaagaaatcggactcattactttttctgtgactctatcctggggttgatatatttgtgaattgttcatttattctgtgcctgtgagaattttacctttcaagacagtgttcttagaaaggcctagaaagattctggattgacaagaggtatgccttgacttggtcaagagcaagaaggccctgaggaaaggggaagataggaaaggaagattggcaaatatattcttaggcagatgacttcaaaaagaaacatctgaaggctgaagatctatagattagttcccttaaaagtgtctaagcctgtgtgtaccctatagaatatcttcatgttccttcgtggtatgtctacccagtgcaaagttgttctttggaagtttaagaaatatatatattgtctaagtgatccttattaaataacttaatagtctgtctgggaaaagtatttgtattaagaggtatttttctgctttcaagtggaaggcatactgctaatggaattctgtcatggaatttatatttactagcaaaagctgaacacacacagatgaatctccagaaagcttcatattttcacacagtagaaagatgctcatgtcctgttcttaccttgtcctgactcctgttggacatgcctcatttcctgtataaacttgcgtcactaagaagacagtaaattcttactcactttgttaaacatacatactttcctgtaggagaagagatgcataaaaatatatttatttcccagaagggcacttgtgctgttcgtaatatattatgcaccaaatgtcatactttctttattccctggcattttcagccctggcaactggcagattgttttgaagtcagagaatatttaaactacaagtaaccttggggataatatagttcagcccctctgtgttacaggagaggacactgagatcaagagaaactcagagacttgctctgggtaacataacattttgtcctagttggaccaaaagctagatcttagtggaatattcctcctattattttcccccatcctctccatcctttttagaaatatggccttggacgaaattatctctgtaaaatggaataattattcttgtactgctcaccatccagaattgttgtgaagttccagtgagatacggtgtgctatagaaatgtaaagaatcctgatgaggtagaaggaagatgaaggtcctcacttcatcgtcaccttatcgcatcattcccatgtactgaaatacttaggctgttttatgttgggttgttcatagggagtctcttgttatgcatgtatacctgattactttatattcttctactacctggttaataaaagcccagccctcttatttctgttgtattagtttgaaccataggacattgccaatatttgaccattttagaagaagagcagttttagaagaaaagcagttttgtgttcctgaacttcatctgtgagctgaagtatgtggtaggctatacaggcagagatacctgtaaatgttttaaataagtggaaaagtatgtaaagctccttcatgttagctgtagtagcttcatggattttgcctactccagaggagcacatgggtccgtatgaatttctttcctagtttctgtttctgtaaacttctagactgcctgcctgaacacaaaagctcagatggggatagggaatggtgactggctgtatgtgggtgctgagccccttcagccatttattttggccttcattctttaactcaggaagttgttctgtatgcagtggttataccacttcttcaaaggacagacttccacagttttccagagaaatttgtcatctatagagggagaacaaggaataaattcatgtatttttcaaactaaatattaaaatacttttgatttagttagaatctgttgaggaaggtttgttgacgctttaaaatatgagacttggccggatgcagtggctcacacactttgggaggctgagcactttgggaggccgaggtgggcggatcacttgaggtcaggagttcaagaccagcctggccaacatggtgaaaccctgtctctactaaaaatacaaaaaaaaaaaaaaaaattagctgggcatggtggcatgtgcctgtaatcccaactactcaggaggctgaggcaggagaatcgcttgaacctgggaggcgaaggttgcagcgacctgagattgtgccgctgtactccaacctgtgtgacagagtaagactccatcttaaataaataaataaataaataaataaataaataaaaatatgagactcctgaaacactatattgttatttgaatttattccttcacaaataagctatttataaaatgacaaatattgtaatcaggttttatttgattaaagaaagaagatagctttaggcaatgaagtccaaatagaattctggtttaccattcacccgtcacgttccatacagttgttaagtctgaatagaattacggtttaccattcacccatcatgttccatacagttgttaagtctaaatagaattatggtttaccattcacccatcacgttccatacagtttttaagtataaatagaattctgctttaccattcacccatcacattccatacagttgttaagtctaaatagaattctggtttaccattcacctatcacgttccaaacagttgttaaactttggcctgatgatgtcatcacttggaatgttcttctctcatccagatacaatgcgttcagttcaaccaatgctttgttcttaacgtgtttgtgagtctctgacatcctttactttaatttagaaagcttgtgactacctgtctaggaaaaatcacttaggcagttgctcctgtttcttaataattagaaatgtcttattaatttattaatttctgaagtcctatgttaaaattatggggataagttgtttgttggctgggaaggggcacaaagaaccttctcaggtgatggaaacattctttttttttttttttttttttttgagacggagtcttgctctgtcgcccaggctggagtgcagtggcgcgatctcggctcactccaagctccacctctcaggttcacgccattctcctgcctcagcctcctgagtagctgggactgcaggcacctgccaccacgcctggctaactttttgtatttttagtagagacggggtttcactgtgttagccaggatggtctcgatctcctgacttcgtgatctgcccacctcggcctcccaaagtgctgggattacaggcgtgagccaccgcgcccggccagaaacgttcttaatcacaatctgggtggtggttacaccacaagtagatatgcaaaaattcatctagttgtatacttaagattgatatattctagtgtatatacgttaaatataggaaacagaaatctaatctctaatttgtagtagctcaggaaatataaaaaaatagatgaaccaaggcagttgaaggaaacagtttttctggaagctgtgagaatgtgtcacaaaggaaggcccaggcttcctgggttcttcgggccaaaattaggggaagtgttggtgccagtgccggtggcacaagctgattaaaacagtcataacaggaagagtcttacacgattcttcgtctttgtggatgtttctgtttcttcctgtctatacctgataggtttgcttggtcattttgtttgttttcttccgtctgaattcctgtcctccattcccatggcatcagagtcaaggcagtaagcagtgtggagagtcaaagaaggggcattggaagagggtactaggcattggttgtaaatcaggtatttatgagtctggggggaaacctctacattaacctggcagccagccgcaaggctgagatggtgctgttatagaaaccacctagcaagggaaaattctgggtcctcaatcttatcatggaatgtgtagtggtgcagccaatgaacaggaatacaggccattcaggggaagaggaatgctaataatcataccctagtgaggatatgaggggaaatagaagagtggaaattttgtccagccttcttgaccacaactggctggttacccaaacttgaggttttacttgggacatataatagggcttcacttgtaccgtgtaagctccaactggacttggcactcttcctggtccttcatggtggttttcttaaaaagaatgagttacgggggaatattttcagttacatgctgtacataaaagtgcattacagaacaacacacacttcaataaataatgagatggtcaggtgctgtactgtgtgccgtaccaggtgtcatctagctgtagcagtttccagctacgtgcaagttggaacaccatagaatttatacagcaaatatgcattaacttatcatttgaatgtcacggaaggtatcatattttatcactgaaattaacttaaaaattgcatgctctgagtaaaatatgtacgtatagatcacgatgcctacttagaacatgaaatattgatgttcatataatgttaatatttgcttaaatagtgattgagggctgtattttctttttatgtgatgatcctgatagtaatgttttgctaccattgtatccaactttttgattttcaattaattacctttgcaagtgactatataatctttctttgtaaaatcacttcatttatatctctcctctttcaaatcgctttgatttccccctggatctccatatgcagagtatcttaagtgtctatttgtagcagtgatttcctctttcactgtatttctgaatcttctgctgctactgggtatttctacttgggtatcccaatgtgaccttgaactataaaactgaactcctcttcttcctgccttctttcttcctcagaactccttccgcaaaaccagctgtgatttttttttccttttttcttagattaggagcctcccagacatccttgactcctttctcttactttctcatgatgtgtagtccagtcaagcaccatgcattttcagttgttcttaaaaaaaaaaaaaaaaaagatttgtccattctttatcttcctgattgttctcactgtcaccagcctggctgttaccaacctcatacttgcatgaccccttcaagtgatcagacttttaatctcttctcaacaagccatgtgttggccaggtgaattttcctagagtctgtctttgagtctttctttctcctgctcagaaacctttagtatatagctccctgttctcaatgaaactgaatccaaatgcagcctgaattgtaccagctctgtttccaactatttaccttcctgaatcttcttttccagccagtggtttgactcatcatttcctgagcctccatccactggccacactctgtgctcaagctccagggtttcccacacaagtcattccttcccttcctcgcccatccatccagctcctgcccagacatcagcactctaaagccttacctcctcctcagtgccacagtctgccccacctccagcttccttctgtggcttttactgtctgtataggcaatttcataatttaacttctaacagtttatgacagttctttcttgtgatgacttggactgcttttcacttcttaagtttttcaaatattcatatgtatagttagactgtcagtgcttctagagtgagagtctttgccttacctatatgctccataatgcctaacataaactaacactaaagcaaaagctctgtgaaggccagaatttttatcagtttttttcactagtaaatccttagcacctggcatgtagtaggtatgtaataaatatttgctatataaattgtaaatgttcaataaacattaactgatttaagattattcacacctgctacatccttttttcactataactaaaagattactatagtgaaaaaggaagtgaatgcaatgtatagccagaatctgctcaatggggcttgactgctccttctaaagaattgtgttttcctgcagatattaatgaatgtcagctacaaggtgtatgccctaatggtgagtgtttgaataccatgggcagctatcgatgtacctgcaaaataggatttgggccggatcctaccttttcaagttgtgttcgtaagtaataatcactttttattcctgttttggattaattgtctttggggtttttccaaaagaacggaaatactcagtggccaactgaatgcttgtaaatatacaggaaaacctcattaattaaaataacaagcaaggggcctgcctgatgtagtaaaataaattgatatcatggaaccttctctaaaatgcatttttattgtggtgataaaaatataatagctaaaactctgaatagagactaagcacaccgaggaaatatgctttgatgaaaagaaaagagagaattaaaatggacatatcaaacttttttggtacctgagagatgacagtaagtttttccttcataaatacggtattttaagcattctttaggttgaattgaactgtgtcccagcttctgcctttaattattccaaattctgagtcactggactctgatttaatgaggtttcacttctttctcaattggaagagtctggaaaatagttaccaaggccctgtgttttagattttctaattcagtcctaatttcagatattgtcttgttctttaaacccaccaaaatgaccctaaattatactgttttgccttaaaaatgtttctgagattttcccttgtttctgataagggtaaaaatccttcattaaaccacatgttctaatattggttctgaaagatagtttcaccaaagagatactccctctccgtgtaaattaatccatgtaatcactacagatcatatgccattagagaggaatgcattttaggtgtaaagttctcaaatgcagatttgagatttttaagaatgtcttatttttaaagtaatcatgcccattattataggtaagcactgtaagattttttttaaagagatggggtcttgctatgttgcctaggctggactcaaatgatcactgttcagcctgctgagtagcatgactatagacatgggccttgtagcactgcagatttttaaagattatatacaatttaaatggctgcatggcagaaaactattaggataattttaagagcaactgtgtattagtttctttcctgcaagtttttgtttttatctatctatctatctatctatctatctatttatttttgagacagagtttcacttttgtcacccaggctggagtgcaatggtgcgatctccactcattgcaacctctgcctcccgggttccaatgattctcctacctcagcctcccaagtagctgggattatgggcatgtgctaccacgcccagctaattttttgtatttttagtagagacagggttttgccatattggtcaggctggtcttgaactcatgacctcaggtgatccacccgcctcagcctcccaaagtgctgggattataggtgtgagccaccatgcccggccacttttatttattttttaatgtggctttggtatataatgagctgcatctttcttgtctagtttgaaatttgccatttggttgacatgttcttcatgagtttactgccattcatttttaacgaagcttatctctcttaactctttgccctaaggtgagatatgtagaggtgataaaataaagacaaatgtagtaaaataaaaatgacagtctcatttattacttttaggtgagtttgttgagtcttttgaaatgttatcactaattactactcttttcctttaaaaactgtcaactgcagattaggaagttttacacgtaagtcctcttttctgtgttcttttacaaacagttctgatcatgaagcagacagacacctaattataaggctttcctaacgggtggtaaaatcagaccataaaattacatttgcacacaaattacctttgaaactgatgcaaggatttggaaatttcaggccaaaaatcacattgttgatgacatccagataacttaggggatcatttttggctgatttgaatcacatgaataaatatgttaaatcattttataatttaaatgtaaagattgtagagtttggatatagagtttgttgtgaatgctttttccacccttttataatttgacttgtagtctggttacaattcttatattgaaggttgctgattaggtaaacttgcagaactagtcacaaaacgctctgtgaaactttgaccagatctgatgtctagagttgagggcagacatccaggttttaataagattatagaaatctgccaatgagatttttgaaacacttgcacatttccttagcatttattttccctgtcattgcccaaataattctgaacttattaaacaaccatccattcttatttgaaaaataaataattcaattttatggttcagctacaacagctgaactgataagtattaagagacgtttgttgctagttaagtgttccagttgagagttcgaagtgaaaacctgggctctttaccagtgttgagtgagaagatttatttctctttcctctgaatttaccacatgtaacatcacagagacatgtagagttcctttaggatttgcgatttgaaccagtccagtctgattttcaggtgaattctgtgaagagcttgatgggggaagtctgaagacagaaggaattagggaagagggtgatacttacagagtaaaggaaataaatgaaaagataatggtatttttggtagtcacagggaagtagcaggaggggactggagatcacacacacgcacacgcacacacacacacacagacacacacacaggcactcaacacagtggttgctaaatgtttgctctggagagagagaaaaccagccagggatgaagcctgcaggcaaatggaggacaaatgacaacatttgctaggacagcatgaatttaggccatatccagagcatacaaggtgtggctgactctctgaactcctgcacatggttatggccaaggaacaacgggaagcactttctcttcttgaatgcactgaactgagatgaaccccccagaattccttgactgcagccaaaggttgcaacaatttcactttctctccttgccgcttgccttggcttagccaagctaaaaggaagaaagcaggcaaatgctggcatttgctgcctctgacctctatgtttgaggcttaggatggtgtaggagcattctccagacatgttgctacctgatttatggggaaaggtggaaattcgaggacttttcagagcaaattcaagaaaagtatcatctttgcaatccaagtaggaagactttctggctttctgaactcctgcaggaacttcagagctccaggatgagtgctgctgagaatgtgtccataggttcagtaaaaaggcccagataaaagaattctgagcctgggcttttgccttttcgtagtattcttcacccatcaacttggagctagttgacagaaatggagggttagagagaagatgtgctcaggaacttctgccgtagtcctggaagtcatgagagaaagggcaaatgccttttaattaagtacatcattcatttgtaatttcctgagcatctttatgagaaacataccatgcttatcttatacattgggaaactaaagctaggaaagtttaagtagcttctcacacagctagtagctgagagttgagatttaaaacaggatttgtgcctccaaatttagggttctagatcaggagttggcaaattatagcccatgggaaaaaatctgtttgtttttgaaaataaagttttattggaacacagccatgtccattcatttacttattgcctaatgctgcttttgtattacaaagacagagttgagaagttacaacagaaatcatatggcacacaaagcctaaaatacttattatctgatgcttgacagaaaaagtttgctgacgctcaagctaattaacactgtccaatagaactatctgagatgatggaaatattctctatctgtgccacctcatacagcagccactagtcatgtatggcctgtgtaactgaggaattgaatttttacttttatttaaattttatccaaggagcaacatgtggctagtgcctaacatattgagtggcgtagttttgtatcctttttggcaagccaaatgggttaattactgctagctttccagcttttccgttaatatgggctttccttccagacttgatattttttgcccatggtaacattttctccagagcaccccggctgggagcctgtgtcatcttggactcttttgtatcttttggtttcaaaggatgacatttagtcttcataatttatcttatgcccgttcttttctttctaccttctctgtggccatctcaggttaggcccctagcctccctcacttggaggtctcatggcaccgtggcccggaggtgagacagatctgtacaagctgcttgctcccagataattacagtaaacaaaaaccatgacaataataatttttattgcaaacttcgtaaatgccaggcactgtgctaagcactttatgtgaattatcccatataatacttacaagatctctattggatttgttctgttatttttcctaatttagaaatgaaggaattaaggcatagaggggttagggatctttccaacagtcatacagtccataaagggtagagcccagatttgaaactggatctgtctcactccacaagctgaacctttaatcaagaaatggaaaagtctgaaatgccaggaggagtaagtcatttatttaaggagaactgatattttaatctcacctgccacactatagaataggtgacgtaactgcaatggccttgaattattgtttcttttattttggttctccacgaattttttttttttttttttgagagggagtcttgatctgctgcccaggctggagtgcagtggtgcaatctcagcttactgcaacttccgcctcctgggttcaagtgattcttctgcctcagcctcctgagtagctgggattacaggcgtgcgccaccacacccggctaatttttgtatttttagtagagatggggtttcaccatgttggccaggctggtctcgaactcctaacctcacgtgatccgcccacctctgcctcccaaagtggtgggattacaggcatgagccaccgcgcccagccatgaaatggtttttaatgacacatttcccagagtgcccagtggttcttactgccctaggtaagctgcctctcagactcctcaaagcagctttacctgcttcctagacctgtatcctaacactcatccccatagatactaagctgtaaagggattaaatgctaatgtggaatttcatccaagaaatgattaaggatattacagatgtgggtgggagtgattgcagactagtaaggttagctagacttttaaacccttgctcttttctgaaatcctccctacttttcaacttcttctaagtaccagattaattaatatctgcttaatatttgtcattcacattttaacccatttatgcctggtgttccattattggaatgctgagcttgtgggagttatttatatcctgctcaaggtcatctcagtaggtctgatttttcacacacacacacacacacacacacacacacaacacacacacatttacaacctccagcataaatgggttaatacattagagtagtatgtctttgaaagtataatgtgagtttattatacaatcctataattaaggccataattaaatataagttgcttaatatatcactgaggaacccgaataatagtatcttagctttttactcttgttttgtaattgaattgccatcaccatgggctgtatggttatgatttggtactatacttgggtacagagctatatgcttgttaccagtttgaaaatttgtcttatgtctgtagccaagagcaaaaaaattactttcctggtggatgtggcattttcagtaggttttatgcttctgaagtgcttttccttttagataaagtatcagaatctttttgccgtaattttagtaacacatcctgcacaaaataggatctgacaaagtactgtttcagtgtacaaacatgtaagagcctacaggcaccctttattatcactcctcagttttattcgattctacagctgcttcccctatcccttagaaatcttttggtatttctagttttctttagtacagcataaaaccttatgactcagtagaatatataatcacatgtaccatattttaaataataaacgtagtacactaatgtgttatcctttacaattaatcttccagtctgaggttaaagatattcagacaataacaacaccaatcacatcattctgggtagcatattgtttctgggtttacgcatcatattgaccggagtgtgaaaatactagagatgtttaataaacagaatgcaagtcatttgaaatgacaaaaagaacaacaggcaatttaggtcgtaaaataggggcagttttaaatggcacaccctgtcaggtatatgtggcataaatgaacagttttggcttcaaatagttgtagattaaagaaaatgtgaatcatgaaagcatcagtaaaatttcggtttgggagaggctttaagatggttgactagaggcatctggtgctcaccccctccacaaagaagaaccaaaatatcaagtagataatcacactttgaacagatcatctaacagagaacactgaggtttaacagagaagtcacaggaaacacctaaggcagggaaggagagggaaccaagggagcctgctcagccaggattagctgggagcctggggaggctccccagtgtgaggaaagggtagatgagagacctccagtgatccacattcccatgtgaattcctgcaatcctagccacaggagagcccttcggccctcacagactctgagacttaacatagggagctgcctagagacctcgtgatggaattgctgccgagagggagctcatgcatgctgggtcccacacacaccttctgagtcttaagcaggtaccaccaccattggcacctgagcactcctctcagaggcctcaggtcaggcccacccaacgtaccactaccatcacagctggcactcacctgtatataccacctgtgggcctggggactggcctgcccagctgctaacaccagcatggactgcgtgagaagcagagggttgtctcaccactgctgctgccatcacctatgctacacccactgcccaggagcctgagaacctgcctggctaactgctatcactgctggcacctaagcaagccacgtagagacccaagaattggcccacttggacccactaacaccaatgccagtgtacgctgccctcgggcccaaagacaaacacatttggcccacctctgctactactggggctgaggactggcccacctggtagcctcatcctcggcaaaattttgcacagaatctactaacaactgcatcctaaggcactgaagaatcagagacaccactgatgctatttacaactgaagaaatcttatggagactacactactgcatgtggccagaatcaaagccaaagtgccccacccaaacagcaccacagataacatcttcaggaagtcctcccctaaaagagatgctagaggaggctgggcgcacggtggctcacgcctgtaatcccagcactttgggaggccgaggcgtgcggatcacaaggtcaggagatcgagaacatcctggctaacacggtgaaaccctgtctctactaaaaattcaaagaacaaaattagccgggtgtggtagtgggtgcctgtagtcccacctactcaggaggctgaggcaggagaatggcgtgaacccgggaggtggagcttgcagtgagctgagatcgcgccactgcactccggcctcggcaacagagtgagactcagtctcaaaaaaaaaaaaaaaaaaaaaaagatgctagaggaattgggtaagggaaaggcaagtcagaaaacctcatttgtatggtgatatgatagagaagagctttggttgggtttggggaatgggcggcggggggacaccaaacttattcagcacctttggcctgacctggacctggttctgtagaatacactccatccatatttgcattagaagatgaacttcttgaaggcagggctgtgttttgctgattttcatatttgccatgtgtgcctagcagagtatttagctgttaggttgatgaactcttatctactaaacgtatagcagaagatgaggattaaagtttaggtattggatggctatagccttgtatacttttgcagtgttttccgaagagctgagcacatcatctcttccttctctggtgtactgtctggctagaacaggggccttgtgtggcactcgaaatcagaaaccactttctgcctcccattcatgttcactggcgtagggtgagacctgatgggccctgcaagctcttacttccctgggatgagaagagcagaggctggcttgcagcatcagccatgttcctcattctccaaagtgcctgattattcactaaatgctgccctagagttatctctactgtggttaaatatagaaaactaggtagtgattttggcagtaggtgactaggtttatttggaaaggtgggtttttgttgaaatgtttctcttcattacgcacacatacctaattgcatgcttgctaaaatggaagaagagaccagagagggacagggacaatcactgtcacgacttttggtgccctgactctaaaactcacatggtaaactgatttttcttcaagaaaggtgatgctctaaatctagacagatttatcctgaagtgtggtttttaattcataccttagggttcattttactatcatttggaaagccaatgtagttttggtttctcatgtaatgtcgggctttatctctctgcttcagctgatccccctgtgatctcggaagagaaagggccctgttaccgacttgtcagttctggaagacagtgtatgcaccctctgtctgttcacctcaccaagcagctctgctgttgtagtgtgggcaaggcctggggcccacactgtgagaaatgtccccttccaggcacaggtaagacatgcccagctgtatgcgcacatagattcccagccacatgagtacacgggacaactttggcaccttgggtcatttgtggtttctgactttaatttttaataatacattgtaaatatttaatcacctttgtagaaactgtacacatacaatgttgaatcagtgggaaaaaattatgtgcaaagagattttcccatttctatgtgatatcagacttccttttgaatattaagaaaagccattatattttatcttcaatttccaggactctgagtctgatatttaagtgtagagagaccagaaggctctgctgggccatgcgctttcctaatgattggctgctcatcaattcacagtaactagactttgtgcaagttgactcatttactcatttattgagtatcgtgcttaatttctttaattggaaatggaggaaattatattcatgattgaatttacgctatgaagattaataacttaaggacagaacttgccaaaactcctgaaaacttctgtgggagttgagtattaagaagtagattattctttatccttcaatttggtacataattgccttatgccctgagaaggcaaatttatctctttaaataccttctaccaatgaaccaccaacttctcaagcaggatcaagtagagttaagtggaagagaaagaaatgtaacctgaaagcgttagacctgatattaacaaggaatggcttcaatgtcacttacttggggtggacattaaatagtctactcaattgcatgtttgataagatgctttctacctaggaaagtgtcttaactctcacagggccatgtagtgtcttaaagctgtaacttacaccatagcagacaagatttaaatataagtatcatgactcacctttgttcatggttagaaccagaaagaactgtgttaaggcaaaggataatacaacattgatggtatgttggtagactagataattttaggcctccaaaagatcctagtaccctcttgtgctcttgctcttgtgccatctgatgcacttttttttttttttttttttttttttgagatggagtctcgctttgttgcccaggctggagtgcagttgtgtgatcttggctcactgcaagctccgcctcccaggttcacaccattctcctgcctcagcctcccaagtagctgggactacaggcacccaccaccacgcctggctaattttctttttgtatttttagtagagacggagtttgactgtgttacttgatctcctgacctcgtggtctgccggcctcagcctcccaaagtgctgggattacagggatggttccactcattattaaaaattaataatcaagtaatctttataatttatagacacgtttctcttgaagttcagtttttaaagctttcagtttgtgaatttattatgcgtattattttgtgtctgtataatgtgtttttaatttttttaaattttttaaatgtttagcttttaagttcaggggtaaaagtggaagctcaattttgatagctttataatccttacatgaagcataaattgagatggtgactggaactcagggatactcctctctagtactatcaataaatttgaaaataatattcaagataaaatttttgcacttaagttttggttatatggtgattttcactaaaaatatttagttcgttaattctttaaacttggtttttttttttttttttttttagggagtttgttgttgtttttctggttttgtttttgtttttattatactttaagttttagggtacatgtgcacagcatgcatgttagttacatatgtatacatgtgccatactggtgcgctgcacccattaactcgtcatctagcattaggtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatggtttccaatttcatccatgtccctacaaaggacatgaactcatcattttttatggctgcatagtattccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactggatatatacccaaatgactataaatcatgctgctataaagacacatgcacacgtatgtttattgtggcattattcacagtagcaaagacttggaaccaacccaaatgtccaacaatgatagactggattaagaaaatgtaaacttggtttttaaagtcatgttttcttctggaaacatgtttccaagtaaaaattgtttttcctagttaaacataagaatgaggttctaccatttagtgtgtgatccttagaaaaacagtattttagcatactataagcagtatttttagagtttcctttttcttgagaactaattttaggtcccagacattcaatagaagatctcttgttcagtgaaagtgagaaatgacttattttatattcaattttaaaagtagaaataaaaaagttaaccataagctccttggtgtctacatttggtaatttgcctccaacaccaacaccaaagggattaggtggatttttcctctgaaggccacacactgccttacccttcttctcccccttgcctttccccttcactattcatggggattatgccgtggaggttagcaaatcacatgtgctgagtctacttttttttttttttaaagaatacaaaaccactttttttctggcaatggtagtgattgattccagggcacagaatatctccttggcctctgggtagttaaatgagctggtcacggccaggcttttgcccagttgttgttcctttacttgaaaatagctgcatcttgatttggcatttcccttctttcttgatttctacctatcatctccagcatgtctcactctctagactcttcctcactatcccgagattctccccttcagaaacacttccccttttccgtcctccgtaatctacatcctcttaaccagctgatacatggcattttggtggagccctttgtgttcttcaactggaagcaaactgtgaggatttcggcatctcatttccctgaatagtgattttttttaaccttatggctcttcatctaacttagacaaatgtcactgagttcttttttaataactaatgaaattacatcaaagcgggaaaaaaagcctgatttttgctgataagacatatacatgcaacatgagatatataatacatatagtgtcttctatatataaaatatctcctaatatataacctaatatgatatatagtattttctaattggttgctgatatatatgggatggagggctaactatatatatagttaccctctgtatccatggttatgcatcagtggattcaacccaattggttggttgaatctgtggatgcagaactggatatggagggctgatcatactatgcaattttatgtaagggtcttgagcattgcagattttgatatccacaggggttatcctagaactaatccctcatggatactgaggaatgactatgtaaataatatgatatataaaatatatgctaagtatatgctatatataatatgtatattctgatttgggtaggataaggaattaacagatggaaaaatgtttagtaaaaaaaaagttggatttttttctttaaatatgcaagtttatcagaaattcgagcaatttgcttacattttgcacctgtttttgaagttttaaaatgtaactacattagtgatgatttattaagagctattcatcatgatattttcctctgtataagtttgcactgttagatttttaaaaggaatattttcccatcccaaatctagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacgggccaggagtggcggagccagaaggtgagagcggtaatggatcatggactctagacatctatctgtgtgtctttgctttgatttccctgtttataaccctctagaacagagtttctcagcctaagcactattggcattttagagtggagaattatttgattgggggctgccctgtgtattgtaaaatgtttagccactgctatagaataatatgtacctagtagataacaatattccatgctaattttagaatgctgtcctgatgtttgggggctgctttatcttggcgtttatatctggagagtaatttagatccttcagggaatagccctaatttcatttcttgtctagaaggccatttaacaactatttatttctgaagtggaatccacagactttcaaaaagttaaagcattaaggtctaatgggcagtcaaggataatggaggatgaaatgaaggaagctaagagattgtcagttgaagagatctggtgatcacctagtgtggttcttccatttaccctctgagaaacctgagacctagagaggggacatgacttgccagatgtcatatagagaacatgtaatgggacctgtgaccacggagcaccttttcccaaggaaatagtttaaggcttatacttgagagggagtctagagacaatggactttgactctctctctggcattcaggctgtggggtcatccctatctcttgatataaacccagcaatatctaatacttcacatatcttgcttacaaagatgttcacctcagaaggaacaaaccttttggatttgtatggaatagacgtattttctctaataaagctcctgttggcttttcacagttgattctgaggtcagaattcagggggccatttttgggtgctgttgaggagatagagtgcccaggctagtgttgtgttgggagtttgccatagccgccttcttggtgaggcaggctttttttctgagctctgaacgtttgtgtgttctggcctatttgattctatgctttcactcactgcatttcttccttggtgaggcagaacaggcaaaacctcagctggaatcaacagtattaatcagtttgcccctggacacttagtatcatgaccagatgtttgcaactgttcattgtttgcacaggcaggaggaaatgggccgtagttccagattttgcctcaagaccttcttcgtggtaggttaggcagaatagaaggttattgactttctccaaccccaagaatattgcagcaatgattttactttgtctggtaccctgattgctttcaggatttaatgctcctgcccaacctgtaaactaatgtttttacaggagacattgattgacttatgagaaaaatcctggtgaatgttgatccagggctttagaactaatatgaaggactgattaatgaaaagcaagtctttaaaaatacaaaggcatcaccaacaccctcacaataacgtttatgattgtgtaatgtataatttgttcagtatattgatgctaatctctaattggctcttcctggcttgtgagattctttttcgtaatttagttagcatatctttttgaaaatattcacggggcttcattaaagattggaatacatcaagaatgcagcacatgctgtcatgtctcttactgaaataagtgacattcttttttaacacttgacaccagaaagcatttcaaacattatataccataaggataaacctttaaccaattaatgaaaatgtttgttttctaacatatggaaagttccacataactgagataaggcataaaatgttgtaccagaaagtattgccttcttcttttaattttaattctgaaagagtttgaaagacttgttcacatcttctccatgtgctccagtagttgaggagtaacagcactgagagttctctgttagtcatgtgtaaaattccctaaaatggcagatgatcctaattctgcatttgctttagtctgattcttaatccttttgcagagataatggacttctattgttttttaagaattgaaatataatagactgaattgtcttaaatggtactaataccctttttcttttctggttttagtggcaactgcaccccctgaaaaggtaatttattcattgcttgcaagtctttttttttcaacgctcaaagtgattttctattagaatatgtatggattttttagacttaaatatagtaacatctctattatgcatcatttggtttgagttaatatagcattcagttattccaaaaaaatttattgagccattgtcatagattgggactcttctcagtgttaggaaaacaatagagaacaaataggacaaaaatctctactttcatgaagcttcaattctcgtgagaagaaaatgggaaactaatgggaatcaagggcataaatagaattcaatgtcacctgatggcctggaccatctgtgaaagaaaggctgtgacatgcttagataatcatgtattcttagagcacatatatagttagtgaagtacttcttagttcaactaaaatttaacatacatgtttgaattgagtttgagtaagaacagaacttacacttaaaagttacaatcaaatactagaatgttgctttttgaaaagtcagtctattggcttttgggcatagatgggggctatgaattgtgagacattttagtaggaaatgtaaacatttactggatctaagtcctatttatgtaatattgttccttctctgaatccggctttctttctttaataaaaacatccattttcattaaatgaatgaactttatgtcagagaactactatgatatattgctagactaaattatcgttgcattttgaaatgggatctcaatgcatgtaacaggctttaattttctttttatctccttctgcataataattacatgaaaattaggtaattattaaatatttatacatttatgtaccattctttaagctgacaagaatgcattattagaatttagatgaggcaatacatacatgagttattttaaatagtattctaaatcttataattatgggatagagtaacatatatgtcataacataagtgctgaaataagaaaaagagacttacaattttggagtgatagcactcgtccagaaagaggttatagtattttgagaccaaaaaatgtataacagatatgcatactttgtgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaaatctaaaaaacccccaaaattttcttgtatacttttactgcattttatttggggaggagatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgtatttgttaaatgtagaagtggtgtagattaggaagtctgctgcctcacggtgatgggggaaattctgtaaactgcagtagtggattaacacctgatcctggtctgttccttgttggcattggccatggctgcagggaatggggtgcaattgagactggttgaggtcatctctagtaagtaatagaaagctagttttaagaagacagaggaaatgtgggaaaaactattaagtgctcagtatttgtaggagctgaattttggtaggtctactcaagttaagaagaaagaggaagccagttagattattacaataaactgaaaatgagagtgagtccggcctagggtggtgggatctatggatatgaaaaagggtgaacaactgtaagaaaaaagtgtcaatggacggggcttgcaatgaaaaatgaaagagggaggactaaaaggtgactttaaacctggatgggacagattaatgactgtggcactggtagaaatgaagttggaatgagagcctggatggttttggaagggtaggctggaggtatctgtgggatatctaaatggacttaccctgtaagcatttgtgcttgcaaagttggatttatgatgagatatccaggcagactatcttagaaaaagcagaaaataggtgatacttgaagccaggagaagaggataagaggttaacagaggccagaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttctccaagccagcacatttctgttgctctgcctggctaccactgttcagagagctggagttgtaaagttatcagacgtgaggttaaagaaggccatagtaactgactggtttaaaatattttaacttaccatgtgttctttgttatggcacatctgctatatccattatttaatctgcaaactgtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataattacagcattgtaaggattgtagtgggaaagataggttttttttttttactgttttctgtgatcaggagtagtatacactattcagacattattgaaggttatcatttgatgaacgatcatttttcttggcttccgcatcactctcagatattcttgctaaatgttgaacccagagccttgggacatagaacagttctttatatctgacaaatgctgtgatatattgctagactaaattatgcttgcattttgaaatgggatctcaatgcacataacgggctttaattttctttttatcctctgcttcctcatatagtagtgattgaaaaaacatcacctcctgtgcctgttgaagtagctcctgaagcttctacgtctagtgccagccaagtgattgctcctactcaagtgacaggttggtgcagtatttttacattatatatcacatggaggagacgtggggctgagcttcattttaaatgtagtatccattatataagcttgctcatggcagggttagccatactagcaaatatttggaaatcatctaaatacagttaaaaaggaggagtatgtggaaataaattatagtatatatgaaacagaatatcacatagtattaaaataatgtttgaaaagagtagttaatatcatgaggaaatatggcataatctgttaataaatacagaatacaggctgggtgcggtggctcatgcctataatcccagcactttgggaggccaaggcaggcagatcacaaggtcaagagatcgagaccatcctggccaacatggcgaaaccccgtctctactaaaaatacaaaaaattagccaggtgtggtggtgcgcacctgtagtcccagctacttgggaggctgaggcaggggagtcgcttgaacccaggaggcggagattgcagtgagccaagatcacgccactgcactccagcctggtgacagagcgagactctgtctaaaaaaagaaaaaaaaaaaaaaggactgggtgcggtggttcatgcctgtaatcccagcacttcaggaggtcgaggtgggcagatcactaggtcaggagattgagaccatcctggctaacacggtgaaaccccatctctactaaaaatacaaaaaaattagctgggcctggtggcaggcatctgtagtcccagctacttagaaggctgaggcaggagaatggcgtgaactcaggaggcagagcttgcagtgagctaagattgtgccactgcactccagcctgggggacagagcgagactctgtctcaaaaaaaaaaaaaaaaaagaatacgatgtaatgattaccattttacttttaaaatttctacaaacacggaaaaagaaagaaaatgcatcagtgttctgttctcaccagttaatactggatcatggataattatgttctttaatatatttttattttcaaagttctgtataataaacatattattttaatcatgagtgaaatagcataaaatgttttatattctgaaacaaatgcaaaattctaaatgtccatatccttaatgtgtattgagctcttataaatcaataggaaaaatactaacaatagagaaatggaaaaataatataatcagataatttgtaggaaaaaacaataccaagaagcatgtaacagaaaatttcgactttcctggtaatcaaagaaaggcaaactaacctaggataataccttattcctatcaaattagtatgtaaaacccaatcaaatttttttattagggtgagattgagactctctcacattgctaaagggagtatgtgttggggttctccagagagacagaaccaacaggatatatccagatatgtagaaagagctttattgtgagggattggctcacaccattctgaaggctgagaaattccaggccaaggaaggctggtgttatagttctagtgcaaacccaaaggcctgagaagcaggggagttgatagcataagttccagtctgagtctgagtctgaaggcctggataccgggcataccagcgtctgagggcaggagaagatggatgtctcagctgaagtagagcagattgccttcctcagcctttttgttgtgtttgagcccagcacccagcagataggatacccacccacgctgctgagggtgatcttctttacacagtctaacaattcaaaggcctttttcttccagaaacaccctcacagacacacccagaaatatgtgatcagctatctggacatcccttagcccagtccagttgactcatgaaattaaccttcacagagtataaagcacaaattggcaatatgtataaaaaacttcagaactattcagaacttttgacccagtaattctattttaagacatcttgtctaaggaaataatattcccaaaggctgtgggtaggagtttatatgagtggttacctatcacagacaatgtataatacagaataaatagaaataactgtacattcaactacagggaaatagataattatgttacatctatacattggaacattatgttgccaccaaatatagtatttttgaagaatttttattgaaatatagcaggaagtagtcatacaatattgctaaatttaagatgaaggataaaaaactgaatgatatagagtattataccagtttttttaaagacatatatacactgagaaaatgctgggagaaaatacactagatattagcagtggtttttttttagtggcatctgagagatttaagtgttttattttagatttttttattttccatattttctaaactgaacagttatttttagagtcagcaaaaatgtcactaaggggcatcatcatcaactttaactgaatttatgataccactgcaggatgaggttgacaatgtgttataggagctaaatggaagagtttggagcctcctttagaatattccctcctcagaaacatgttatggttcctttctaatagaaatgttctcatatgttaagcttttggccacttagtgagtcagtagaacaggagcctcgcccttcagggtgcagctacagtcacctagccacggctccagatctagacatccctgcactctaaggggctgggaagtccctctttcaccacaggctcagaagtgcctgctgtcactccttggcctctccccgctgccagcgcctgctccagggtggagcaaagttgtggccaagcccaagtgctattgcaacccagccagttgtgcatgtgcttgggtgagtgttgacatgccagtcccctgtcgccttggccccctctggacattgggcaccaatgagcatgggagggaagctgagggtaagctgagggtagctcagtgtgggcttgcaggtgcccctcagcatgaatagcctgggtgtgtggacaacatgttgatggagggaggcagacaggttcctgggtggaaaggggtgagtcctcagtgaaaccccaccttcaagccaggaatggcctgaagcctgggggccaggctgccagttccaggtgtagtccacggtccagagtgaagacttcatcgataacagtttggccaatcagatggtgtttttctaggccctccatgatcacccatggaccaatcagcacacacttcctccattctgagcccataaaaaccctggactcagccaaactcacacagatgtcaggagtaccagctgtgagaaggagctacccacttcgggtctcctcagcttttcaggatgacgtgcccgcagaaaggagctacccactgtgggtatcctgagagctgtcacgtcactcagtgaagctcctctccaccttgctcaccctccagttttctgtatacctcattcttcctggatgtgggacaagaactcagagcccaccaaatggtggtactgaaagagctatgacacaaacggggctgaaacatgacccccccactcaccatgttgagggtgccgagaaggggagaagagctgtggccctttggggagcccaaacctaggggctccccaagccagggctgtaacagcctctttggtgctgtgtggtttctggcatctccgagctttcgggcagcactgtgtccgccatctccagatgctggtgcctgcagcagaagttactggcagtatatctggtccagccacagcctcacatgaagcctgcacctgtgccagcacctggagctgcccagtctgctacagcagctgggatgcctggctgtgtgtagtggctggaccccatgcttgcttgctcacacacccctcactgctccacacctggcttgcccttggcaagtgtgggatctgggctggcagcacaggccaagcacagcctgctgggctgagtgggtagaacaagctcagtgggtgcaagcaaaacttgggcaaagatgccaccagccacagaggttctggctggcaaagtgataccccaaggatcctgtgacaaaatgatggtgattttttttaatggccatggctaaaattgttattctctattctgaggtcatgtatgtatctacccactttattgagcacactgataagagactgctttgtgctgcaaagtatacaagcaaataatacactattttggacagcaaggatcttctaattgtttatagtaatgttaaaaagaaaaaaatgcagtaagacattgtaatttactagttctttcaaaatactgcatttcagttttttcaatgtgaagataaactctagttttgaatgggcatggctgacttaaatggacaaacctctttcaaactagctttgtagaggttaagttcagttaggtaaatgcagtttcaacatttaaatgtagctgtgtgaagggtaacaaattgaagttactcagcttcaactgaactgcagagctggttaaaaaaacaatgcaagtagccttgctataggaagttgttaaaacacaacttgttagaggcttaatttgagtttggcagaaatacagggctgacatctgctgtcacatgtttgaagcatgaatatatccttccaagaaacaagtgatgcagattttcttttcatgcaacagttgtaggtacttccactttctgtagtaaaagaatatttctgaaagaatccatagggggaacagtatagatagtctttgaaatgaagtggtttgcaactttagagctacactatacatagtgatctgcattagcacaagaagactgttttgtatcaaatataatttaaatcaaaatgtgtatgttcccatcggtttcatatgggagccaaacacagatttaaggagcaatctcatcagttctctcaggaatattgcataataatgtttttgtctctaaaacacagaggaggtaaatattatttgttactgttagtttctcccatgattgaagacagggatagaacaatacgtaagagtctaaaatgaataccatcagctccacattgtttagtgattatatctttacgatggtgaaattggaagtagccttttcacatttagctaaacacactttgacatgtgataattataaagtgagccacatatctgcaggaaatacgtgtgatgttttccactcttaacagctgacttggtggctcgcaacattattggcataccattttcaagtgaattatatgtttcagcatataaattcttgatttagcatagtgtcttaatagctaaaggataggttgggaaaatcaaacttttatttctctggcagatatttacaaagtggaaacatctgtttcaattgttgtgggacaatctatgctcactgtggggcagttaggaagccagggcatttttgtaaacctttccatgagttaacatttgatgccttcctctggctcttcccaagctttctccatggctcttgcagactggtcagaaattattctttgactgagttaactgccttgtggaaacctctgtaattatcatggcccagacatttaaaaaaactatttgctcatcagatcttttccagaactcagaaatgacccaaaaatgtttgtccctcaagcatattaccagtgtcattactgcctcaataaactgtgtatgcggatagaaaatgaactcttttatttccatgtgaaatcatcatgctttagtatttccagactccattcattcattcattcattcattcattcattcagggaatcacatgatgaagaaaaaagctaaaagtcagtatagtcattttcatattttgctaaaagctttctgtttcatttaattttagaaaatagagtaaaaataccacactgttaaatctaccattggccttgttgctggtataaatagagtatttggttttccatcactggctttctgtcatggccctttttccatattctagatggactccagcaaaagaaatagaataaggtccttgacctggtgaagatgaggttttcagggagcagatatagtagggaagagtagggctgtcctgtgaaccaggtggcattatgaaggacatgtgagagagtccagtggggagcactcacttaatcgtctctctgcaaagccaagaaagccaagcatgctaaaaagacaagacattcccattcaccagcatacatacccctgacacaagaaatgagtgctgtctatgtgaggcttgactctggtgtatcagacagagcccagtttctagagtttatattgacacagtttgctcaaagaatcatattcttctacatgaactgatctactcggtgggaaaaggtttgcatgccgatgtgtgagtgaccacttaggaaaaatataaagcatcttgtctttgccctaaaaaacagaaaatgcagaacacttttcctgttctttaagacaacattctcaggacttgtgtactgtctatgtgctcaggaatgaaaacctattagaaaaggagagaaaacacaggggagatatgagggagacatgttttatatgttttaaagtataagtaccagtaatttatttttttacctgatattcaactttttttttttttttttgaggcaaagtctcgccctgtcactcagggttcaagcgattctcctgcctcagcctcccgaatagctgggactacaggtgcccaccaccacacctggctaattttttctatttttagtaaggatggggtttcaccatgtcctggctggcctcaaactcctgacctcgcctcaagtgatcctcccttctcggcctcccaaagtgctgggattacagacgtgagccactgcacacagcctctgatgttcaactttttgataagtagtgaatagaaagcagacaggggtgttttgaaggtgtgatggttgttttctgtctgcctacaagagtggaatccttggctcacgcctgtaatcccagcacttggggaggctgatgtgggtggatcgcgaggtcaagagatggagaccatcctggttaacacgatgaaaccccgtctctactaaaaatacaaaaaaattagccgggcgtggtggcgggtgcctgtagtcccagctacttgggaggctgaggcaggagaatggcgtgaacccgggaggcagagcttgcactgagccgagatcgtgccactgcactccagcctgggtgacagagcaagactccgtctcaaaaaaaaaaaaaaaaaaaaaagaatggaatcctgcctggcaaaggatggaagggatctctgaggtcaaactgatgacagttacattaattaatcacttgtgtaaaaatgggaagaagtagaaatcaagtatgtttcagaaagtgtccctctttcctttgctgtatctcttagtaccctctagtggtgtcagcctaacattttcttacatgtaacgtgatcctgacagacatgttcagcgtttgcaagccacgtctctatatacttatgtatgaggtaatcaactaaaaatcaacaaacattttttatcaaattccaacctcctagcttctatctaagatattggattggtgggaaaggccattattactcattttattcctaagactaaagagttatacttcttcactatttctcctacctcagagctgacttttgagaagaaacactttagctatgttggcaatttgtggcataggaatatatcacattttaattaagcatcacatatatttgaagacttgttcacacatataaagaagttccattctaaggctgtccctgccaaatgacaaatacttggtaatcaccaaattggtattgtgggagtgggttagtgactacttatcaagcttttcatgaaaaccccagatttatagcctcttaatttgttctgaacccttgccctgaatatattaattcaccttctaattttttttttttgcaaatatggtcaacatgtctttctgctttatgaaaatgtcagagatgagtataaagataggtcaataaccacccgggaaaaaacccaagaaatctaaacaccagtaacttgcaaaggaagcttctatgtataatatagagtcgtgtgcatctcatgctgtttcactaaaaaattcctataaacagaagagaattcttacctgaaagtccatgagtataacctggtgaagattaccttttaccttcagattttaggtacatacaagttatatttttaaggaagacttttcagattatgaaagtgccaagacatgcttagtgtaaaaattttaaaaagtaccaaaaaaaatgaagaaaatgctaatcctaaaaaccataaaacttggatctacttccctccaaccttcttttctgtgtgtattgtagtataatggagattatattctatattataatttgtgcctgtgtttttttaacaaataagcattttcctatcttgttaatgattatatgctgtgctgtatgtataattcattgttttgtgttattattgccagtcacttaagtttaggcagtcatattaattacccatgtttttagccttttgaattatttttcctataatttgataatattttcactataaacaaatgtatcttcctgaaagtgaattaacataactagactcacaaaaggtataagtaatttgtaaatacatggggtgtgcatacatttctcatacatccaggtgactttgtgtaaaatgctgaagttcatatgcttcctttttcagatgacttgcatgagtagtctcaaagtcacagcacagtgaatactttatgaaaaatgaagcatgtggttttggtttcggagagcaacctcaaccccaatttaggtcatttccatagtgaatctgtgttaaagcactgttttccacatccttttactgcagaatagacagtgtgttattagcgagaatagcccacctgcttttcttctcattcaaaccacagacctctctaacaaagctgtgctcctaggttgtcatgctcagaggcgccaaactatttaccttggagggtcgcttggcctcattcataccagcctctcttttgagccttgtttactatacgatgacagataatagcccaaggtagtattggtataaatgtgttggtttttaaatatattcttaaatgacttcaatatgaacaataatggtaacttttattgagcacatataatatgccaggcattggctacatgcgttatttagagtatctctttcattctcatactttgaagttggaactctgattatttccattttacacatgtagaaaagtgaggcatagaatggtgaggtcacttgccccattctgcagaactgtaaagggcagcagcatttgtgcctgcactgtcttcaagccagtgcttctaaccaccagctgtgccaccttcactaggccattagaccttcttacaaaggacattggaaacagaaaatcttaaaggagtaattaatctcagaaggccccctttgagtccttgggtttttttttgatggactccacctaaccatggactcctaagaccctccctccactgtagtgtatgtctgtgagtagactgaggacttgaacagggctaatctgtacaggatatagagaagaagccagtcttacacagggctcagtaagggagtaagggaggaatttagcagaaaagatttgggaaaagattctactttaccagtagaaataaaatatgttcattttgaaattggcaaataagagtaagatacaccaagaagtttttctttgtttagaagtgggaggtctttggggggattaatgataaattttggaggagattggatgtatttgttgaaactcaaatatggcctgctaaagaatggaaagttacaatgtgtttcttatcaatagataagaaatctcttacctattggtgattcagactctatcatctaagatgaactacaatgaatagaaactcattaataggccattttggaagctgttttattaataattgattttcttacaacttacaacatggcctttttctgagtttcttctcacttcagttcatcttaaaaatggctttactaggaactattgatgtccttggataggactaactaatccattataaagtaatcacatgaatttatacttgatgtcagaggtcacctttgtcttctaaatgtagagctggcaataatttgctagttggtcaggaaactcaaagtaatactttgagagtagcagtgaaatctgttcatttctgtgggttttttcacattattttatttacttttaaagaaatcaatgaatgtactgtgaaccctgatatctgtggagcaggacactgcattaacctaccagtgagatatacctgtatatgctacgagggctacaggttcagtgaacaacagaggaaatgtgtgggtaagagacaatttgattgactaaattattaaatatcaaacatttgaacattaagaacatttttttcttaaaccaacttaaccattttgggaaagtgttactggtttaattttttgaaagtttatcccttagctaagggagctcaaaaaaaggtttgctaaacaactggaattctcttacctctttgttcaacatttgtttacctcgcaaatgtaatatatttacataaaggtgaaataatttccaaaagctttttgggtaaagtaaacaaaatatgaattacagaaacagctacctaaaaacatgtatttagcaaaaacaaattaacattagtgtatactgcagtaaagaattacattcatttatgtacataagacttgatttttttaaagggattttaaaattgaaaatccatatatgctggcctgaaggtgtcagtcaatttagaaatttagggatctcatatatgctccttttggaaaaaaaaaaagtatctcagaaagatatgcagtagagttaaataaatcattttaatgtgactctaaatttaatttctctttttttttttaagaaaaagaaaattcagcactaaattatgaggccaataggaagcaacaaaggaacatatctaattaatacttctttagtatatgtgaattttgctgtttggtgtgtgtgtatgggggagaaaggagacagccacctggtccataatttggctatttccttgtcatttgtatacattatatgtgtcactttcagaacctagaatattaagttagaaaggcaacagagatgacctaatccaactccatccacatgcacggaggaagagtctctttcatggcatttctgactccctactgacagcaaattccattgcttggatgtctctcgttatcaggagaatccttctgtgttgacctgaaatctgcctctttgaaacaccagtgtcatggttttgtagttttagcctttgaagtgatacacagtaggctgcttctctcttccaggaacaatccttcaagtacgcgaggagaaagatcgtgtctccttttgctgttgtcctcagttataaaggttgggtggtacccagggaatagtatgatggtattttacagaacagggaaactaagttcttgctacacagaactaatatttttatatgtatttttgttaacagatattgatgagtgtactcaggtccaacacctctgctcccagggccgctgtgaaaacaccgagggaagtttcttgtgcatttgcccagcaggatttatggccagtgaggagggtactaactgcataggtaatggcagcattcttcctgcttacaaattcttagatctgagtttttagatcccctaagactatcatcagttcagtgcttatccagacaacccagaattttttattaaacaattatcatgacagcagtctgctagatcccaggtgatataaaaatggatttttttcccctaacatttttgaagaaagagtgtcatatatgtgcatagacaagatacattaaatgttacttttggaccaccctgcatgaatcaaaactggatgattttgatgtgtgtcaaacaaatcaaagggaaagtagaaatcagttactggccaggcgccatggcccacacctgtaatcccagcactttgggaggccgagcctggcggatcacctgaggtcgggagtttgagaccagcctgaccaacttggagaaaccctgtctctactaaaaatacagaattagccaggcatggtggtgcatgcctgtaatcccagctacttgggaggctgaggcaggagaattgcttaaacccaggaggtggaggttgcagtgagccgagatcacaccattgcactccagcctgggcaacaagagcgaaactccatctcaaaaaaaaaaagaaatcagttacttcgttattatatttgagctaagctgggagatgggagaggtttgaaacagtatttggaacacaaaactcaacaatgctatctgctcttcgtagatgttgacgaatgcctgaggccggacgtctgtggggaggggcactgtgtcaatactgtgggggccttccggtgtgaatactgtgacagcgggtaccgcatgactcagagaggccgttgtgagggtgagtcagctgagagtgttcagcacacatgacggtgatgtgcagggttggtaggcaccttgcctggttcttgtttccttcccacactcagtgcgtgacaccagtttatccaagctctttctgcttcctagattcacaggctctttgcctcttcctttcactggctcttttgggattattttccatcttcatgctctcattatttttcacctcaatatctgcctctctggtatttggaatgaaatcaccatagaatgattaattgcatcatatttagtagaaacacagacttaattacagagtccggaccattcatctgggaacatgctgcaggtgtaaccagtgttgattttttgtttttgaccttttcacctacttacattcctttgtctccaatgctttcttttacatgtgttctggtactttctcacagactccccaagaagcatggtctgacaaactttggtcagattccaactgtgcttaataaaatttcctcattattgaccacagcaatgagctttctctcattataaaaatgttataaaaagtatttatagcatggtcacaattattatccttttcatatttcttttcacgtttgtgtccaagttgctctggttctttttgaaaccaatgtagtgaggccaggcacggtggctcacgcctgcaatcccagtgctttgggaggttgaagcgggtggatcacttgaggccaggagtttgagaccagcctggccaacatgctgaaactccctctctcctaaaaatacaaaaattagctggatgtggtggcgcacgcctgtaatcccagctacctgggaggctgagaaacaagaatcacttgaacctgggaggcagaggttgcagtgagctgagatcatgccactgcattccagcccaggtgacagagaaaaaccttgtctccaaaaaacaaagcaaaacaaaacaaaacactatggcactttttttgcaattattttcatgaagaaatacactgaccttctgctaaaaacctgtcatggaaatatgagggtgaaggaacacgggatctgtgagggcacgggagcatggtgctggttccttggggttccctgcctggctgtcagcagagcctaatagatctgggctctgttaggtggggcaggatggactaggttggcacagccagccctcagctgtcccctggcttctgcctgttggttttcttcactgctctaatgacccaggcctggagggagagctaattagacattttttggcagcctacacttgcccctcctgctggtgtcttgcctctgccccttgggttctaatctagagagaagtgggagtgttttatgttgctggatctctgatcagcatggagttttgtaccctccccgagggccacgaggctacagaacaagcacaggtgtaaagtgtctccacgctgctcttccagggaactctcctctgctgaagagatgcagcgtgggagcagctcaccacgcccacagtaactgcctgacctgtagccactgactttgcccctttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaagtcaaatactgatttttttttccctttctttctttctttctttctttctttctttctttctctctctctttctttttttctttctttctttctttttttttttttttttttaaagacagtcttgctctgtcgcccaggctggagtgcagtggtgcgatctcagctcactgcaagctccgcctcccgggttcacatcattctcctgcctcagcctcctgagtagctgggactacaggtgaccgccaccatgcccggctaatttttttttctatttttagtagagacagggtgtcaccgtgttagccaggatggtctcgatctcctgacctcgtgatctgccagcctcagcctcccaaagtgctgggattacaggtgtgagctactgcacccggcccaaatactgattcttaagttctacacacgggtcaagaatggaaagataagatacttaagtaataggatggaaaggaatagaaaataaattggaaaattatgtacttaaattggaagcttgtaggagaatattcggtgatattcaatatatgaaaattatttgggagaaagatgactagcgttccctcagtaaataatatataattctatccccatgaaaagtcttgaaaagaagaaggagccaagaaacgcggctgttttcaaatttcatcatggactagaaccaaacgtccccgggcttctggcacacagaagattttctcagctgtcactaacgaagttgctttcaaatagcaccagtctccaaggagtctattgtagtttacagacattatctcatgcatccttactttattctgttaaggtattataaggcaggtagttcctaatttatagaagaggggaaaagccgaggtgagagcaggtagaaattcagggacattatcttgtattgctcaacattgcaccctatttattgggctagcctgtctcgatggcattctctgatttagcagttgtagttctatttttttgaaatatcccatccagaggagaatgtaatgctatttggaaaatgaaactggcaagcaccatctttttgtagaacaagaagtcccagaacatctgacctaaaaaaaccactatgtatcattggccattggcaagaatttttactgatagaaaaaaaattacaacactgacctggtgcttattttgttaatatcatctttaactttttcactttaagtatcttttcacatgtctaatggtatgcagtgggagataatttttaagtatttactagaatgtagacatcacatacccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtagttatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaatttccctagagcatccaatgtttgcagagagaacctctagctgggtggatacatagcttcctcacactcacccccattctttgtatttctttctggaaagctgtgctattacttgaaaggtttcatgtccagaaattggccctagaggagctgccaactcccagagtggagaggccaggtcctgctagttgaagaattggggccaggttcttccttggaatgtatgcaaatattttaatccaggtatgcttgaccatgcattattgccatgtatttaagtatagacccaatgtctcacttacccaattattgtttttcccactgaaatgtagatataacatgctttcccccgctgccttcatcacaaagtaagattttgctttggtattctgataaaatgttcacgacctaggtttttgatttttcagatattgatgaatgtttgaatccaagcacttgtccagatgagcagtgtgtgaattctcctggatcttaccagtgcgttccctgcacagaaggattccgaggctggaatggacagtgccttggtaggtactatagtgtacttatcaaagatttgtttcttctgcatggcccattttctgatagagtggtgtaatgccaatggagccctctttcaaaatgaaaaaatgaaatcttacatcattctaagaaaagttcccagtaacttttaaccattgagaaaataagaaaatgacttagcataaaggatgtaagattctcgatggggaaaataattaggattgaaacaaactgatattcctaatgagataaatatccaaaaccaaataagatagtaaggtctacaggaaggaagagagatggagagcaaaacacttaaaaagagagaagaagcatctaccacagacaagtagaattaggtaacacacacacacaaattttcaacagaagtatcaaaggtagtgctttaggcactgaggaagacagagtaatgtatttgctttgattctaattacccgtgctgtagttagctctgccccttaatggttttcatttgtgtctaccatgtaatctttttccctaaaacttgaactcttttccactccataccaaaactctgaatatgtgagttaaacttttcattcattcattccttctttcctttctccctcaaatgcttaagaacttactataggctatgcatggtggctcatgcctgtaatcccagaactttggaaggccgaggcacgaggatcacttgaggccaggagtttgacaccagcctgggcagcatagcaagacctcatctctacaaaacattaaaaaacttacctgggcttcgtggggtgtgtgcctgtaatctcagctacttgaaggctgaggtgggaggatcgcttgagtccaggagttcaaggtttcagtgagctatgattgtgccactgctctccagcccgagtgacagtgagaccctgtctctaaaatatgaaacaaaaggcaaaacttactgtatatccccagagttgtactaagttctgggatatattgagaggaaaaactgatatgaccccttccttttggtacttactgtctggtgggggagactgacatgcactcaaacatctcacagataaatgcaaactcacagatttgagacaagcactagaaaggagggttctatgatgctgtgagagcatatggtagaacgagctgcccttaggaaaattcttgagttgaggttcaactggtgagggggtgggagggagaacatttcaggcacagtaaacagcatatgcaagaggctcgtggaagaagaagagagcagaaggccagtgtagctgaaggccagagaacacaggaagatttgctgcaagatgagaggacagaccactgaaaaatttaaagccctcttagtcctgttaaaactgacggtcttcattctcatagccctgggaagacatttaggtgttttaatgggggttgcagaagtactctcagttttaaagctttagtctcatcaccaaacagcatcagctcagactctgtagctggtacggagagctccgtgtcctgagcccctaggcccatccccaacccaagagtctctgctgatggagttgtgagatgtagtctttgaagaaaagatttttattcattagttttttatttgataagcaattgtttttgtaactggtgctgaccaaaaagtattaatatatatggtttcagttttcccatttggcataaatttcatacttgcctatcaaggttccatgcgtattctcattttcacatcctgataaataatccaggagcagagccggaactctaccttaaataactacaattcataatagtagtgtaaacgcagccctgattcatgaatttattagtggaatgtgactgatcaaattggcaagtgattgttcttcaatataaataatactaaatgaattcttatacctatatgtgcatatatatatatatatatatatatataaactttagtgatagaagcacagcacctcatttaaaactaattttactttgtcaaccagatgagtagaatcataagcagaaatattagatcactgcatttctcaattcagccaaagtcccacatttagccccttgttttgtttttgcgttgctgaggtcatgtatttcctattgttaaatggaggcagtgtcctttatctttctgctttgggtaaaattttaggctctacataatctacaaatgaagccactcccccaagatttaattgcagttccatccattgttcatattggacttgcagctcttctaaatttctcatgagggcctttgcaggttatactgaaatagattttccatcttaattttttatagtagtagagctttcaaatgtcgagaagttgactgtgacaaaaagcagatattgcagcatgcctttctacttacattgaaccaatgggtgggttggaattttctgctaaactctgaccatgttaatgactgcccagccctagctttgtacttctggtactctaaaatacctttcagaaggtgcagtcttgtcttaagcctagttttgagttgagctcatcactaacataactggatatatattcattcatttaacaaatactgagtgtctaccttgtgccaggtatttttccagaacactggggattgagagtgactaaaataggccaggcacggtggctcacgcctgtaatcccagcactttgggaggccaagacgggtggatcatgaggtcaagagatcgagaccatcctggccaacatggtgaaaccctgtctctactaaaaatacaaaaattagctgggtgtggtggcacgcgcctataatcccagccacccagtaggctgaggcaggagaatcgcttgaacctgggaggcggaggttgcagtgagccgagattgcgccactgcactccagcctggcgacagagcaagactccatctcaaaaaaaaaaggtaaataaataaagtatataatttcatttttaaatgctaaaaactattaagaaatatgtcaaatattaacattaattaacactggttgataaatgatttttttctttatatttctcagaattttctaaattttctataatgagagtgtctctgtctctctctctcttttttttttttttttttttttttttggagatggtgtctcactacatcaaccaggctggcctggcctcaaactcctaagctcaaatgatcctcccacctcagcctcccaagtagctgtaactacaggtacccaccaccacacctggcttatgttactcttaaaatnnnnnnnnnnnnnnnnnnnnagtgtatggtgaatatcttccatagattgatgacaagtatgctcctatgtcagttccttgatgaagtcaatggccttgagtgtctgactatttcgcttttaccggctgtatgttactatgtgttgggaacttagtaccgtgtactcggtaatgtggggtcgtagtatgtatttcttatgataggttagagtttgcgagattatttgtgttgcacgagattatgagatattgttatggcttgccacataagtgcgagtttattggttatataggttatgtcgagaacggagtctctgattgttttgcccaggctgtaagtggagtggcgccatctccagctcactgtaacctcctactcccggattcacgccattctcctacctcagcctcctgagtaactgggactagcagcgcccgccaccacgcctggctaattttttgtatttctagtagagatcgggtttcaccatgttagccaggatggtctggatctcctgacctcgtgatccacccgctcggcctcccaaagtgctgggattacaggcgtgagcacacgtgcccggtcattaaaaagtttcctgcaatcacaccattttggtgaaaaatcctacatttgtcatttgttagttgccatctgtagagatgataatgtctatctcacagggctgccgtgttccataaatgttagtgtctttttttctaactctcctctcactgagtacatgtttttacattgttataatcaaacatgtacaatgttttatataacatttcttaaatttcacattatgcttatagttttttttctaaactggtctatcttcacgttgatttgactctctttctattgaatgacttcattaagcattgctattcaacccctatattctgcagggattttataccagttacactttctgcttctttcacagactaaatgatgaacttggtgaaaccgttaatggcctctttgtattcatgacatgtaagctggatcttactgattgatgcttctccttgatttataaattagagcagaaattgttttgggcagaaataggcaaaatgttagcaggtgttttctgagggactacattttttccctagtgtttagctcaggtcatacaatccctcatcctcaatagtttattatccacttcaaatatctatcatttcagactgtacctaacacacatcatccctaatgctttttggcaactcttgttggctcttctgttaacgtagcttcttctttcaagtcgtggatttcattcttctctagagagtcacgttcgtcattcggcactgtattccttggacctgacattcagcctggagttgctgcccactcgatccccacctttaatgactatttcatcactctgggttctggccagttccaaatggctatttcaaccaagtcctttcttaagggaagccaccctgtcaggtactcaatttacaggttcttcttggcttgtggagatctggcctgattgaaacccgatgagagccatcccccaaggaaactctctaatatttaattatttaaagatacatttgatattgctaatgtagagatcttagttccctgaatttagacagagtttgggctacatgacctctctgaagcttagttttattatctgtaaaatggggattgaaatacttgctgtttaagctttcttgccagaatgaagtaagcaatatgaagcacctagtaggcatctgacatatggtggaaccccatccatgctacaaccctttttccccaactattaccctcctctatactgctcttgtcctcaaacataagagatgcagtaataactggtacttggtaaagtaagttatgtatcacattctttttttttttttttttttttctgagatggagtctcactcttgtcgcccaggctggagtgcaatggcgtgatctcggctcactgcaacctccgcctccagggttcaagtgattctcctgcgtcagcctcccgagtagctgggattacaggtgcccgccaccacgcttggctaatttttgtatttttagtagagatggggtttcaccatgttggccaggctagcctcgaactcctgacctcaggtgatccacccatctcagtccccgaaagtgctgggattacaggggtaagccaccgtgcccgggtcacattcttctatataactatattctctttggctttttgaagctcatgtcatatagttttttaattcttcttatgtcattggagcattctcttttctttctttctttttctttttttttttttttgagacggagtctccctctgttgcccaggctggagtgcaatggcgcgatctcggctcactgcaacctccacctcccgggttcaagcagttctcctgcctcagtctcctgagttgctgggattacagctgcatgccattatgcccggctaatttttgtatttttagtagaggtggggtttcaccatgttggtcaggctgttctagaactcctgaccttgtgatccaccttcctcagactcccaaagtgctgggattacaggcgtgagccaccgcacctggccttttggagcattcttttatgaatgtaaataattttgtggttcctgttcaatatctcccatccaaatactaactgggcccaccctgcttagcttccaaggtcagactagatcgggcacgttcagggtgatatgtctgttgactccttccaacttcttagtgttcttacttagctggaatatacttcttgggagccatgatacttctctgtagggtcattagtgattcctaacaaatgttcaggcatctataataatgctgctatttccattcctgtactttattgtctctgctcaccttcacaaggcagaatatgccacctattggatatatgcagctagccttttgggggttgtcttgctttgtagttcagtttgtgatagaacttgagacccggtaacacaaaattctgagattttgtcagtgtaatctttcttttttaacccctgattaagttgagaatgactttctgactcccatttaaactctgtgaatgtaggtcttgggtatttgaagaatttagtatcattcagtctacttgacaactgattagctacagtcttaaccaagacctggcacagagaacttgaagaataaacttggacagaaaacatggagaactcattgttctagaagttcttttcacactaggctttattttcagatttgaagattcagtgttaactttcatggcttatatgaatattcatagactaatccaaaattgaagacttggtacagcagatatttgttttatagaagattgcaactgagtacagcatgtacctttttcatattttatgtgcaaacattagctttatccctacattattatatgctaaaggatgcttctaatcaatcactaagctatttattgagctgttgtctgtgtatctatatgccagagaagattggcagttataaaaacacccacccaaatgtccaacaatgatagactggattaagaaaacgtggcacgtatacaccatggaatactatgcagccataaaaaaatgatgagttcatgtcctttgtagggacagggatgaagctggaaaccatcattctcagcaaactatcgcaaggacaaaaaaccaaacaccgcatgttctcactcataggtgggaattgaacaatgagaacacatggacacaggaaggggaacatcacacaccaggacctgttgtggggtgaggggagggggaagagatagcattaggagatatacctaatgttaaatgaagagttaatgggtgcagcacaccaacatggcacatgtatacatatgtaacaaacctgcacgttgtgcacatgtaccctaaaacttaaaagtataataaaaataaaataaaaacaacaacaacaacaacaacaacaacttttgaaagcaggcagcatggtttgtgggaacattaattattataacaaaatccttctcattgtatagtttatgaaggttttgacatgatggcatcatttgatcctcacagtagtcatctctgtagtacaagtgtggaaattgattcccaaacaagtgaatgggctaactaaaggttataggtaataaatgtcagaactaggatgtgacctctgatcttttatctctaaatccagtgttttgttctgtacaatgtctcatgtacccttcgtgtacacgtaagaaaactaaagaacaaaacaatataatgaagacaataaggaaaataaaagagcatagaaaggagaaagccacatgggctggaatcatcccttgcaagcagcagtaacaatggcttgaggattctagagtttgagacagcaagtctgcaccatatgtagtggcagttgagttttgctgaaagataaaatgctcctttggaaaggtgaggtaggaagccaataatttggtgggattagtgattggatttttctgagatcatccttggctctttatgtaggatgtgcatagcattcattggttcttctccagttctgcaaagccgtgatgattctttgaggattatgtaacaaatgtttgtcagcagctctgctgctactaccacatattttaacttcatcagaattgacagagggggtgtgagattctgaggatctactatacctcaaatgcagttgaggtggtttcatcacactggctggaccaacatctgtctctcattttgccatgcttgcttttctgccaaatatgttcttccatcttctttaatataaaagattatgtgtgaagaatagttgaggagtcgctggagtaatgacacatttggggtaggggataatcctgtgttttcatgtagctgtagtgctagaataagatgctttatccctatctcaagtggtactcactcactgaagcctgtattggtgattaaggaacaaattgaatttggatagccttagagaaataattggctatgttgacatactcatctcattgaaagtacaggaagtaatacaggtaaattactgctccgggacaaattctagccaaccccaagcagctgctacatgaaatgtaagtgagcacaggctggggagaacatgactgggtgacatcagccactgaataccctctgtacatggtgggctgtgcccaccagggaggggcttgagacagtctggtatgttcccaggatattaggaagggaaattttaaattttaaaaggttcttcacccagatgaattacaccccaaggcaacgagacaatgagccaggtgggattactggccagctgggagtcatctctgtgaaattgtggagaattgatagttaccagaggatacggagagagtaatgttctcatttccccgcaaaaagaaaagaagttggaggccaggtgcggtggctcacgcctgtaatctcagcactttgggaggccgaggcgggcagatcacaaggtcaggagatcgagaccatcctggctaacacagtgaaaccccgtctctattaaaaatacaaaaaattagccaggtgtgctggcaggcacctgtagtcccagctactcaggaggctgaggcaggagaatcgcttgaacccaggaagcagaagttgcagtgagccgagatcgcaccactgcactccagcctgggtgacagagcgagactctgtctcaaaaaaaaaaaaaaaagaaaaaagaaaagaaggtggagttctgggaattactgaccactgagcttcatgttaatcttgacaaagaactgtagaatgcatgattcaaatgatgagatgaaacattttaaaaaggaagtgatgattataagaaccagtcaggattcgttaaggataaatcatgctagactgtcctgactgcctttcctgatacagtgattagatgagtagaccaggaaattctgtgggcatggcacatctagttttcaacaatgtacttgttagagtctctctgggcactgtagatgagaaggatcaatttggattgggtgataggattgtaagatggatgcatacatctttgaactatctgcctaccaagtctgacctgatacctcggcaagtttcttaccctgggaggtttaattaattcattgagtggcaaatgccaaattgttatgtctcaaaagcccattggtaaattgtttgagatttagaatccatttttcttttctttctttttttattttttaaagtgtcaaggtcttgtccaggctggagtacaacagcatgatcacagctcactgcagtctctaactcctgggctccagtgattctcctgcctcagcctcccaagtagctgggactacaggcacgcaccaccacactcagctaatttaaaaaaaaattttgtgtgtggagacaggggcttgctgtggtggccagactggtctcaaactcttgtcctcaagcagccctcccacctcagcctcctgagtttctaggattatagacaagagccaccacacctggctagaaccaattttttttatcaacactgttttttattatatttcctaacagataaaacgcaaaggcctgttgaactcattatgtatatgcactggaagaatttgggtaatatgaacattctgtaagaccatatcttagagtaagacaaattttgagctctaccatgaaaaccagaggcataatcatctccctctgcttcagggaaaaggcaaccatggggtggatggtggggtgggtaggcaccacctgcttccttcataacccattttgtgttgctgtaacggaacaccttgagactaggtcatttatgaagaagagaggtttattgatttagctcatggttctggagactggcaaattcaagatcagatggccacttctggtgagagccttgtgctgcgtcttaatatgctggagaagtggcaggtgaagcaagtgcatgcaaagagagcaaaacacagaggcaacctcactttataacaatccactctcttgggaacaatttcattcccacgagaactaacccagtctcgagagaaagacattcatctatcttaatgaactaatcacctcttaaaagcacgacttccctatgctgccaccttgacaaccaagcctcaacatgagttttagcagggacaaaccattttcaaagcatagcacttcttatggcattgatgggagatcttcccaagggttggaagctagaactgtgggggccaagccttctgctatcattaccacccagggccccacaagtttgtgtccttgactaaactgaagaacactgaaagtcatggaaggtttttaaagtagaggagccaacaccatttatcagatttgtattttagaaaaaagtttattctgtctgcaagctggataatggattagagaagccaagtcttagacaaacaaattaaaagactgtggcagtaactcgggtgagaaagaatgaaagtaggtgatttgagagatatttgaagggcagattggtatgcctgggcaataacaatgtgaggaaagagggagagtaaaaataaggactcaggtttctgacttgggcatttgagtagataatggtactagatattggtgtgaaaaataacataaagaaaagacagaggaggggtcagttttggccataaagactcagaggtacctgggggacatcaaggagatgtccagtagacttaccagctggatgcatgcttctacagtttaggagagaaatctgggccaacgatataatgctgaattaattttacaccatttgcatccaccaagtgtttttacgtgtggttcctctctggagaccttccttctttgtagagattctttagtgatattttactgtcttgctattttctcaggagcatagtctcattaaggcaatgtactttcagttcaaactgttctatctacggtgattggcttgacagaattctggttccatgcaattatgtctataataagtaaagaaagaataaacacatcaggctaccctagatatttcaaggcattctgcttcatcattaatcatgagtagcctagaaaaatagaagttttataagtatctcctaaatggtaatctgcagtgtctgttaatttactttacctagagaaagtatggtcttagaaattgattttgctgttatattctacagccttataaatcactttccctggtgcatgaataattaaagagagcaatccatacatttctgagcttgttaacatttttgaaacaaaaccagatactaaacatgacattttcctgttgctgtctggaatttctatgcctggtgtctaggctcattcccattatttactttggctccaatgcttggcttcttctttcaagttgtttgccttcagtgtttacagaagtggattcccacaaccaaggaaagggtggttaatgagtcagtctggaagtgctatttttgttatcgtggactagagtcagctcaccataattagtgatattttgtgaaagcaacgcagagcacctaggcagtgccatttccttggctcttctcagtatgtgcagggaacacacccgtgtgcacactcacagatacgtgtttgccacattttagtacaactccgtttctgcattccactgtaagaaagaatacagtcttaatacagtgcaaatgcatgcaatctagactctgggtttgtattgtcagtgtgcttgtgactgccttaagagggtagaaagctttgctgctttcgtggtgtagtgagcattgaaaagtgaaacagatgctgtcacgtgtcttttcctccttgtttgcctggcttaggcttaagatgctttgattatgttatagacccctataagattaagcctaattgtgttattgtatgtgtagttttagcattttgtgatttaagtttttcctctttaagttcttgcttattgatacctcactagtgtctgtcactgtgacatacggtggacctacccagggccattcaaatggagcacagaacttacatgtttatttatttttgaaaaatagtaatatgtagtagggacttaatattttttaatgaagtagattttagatgattattttcaatataaatgctgtgttagcaaataataaaaacaaacatcaattcatacattctctctttctttaactgtttctatcactagatttaactttgcctgtgacagaaacttacagtcaggttaaaaggataggcttgggttcacatctcagaaccaccattttctatgtggcgttgggctggttattgaacttctctaagcttcagttccttcctccataaaatggttggcccataaggattttgttcggattaaatgagatgatgtatgtaaagcttttaatgcccacatgtagcaagtgcttgataaagattaggtgctattattattatctacctcttcagcgtgtgccctaccttcaaactgcccagtaggcttgtgtttgtcccttagattacttggtttttatcatatggattcactgccattttagagctttttattggactctttttcacctttctgttaaaacttctctgtgatttctctgggtcatgagtcatatcttttgcttttgtgaactctcccatcctattgaattcatcaatttccaaaatagacctcaacccatctttggttctttggaaaatgctttcttgtagagatgttgcactaaatctcccgtctcttccttcctcccccctacaacaagccatctttacttcttgaatttattcacagagcatatttggttccgagttactttcagaaggtaagttaaagtatagaaccgtcatccatttagctcacgacaagctgctttttctcctttgggctaatttgaaagtttatctttaagaatctgcctggtcttctgaaggtctactgtttccatttctaaccaaatttaactttatccatgttttctttttcttctttttttgttctttccattacgcaacattcttcaagatgtggacgagtgcctggaaccaaacgtctgcgcaaatggtgattgttccaaccttgaaggctcctacatgtgttcatgccacaaaggctatacccggactccggaccacaagcactgtagaggtaaatactgtgatcaagtttcccatttttatttaaacttcatttaaatatagattagagcaattagccttagaaaagggaaccctgctacctgtgtttattttgaccgagcgacttagagcacatattggttggcttggctgaaagtggctccttgctgtggttaaatacagagcatatctatttacataaagggaaacgatgtatttttagagagtgtctgtgagccacagatcggttcatctaaatttttttttctcattataaaagcaatacacacagttgcacaactctgtgaatatattaaaaaccattgaattgtacattttaaatggaattgtatagcatgggaattatttctgaataaaattgatatgaaagtaaccaatatacactcattttagaaaatttagcaaatagagaaaaaagaaaagtaacaatcttacataatgtcattaatgaatattcatatttcgtggatattgtatataaagatgttctatgtataattttatatcttgctttttgccatttaatagtatacctaccataagtgttttacattccattcataactttttttcaaacgttatttttagaggctgcacaatattctagtatattcctatatcacagttttcttgctcttctttaggtattgaacaaacaaaaaattttcagcttctcattagtgaacaaaactggtacaggtcttttttttttttttttttttttttttttgagctgaagtctcactgtgttgcccaggctagagtgcagtggcatgatcttggctcattgcaacctccaccctccaagttcaagtgattctcctgcctcagcctcccgagtagctgggattacaggcacacgccaccacgcccgactaatttttgtttgtttgtttgtttctttgttttgggtgtttttttgaggtggagtcttgctctctcccccaggctggagtgctgtggcatgatcttgactcactgcaacccctgcctcctgggttctagcgaatctcctgcctcagcctcctgagtagctgggattacaggtgcctcccaccatgcccagctaatttttatatttttagtagagacagggtttcaccatgttgggtaggctggtcttgaatgcctgacctcgggtgatctgcccacctaggcctcccaaattgctgagattacaggcgtgagccaccacacctggctaggtctcttttaaaaataaacttttgtctgaactttagaattatttccttattcataaaagtggaattattgggtaaaattttttttttttttttttttggagacagagtcttgctctgtcgcccaggctagagtgcagtagtacgatcttggctcactgcaacctccgcctcccaggttcaagcgattctcctgcctcagccgcctgagtagctgggactacaggcacccgccatcatgcccagctaatttttgtatttttagtaaagacgaggtttcaccatattggtcaggctggtctcgaactcctgaccttttgatccacctgcctcagcctcccaaagtgctgggattacaggcatgagccaccacgcctggcaaaaatgttctgaatttttttactatttggttttttttttaattggcatgtaataattgtccatattgtacatatttatggggcacacagtgatgttttgatacatatattgtatcatggtctttttactatttttacaggagaacattctcatttcatatatatatttattttaattctgaaaaggcttaatttttttatatgttcattccctttagcgattctctgaacacttctaatttttaaacatttattttatatacttaacatttatatttgtttttaaaatttccattaatatcatttctcatttatccggctttttatttgtttaatcaatgtatacgaactctttatatatgtaatacatatataaacgtatgtacatgtggccggacacagcactttgggaggcccaaggcagatggatcacctgaagtcaggagttcgagaccagcttggccaacatggtgaaaccctgtctctactaaaaatacaaaaattagccgggcttggtggcatgcgcatgtaatcccagctacttaggaggctgagacacaagaatcacttgaacccgagaagcagaggttgcagtgaactgagatcgtgccactgcacaccagcctgagtgacagagcaagactcaaaatagagtctcaatgatgataataataataataataataaatatgtgtacattacgtatacatttttggtggtacactgttgtaatttctccaaggcttccctaattttcctttttatgattttttaaaaattttttcttatggccaaatctgtggatttttttcttttctgcttacttttacatctaaaagtatgttctagcaaagggtaaaagaggaaataagtaaacattttcttcttaagtgtcttgatgtaagtgaaggatgtagggtgataattaatttctcactatggtaggcaagtagtaaatgaataccctggtatcctgtaagaatcgaggcctcttccactggcagtagggaacatgcaggcatctggatttgatgccttgctccaataatacaacagagcaacagtggatcttggccactcctagtggaacatctaacgtgggcacacctccatttctcctggtcccttctcttttggctcacatccacagtttcctactgattccttaagccaggtatctcctcagaccaaattaaatatgagaagcatctgaaaggtattatttcttcccccatacactggatcaatggtggatgaggatctcaagccttaggagtcatggttaatctttgattgctatatctagtttattttcatatcctgccattttatcttctttcatcctaatctgcctaatttttttcatctgcttgttgataaaaactcttgtaatctgtcctcctctttcatagtccaaacttacttgtcacagttgcattcttcagctagcattctctgacctatccaaatcaatgtcacaactgccctgtgaagattcttcacagggcagtacttggacccaagtacttgttcaagattatcctgcctttcatattcatcttcttcctcactgcttacctgatgtggctcttccagtggttcatggtatgaccttgggtgaataatctcaggtttccagacattgtgtcatccctaaaattaggggatcagactctctaatgggatgctcaaagtagcacatgttgaatgaatggctcattaccactgtcttgctcttggctgttgccatcccagctgagcctgggaaagattggttggggagacaagacaactaacagcaatctaatatccaagattataatatatatataatgtctaaagtctagtatttagttttgtttttttaaaaaaaggcagcatatcggatgctagtcctgatgcgtagaagctgtgtgagcttggataagttacggtatcttacttcactaagccttacttttctcatctgcaaataaaagggagcaataatggtacctgctagagttgatatgaggattgcaggaaataatacagggacagagatcatgtagagagaatgagttaatgcaggggcagagcatgacatggtggtggtggtgtttgctaaattagaggcataaacaaagtttcgttaaagccaagaagtgtgtggctaactctgcttgtgtgcgtctgggaaagcttcacaaaggtattgctatttgaacttagtcttgaagtactgaatacaaaggggagtaaaacttggcaggcagaggaaacagcatatgccaaagcttagaggtgagaaagggctattacttccacttggcatttaaccttgacctctactccgattctaatggcgtcttcccattacagcctgggatgcattacctcattcttcccacatgatctctgtccctgtattatttcatgcaatcctcatatcagctctagtaggaagcattattgttcccttttttttgcagatgagaaagctcacacagcttctacacgtcagagctaggatctaatatactgctttatttatttatttatttatttatttatttatttatttattgagatggagtctcgctctgtcgcccaggctggagtgcagtggtgcgatctcggcgcactgcaacctctgcctcccaggttcaagtgattcttctgcctcagcctcctgggcagctgggactacaggcacgtgccatcacacctggctaatttttgtatttttagtagagatggggtttcaccatgttagccagaatggtctcctgaccttgtgatccgcccacctcggcctcccaaagtgctggtattacaagcatcagccattacacccggccctgccttttcaaaacaaaacaaaacaaaacaaaaacaaaaaactaaacactagactttatttggatttcacaagtttttccagtcacgtcctctttctgttccaggatccaatccaggatactacactgcatttagttgtctagtctccccaatgaatctttccctagttttcatgatcttatctatcttaaagagtataggccagaatcctgtagcttttccccactctggatccatctgatgtttttctcatgattaaactggggtcatgggtttttgggaagaagaacacagaggtgaaaggctctggtcctcacataatgtcaggtgtacattcacatgtcgggggtgtgtgatattcttggcacaaaagaaagaagacatttgtccagcattcctattttattagaaagctttcttttggctcagaaatgctatccctcattagaaaagaaaaatatttttatccctagaattaatctatctttgttcccttggtcattttaaagacccaaagatcaccttgtgcaagataactgtgttgcctcaagttattccaagtgtatgtgtcattacttgtcatgaattactcctgacattcttagcaacataaatgagtcagttacgtaagatgtctggcatagcctgatagtccttggaatggagggtctatctctgttgcagacatcttcacatgggaatgcttaatttgttgtcttctatgagaaagtcaaaaagattccaaagcactaaaaatgttgtcagatgttatgtgagatccagccagctacaagaactattgttggtcttcagttcgtgaactgacatctcaagtattttatagaatgtgctaaaagaaaatagtgacgtaggctgatctttgctggcaaccattcctaaagctaagagacttacagtgtttgaaaggtataaaataatctttaaaatgaaagttaccttgtttattttctctatggacagacaatattggcagccaggaattatttataaatcaaagagaccaagaacacaattggtaaaacaaaagtttttaatcaactaaagtaattgctatgaaatattaaataaaataagaaacaaatttttgaactccaattacattaatactttgagctatttcaggaaactatgtcagtatttcagtagcaatttcaactatttcagggagggataacctgatactttgcttatatctggatacattttaaaagttaatgccccattagaggttaagaaatgaaactttgcggctaggtgtggtggctaacgcctgtaatcctagcactttgggagaacgaggcaggcggatcatgaggtcaagagatcaagaccatcctggccaacatggtgaaactccctctctactaaaaatacaaaaatgagctgggcgggaggctgaggcaggagaatcgcttgaacccgggagacggaggttgcagtgagccgagatagcgccactgcactccagcttggcgacagagcgagactctgtctcaaaaaaaaaaaaaaaagaagtttggctcaggagaaacaggtaattgtcaataatacttgagtgaaaggcctatacagttaattgagttttcctggcagacacttttagatgcattttaaataagaaaatttgaagaaaaccacagtcatacattgatctataggacatggtttttaaaaaacaaatccctctattttatttattactccctttagattagggctcctttctcctcctgtgagtatagggctaaagtgttttatatctattcccttcggtaatcttcacaacaaacctgtcatgtaggtgatgaagatcagttgtacctaccatgttttaataatcataaactcttataagttggctagccattcagcagaacattctgaggctgtatttgcactgacaaggcaagacagaattatctgcttaggtcggaccaatataatggccaaacaaaaacatctggaagactctactcttaccagacgtgttcaagttattgatgaagccagtcctttgcttcagttgtataacttcgtatacatgacattttctaggacacttattaagaattatcttctttctcagttagtgattttatcttgtcaaagcatgtttaaaaatcctcacttatcactttctcctttggtattcagcagtcatcataatactaccatttctcttggctttccttgttactttgaaaatgagccagagttctttatacaactgtttggccttatagttcaacttctagacaaagtagaattatctgtttccttccataactgcctatgtttttggttttgtttttcaaattcctagtcgagttttccttctgacttctttcatgcaactaaacaggtctgcaaactatctgagcgacattatattgcatcaggttctgccttctgtttgcagctctaaaatatttcatgttgtattccaagacactgatggtgaggagtatgattattataaatagcttattgatttattgtctatttttagttatttctattctatagatcagtatactgaggttgatacaacagcatgggtggagtgataaatactaaagtgtgtagtgccagacataagaagtactattatttttgttacactaatcccagaatgcattgcagggagcactgcattctcctgggtagtctctttttcagaaaaattgccgttgttgtgtttgcagatattgatgaatgtcagcaagggaatctatgtgtaaacgggcagtgcaaaaataccgagggctccttcaggtgcacctgtggacaggggtaccagctgtcggcagctaaagaccagtgtgaaggtaagagggtagtaacatgaactactgaaacttcagcttaaagcacctggtctgaaaaaggtacgctcaatcaagtgagtttaccttttaaaaattacccagataattgcattatagtgccagaaagccaggacttaaacataagttaggaaagtcaataaaacaagattgaagacagttaaatttgaaaacctatggcattagctatcaatggctaggcattagtattaagaagaaaaattattgctttctgtgtaattctttactacagaaggtaatttccatttaaacatgtaaattaatttaaagtttttatatacttggatttcagcaattagaaagtcattatatcgggctgctttatgctgtggaatgttaataaccttaatttttgtatttaacgttgaaaaattttgtcttttaaaaaaatcgctaaagaagatttctcaataaaactgtaataatgtcccccttagagagaaagtttgcaaaatatgttctgttcctacagctgatagtgaggattctggatttgctagggttgaccttagactttttaaagaaacatttcattgaattgcacacagaaatacttcacttcccaataagtatgtgcttcctgaacttgaagatattatgatctcacctgtgtcaaccacaagtgtccagagttcttgagaggaaacgccatttcttatttaagaacagaatccacactgtataaggccattgtttcataaataaacaatatccacgtcttcatgtatactctgaatatttgagaagcaaaaaagtctcctgagatagtattacaaaagcgacaatacatgatggtcattacttgtatcaacattgtctttctagaatttacactgatccaattgagactgattgaaaatgtttttgaagcaccacttccacagtttctttgtattctcttgctcatagacattgatgaatgccagcaccgtcatctctgtgctcatgggcagtgcaggaacactgagggctcttttcaatgtgtgtgtgaccagggttacagagcatctgggcttggagaccactgtgaaggtaagaattgctcctgatttcagaatcataaaatgcccagatcggagggaaatctgggcatcatctcagccttgatctttgaacctcatctcttgatttcatagtgaagacattaggtccctgcaaagtgtcttccccggggtcacacaaataattcaaagaagggagtagagtccagattatctttgcactgcttggagctgtcttttagacttgtgccagccaaaggcataaaagaatcagtttaactttaccagctatagatggtttatcctgggtacatagttctgaactgtaacaccttatttatgcagaaccaacttctaaatgttccaaataagtaaatacaacttaattttccaggcaattagaaggtttttcagagccaaacatcaattcagtttttggctttttgcataaaatatttctgaaagatatcccacatgtccagtatcgtgcagtcatcaaccactttcactacttgtttggctaagaagctctctgcagtggttgggtgactgaaccaggcctgcttatggagcggggaatatcttctcccagtgggcttctttttcacttttaccaccggtctgtcacttgtgacctttctctgcattcattgtccacctaagtaacaagctttttcccagcccacctgaggtttcactgcatttagagcctgtcagttgtgaaaccagaaatatgcatgttggcagggttgtgtctcccatgcagggtccaagtttttgaaggagggtctgaaccccacctttgagagaagtggatgagccttttggtgaatggtttcatgacacacacatttcagcagccccagatcctttttcactaccagtccagtggattgggaaagatctattgtcatttacagcatctacatttctgaccagagaacttggcagaagcagtcacaagtggctgagccccatatcctcctgctgctgggagtgtaaatgacccaaccctcgggaaggcaattttggcagcgttttaaaggccttaaagtgtatactgttaatgaatcagtaaatcaacttctaagattttatcctaaggtgatcatgttcctcaaagagttaataacaccagtgaaaagttgtaatcaatatacctattgaggccagatgtggtggctcatgcctgtaattccagcactttgggaggccgaggcaggtggatcacctgaggtcaggaggtcaagaccagcctggccaacatgctgaaaccccgtctctactaaaaaaatacaaatattagctgggcgtggtggcgcccagctaatatttttacacacacacacacacacacacacacacacacaaacacacacaaacacacgcacacacacccctattgagaaataggtcagataagtgataatataagataggactatgtatgaaaaagttgtgttttaggaactctctaatatatgggtaaatgataatgattctagatagtgacatcccaaggtgggagggttggtggtgttggagggagacatttatggaagaatctattctagaactaagtaactggtaaggtatattctagggcagtggtccccaacttttttggcacacagggaccagtttcgtggaagccagtttttccctggatggggttgaggggatggtttcaggatgaaactgtcccacctcagatcatcaggcattagttagattttcttttttttttttttttgagacggaatctcgctctgtcacccaggctgagggcagtggcacgatctcagctcactgcaagcttcgcctcccaggttcacaccattctcctgcctcagcctcccgagtagctgggactacaagcacctgccaccatgcccggctaatttttttgtatttttaatagagacgggttttcaccgtgttaacctggatggtcttgatctcctgacctcgtgatccgcccatctcggcctcccaaagtgctgggattacaggcgtgagccaccgcacctggcctgcattggttagattctcataaggagcgtgcaacctagatccctcacatgcgctgttcacaagagggttcgccctcctatgagaatcgaatccagctgctgatctgtcaggagatggagctcaggcggtaatgctcgctccctgctgctcacctcctgcagtgccgcccggttcctaacaggccacggacccgtaccggtccatggcccagggattgaggacccctgtgctagggcactaaaaatgtaaactgaccatcagcatctcctctgtcctgattcctggccaagccaagaaggaactgcaccattgattaagtcttgggtaactgatgttcattggagggcatgttcctcgctttgtctcttttaatgtgtaagcattttaacagaagtctaaggtttttattccaaaaacatccattgcatgaaaagtcaaacaaaagcttttagcaaactcgttcttcattattaatgtatataagatatgactatgttccgtaagaaagcttcttttggaatatataatcaggcccttttaaagtcaggactagtttctctagtgtactgggttataaataggactggagtccatccaactaatttagagctccctttgaaactatgttagcacctcagcctgctaattcccaactagcaatgtttccgaccctccccagtgatatttagccataattaactaaaccgtgactgttcacacgcctctgacagctgtgcaaggaagagccatctttcttgttggcttttatgtttacacgtgtaattttcccctaatggttctggcaaagaccttgttttcttattgtcctgtcatcctgctggcctcctcgtagagtcagactcccaagtgttgtgcctgcttctgtgcgctactgactccagcatgcttggtagctagtcattctgtgataatgaacgtgcctcaattgtcctcattcttaggagtctggagcatctcagctttcaaaggctctgcctgtgacttgttccctccaagcacagtctttaatctcgtgtctaccttaacctttccccaatccctcactaaggttgctccctgcagtcctttacaaagctgagaagatgactcattacttacaatgtctttccctttccctctgtgccctttgctcttggtcatttatttgtggacaaaattttaaaaaggtggaaaggtgggatagtatttctttccaaatcagagtcattcatacattcacttatgtatttgttcaaatatttatttagtgtggagcttgtgccagacactgttctaggcatagggcaataaaccaaacagaaatttcttcccttttgtagcttacattgtagtgtgggagataacgaaaaaatacaataaatggctgggtgcagtggctcacgcctataatcccagcactttgggagttccgaggcaggtggatcacgaggtcaggagatcgagaccatcttagccaacatggtgaaacctcatctctactaaaaatacaaaaaaaaaagaaaaattatctgggtgtggcggcgtgtgcctgtagtcccaactactcaggaggctgaggcagaaaaatcactcgaacccaggaggcagaggttgcaacgagccaagatcacgccattgcactccagcctgggcaacagagcaagactatgtctcaaaatatatatatatgataaataagtaaaatatatagttcgttaaatggcaataaattttacagagaaaatagagcggggtatatggggagtgttgaggaagggtggtgattttaaataaagaggcaagtagaggcctcgctgggatgataacacttaatcatttatgggtagagcattcagttcaagggaatagcagatgcggatgcccgaggaaccagctatgtggagacctgaggggcaccacgtcagcactttccacttttgatgcccaagatgaatatttgaaggaagatatctgaaaggcaattgtatctatgcatttggaatttaggggtgagttctaggccatgaaattaattgggaatgagtgtagctagaagagagataaatcccgggccctccaacatttagaagtgaggaaatgggtaagaaccagcaaaggagattgaggaaaaagtggcaagtgaagaaggagaaaacccagaatccaagagaagaaagtgtttcaaggaggagggagtgatggattgtgtcaaatgttattgctaggtaacagaagaaccaaaagttaaccatgggatttttagcaagctggaagtagttggtgacctcaacaagctcagtcttggtagaaagatgacagtgattcactgttcctgcccttaaaaccttttactctacttctaggaaaaatatatattttcgcactaccccaggtggtggtacgaaatagtaccatgttgtgctctcgtaatgttcaaccttcttattgctttgaagacagataaaggccttgcaaaaaaaaatttaaactaaacctaaccctaacatatgctcagctttctaatgtatataattatttataaacactttaaataatgctcttttccctcacattcattatttgtcttagattttggaaaataaatgagaatcaaattgctttaaagtagcatgaacagagccgggcatggtggctcacgcctgtaatcccagcactttgggaggccgaggcgggtgaatcacttgaggtcaggagttcgagaccagcctggccaacatggtaaaaccccatctctactaaaaatacaaaaattagccggccgtggtggcaggcgcctgtaatcccagctactggggaggctgaggcaggagaatcgcttgaacctgggtggcaatagttgcagtgagtcaagatcacgccactgtactccggcctgggtgatagagcaaaactcagtctcaaaaaaaaaaaccaaaaaccagcatgaacagagcaacatgcttccattatgctgaggcaaacatctaggttatgaagtgttttttcttgtagaaattcatattcccaggattctcttatgatcttttttgaattgagttttttatttaatgtcactgatcaaatatgcttctcctcgcttcattatctccatttcctacaaagcaaagaaagaaaggttaatggaaaaactgattgtcagtcgggtgcagtggctcacacctgtaatcccagcactttgggaggccgaggcgggtggatcacaaggtcaagggatcgagaccgtcttggccaacatggtgaaaccccgtctctactaaaaatacaaaaatcagttgggcgtggtggtgggcgcctgtagtcccagctacttgggaggctgaggcaggagaattgcttgaacccgggaggcggaggttgcagtgagccgagatacaccgctgcactccagcctggcaacagagcgagactccatctcaaaaacaaaacaaaacataactgattgtctactttacacccattaaaatagttgtagagctgtcagagtaaatgtggaacaatcggagttctcatatgtttcctgtgggaatgtaattgctacagccacttcagataacagttgttcaaaacttaaatataacctaattccatgacccatgcatcgttttcctgggtatttactcaaaaaaggtaaaatcatatgttcacacaaagacttatgattttagaaatatttatagaaaccttattcacaatggcccagatggaaacaacccaaaatgcttatcaaaaggtgaatgagtaaacaaattatggtgcattcatccaatggaattctacccagcaataaagcccagagaactactgatacacacagcaacttgggtgaatctcaaaactattatgccgagaggaagaagccccaaagcacaaaaggagtgagagggaatgtattggggatggaaatgcctgttccttgactgggatggtggtcacaaggatgtgtatacatttgtcaaaactcattgagctgactcttaagtagatcaatttattttatgtacattatacttcagtaaagctagaaaaacacattaaagaaaaagttgagaacctgccttagttgagacaaattcacatcacctatgttttatgttttagggtcagtacccggaagcattttaattctgggtgaacagtcattataataacgtggttttatttgatagaaagaagtgataaggcactctcttatttctcttttgtttgccctgtgaatagtacagaagcctgttaattggttgattggattctaggagaaaaatgaaattcggtatcaccgtacttgaaccagacagccgggcgtattagacagatggcaacagtctccatattcacttcttcctggaatctctcatattttggcagcaattacaattatttgcaagaaatgccataaaatgccaagttctgagaaaacaaagaaggttttgtttcttagctttcttcgttgctaataacttaaatcctcacattcacaacagaagagggctcatggagtacattaggaataatgtgctttgactaggggtaaacatggtaatcagcagcccttgagaaagatctgctcgcattcatgcggtgaaggggagccattaattgtctttcattctcacagtcaaaactcgttattggttatgtataccacttttagttgcgcatttgctatgaatttttttaaacatttttaaacattttttaaaatccaggctacctcaaacctgtttgttacagctgctgaataagtgacttaaactaggtttttgatcttgctgttctccttctgttcaaaagtccctcttcttccgactcccccatattctaccctactgtgaaatttactataagtaaatttacagatatgcttctgttacacaaaagttttattttaaactttatgatattctttgtctaaatgcatatgacccctaaagttgatgctactactttgtcagataattatattttgtgacaattcttatgttacattggtttggacttataaaacaatgtaatattttatgtttaataatacaatatcatttgtttattttattgttaataatacgatatagtttgtttctttgaacaaacatttctcttggggacaaagaccatgctgaaaacttttaaatttttttctataatgcataatacagaagcttgtataaatagatcaagtgttgctcaagatacacttaataagtatttttgaaatattttaagtctttatcatcaccaacaatataatcaagtaaattattatttgctacagaattttgacttttcctcttccatttaatttcatttgatgtttaaaagttccatttcttggccaggtgtggtggctcatgtctgtaatctcaacactttgggaggctgaggtgggcggatcacttgaggtccggagttgaagaccagactggccaacatggtgaaaccccatctctactaaaaatacaaaaattagttgggcgtggtggtgggcgcctataatcccaactactcgggaggctgaggcatgagaatcacttgaacctgggaggcagaggttgcagtgagccaagatagcgccactgcactccagcatgggtgatggcaagactccgtctcaaaaaaaaaaaaaaaaagttaaaaagttgtcatgtatttaaaattatgtattataaatgatgtaaaatagtgtacctttacatgtaagagaaatgtctaattttccgatatgtgatttatttagtctttaaaaatttttaaattggtttttagatatcaatgaatgcttggaggacaagagtgtttgccagagaggagactgcattaatactgcagggtcctatgattgtacttgtccggatggatttcagctagatgacaataaaacatgtcaaggtatttcttgctcttttttccccagtcattatttacgtaattcttcaattctgccatgttgccagatgatagtctgtggttttgccatgtgatttatatgtaaataatttatgtcaatttttgatattaaaatagctgtcttgggtccacatcaagtgcaggaaggtgttgctttgtccagcatagtgtcaactgaaactcacacgagtaagagctgtgtcctcactgcgtgcttccgtcacctgtactttactgtttattccatgctgtaaccttggtactgggttctaaattatctttatagcatcttttatgggcatattttattttgtctcataggtggtatttatctgtccttttctgactctatttttatccagtgcccgccattgctttttttttttttttgagacagagtctcgctcttgtcacccaggttggagtgcagtggtatgatctcggctcactgcaacctccacctcccaggttcaagcgattctcctgcctcagcttcctgagtagctgggattacaggcgcctgccaccacacccggcaaatttttgtatttttactggagacgggggtttcaccaccttggccaggctggtgttgaacacctgacctcgtgatccacccgctttggcctccaaaatgctgggattacaggcatgagccactgcacctggctcaccattgctttttctcttcctaaaaagcctcactaataatttggtcaaaatcatgaagaagaggatcttatattttttcaatgtgctgtcatgtttaatcttccaaactgtacagtgcatgaagggtactaatgaaaacacagcaacacaacacaggtactaataataacaatcacagcagctgtaactgagcttcttcagtgtgctgagtactgtaggtatcttggtatctcttcgaattcttacagcaacttcagaggtagcttttcttgtattcattttgtgcatgagtaactgaggctccgagaagttagggagtatgctgctctctaatgagtggtaaagttgagatttgaacccagggtcttttcccactactcttccctacattgccataccaattattgttacatttatagccaaaagaaagaagaaagtgaaattaagtgatttctctcacaaggtagcccattgagtcatttcaacaccatagctaaaaaaattaaattctctaggttctgtatcccaacatttttagctatacctgacttgccccacaagctttcctctatttactagtgttagtaaacccatgtttatattttccatggaaaattcacacttattttacctttatatctgtttatttttgatacccaataaatgttatttttttcttattgtttatctaccattatggaactgtgtagtgtatcccaaagcataaataaataaaaaaaattgttggagttactttttacccactattactgaatatgtatgatttttttaaaattctggattgccataagttatatctcatctcacatgtcccaaataacagtcttcttgtaggagaagatggtatctactctctaagatagtggcactggaattatatatctatattaccggtcacacccagccatgtgtcagagatatgaaaaacacggacctttgccacaaggtttttaaaaattaattcctttactgatccaaagatttaaatatacaccttcctgcacttgatgtgtacccaagacagatattttaaaaatcccaagatttaaatataccatgtacctcatttgagatcatgtatttatttgccatcctcatgcaataaggtgaaattcaattttttccaatgcagaaattaaatgtgcttggacttaatgcaaaagagaaggaatatttgaattataaatatatgtgagaatatttccactttgggactattaccttttaacaaaatgaatcttgatttatataaaaataccaagagatggaaaaaaaaaaaaaaaggaaaccaaaccctgactcttgtttttattataggctttttggcttaaaagtatattttcttttctaattcttctcgtcacaatttgttttggccaaatacaggcaaaaccaaatcttaataaaaatggaccaagatttcatattgcataaatttaacttctagagttcagtcacacggaactaatttagttatctgattcattaattgcactacttcattctctcaatatattaaatttgtgtctgtggtttgatatcacctctcaaatatgtgactactccaaacatagagagttttattgactatcaatcattattaaattgacttcgttctctgtcacatatattcctattttccagaataagttaatatgtctgaaaaatgtaaatccaaataaatgagaagcatttctgaagtaggtcttagtactgtttaaagaatagtgtctgtgaatctgttttatcacccaccacctcctgttagaagctgtatatgatggcatgtatatactcacctcgttttgaattatcccttttcgctctttcactagaggcagttttgtgatctttcactctgcctgaagttagtagcctacttttctctaatcccttgatcatgtcagcattctgtggagaggtgtagatttcagagtttgtttaaattctgaaaatgtaattgatggcaatgctaataaccatggacatgtttgaataacagtgtgtgataggcataaactttaaaccttacctaatgttctgaaaatacttctatattcagtaaggcattttcagttggaagcgtgtttaagattttctttcccatacaaaactaatgatgatatacagacagtatggaaattccatgttaatagtctctttagaaatgtggcaggatacatttgagattcagaatgcagttcagtttcatgttttgatttacgcatgccaaattatgaatttctgtggaatcgcggacccatgaaagaaacccaacttaaatatagtctggctttcagcttgaagttactagcagcatagtttagaaatgcctcaataagtacaatccaaattgaatgcatatgtttccctagttccaaatattcatgttgttctttcttagcagtttcctggaaaaaaaaaaagtctaggaattcatcttcagttcccgtcatcaaactttttagacaattatttgtgttaatcagtgacttttttgatgaaaaaactttgtgcacattattccctatgcaaagttgcaaagcaggtagtttttaaagggccacactgaggcataggataaaataagaagaggggtctcaggtagctattagggcttaataagatggatataggtcctgagcttgatccccaagccagtggaacttcatgccaccttcttcctcagatagaggtaattcttgggcagcaggttggaaataaagagtggatctgaggaccaaaaggaggtcaaacttcaaaaaggatggccaatctaagatattaccaataggtagagaacaaacatagacaatgtcagagattttatcaaagaagtaaagaatttcacagagtaaaatcatattgagaaatacataagtagaaaatgattcattgaccttccttgaaatatctaaaaactagtgacagtaacaagaataggagaattgttaagaaagtatgagtaattcctgttgggtttcttatttttattcagcgatggacaggccaaataatctgaattatgttgcagatggaaggctaaagagttcaagattaataaaggaagacgtttaaaccaataattgccagaatttctgttgcacgggaagatcaacaagtcaaaaagaagagcttcaggagattctggctgtagggaaagggatgactttattgaggaccactgggtcagtggctaagcgtgttgtagcagccaataggaagaacatacattctgtaccttttccctgtccttattaagctttgcagtattcatgtgggttcctgtactgaagacctcttttgtaagagataaagggagggcctacgagacttggggaagataggaaaacgaccttagtggaggtatgcctcctgaatgctgctgctaaggacatgggatcatttttatgacccccaattaactaaaagaaccttcaccagtcaccattcagttagcggagaaggaaaataactgagaaattttgtggtggacaaacattcataagaccctgcaatgtacccaataggagtcaggaactcagagcttttcagctgagatcgtttatcaaggagccatcagtgtaatgagggacacagatgagtaaaccaacaattaggcagttgcatgtatcagaaccattgtgaacaggtgaaactttctctaggcgctttatgttgtcatcttgggcactgttagccaatataattagaactggtttgaaagagccttttacttatagtaaacagtccatgtgttatcagtgtttggaagtagcccttgaccctggccacggggagcacaattacactgaggacaagctgagcataaagtcgacaacacaagtgtatggcatgatctgttcatgagtcttcttaatagtagttattgctttttgacgcttcattgtgtggtaggcactgccctgagccctcattcgctgatttcatcatcggaaaccatgcaaatacgaattttcatggtctaaaagtccttctcagccaagcatggtggctcacctctgtaattgcggcactttggaaggcggagacaggaggatcacttgaggccaggagttccagaccagcctgggcatcatagtgagaccccatctctgccaaaaatttaaaaaatttgccaggcatggggccagtaccttagtgccagccactcgagaggctgaggagagaggattacctgtgccctggagtttgagactgcagtgagccatgatcatgcactgcactgcagcctgggcaaaagagtgagaccctgtctctaaaataactaaacaggccttcttttacttgtattttatttctattacccatttccaatgagttatagattggagtctatttcatttatatattcagcagacatttgtgaagtgccatttatgagccaaatactataaataagacatgtctagccttgcccttaagaagcccacatcctagggatggataggcaggaatgtaacaaggtactacagactataacagctgtgtgcatggcaatgggagagggcaaagaaggacagcattctcaccaatgaagagcatctctcagagttgtggagtattcctcaagccccatatgtctaaaataagggtagctttgggttgaacctatgaaattgctttttttgcaggtcaaaaatgattgtacattggctatttcctaactcaacctaaatagtttctctctcataactcagcttgtcctgtggttgatttatggacaaatggtatagttgttccactaaataaatgtccagccatgtcataatagatttatttgccatctgtttgatagtatatgggaatgaaaccgatttttttcaagtttttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataattcagagcctcaaagcatgtatgcatcaaagtaaaccatatctgaaagcatagctcaggggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtcttgatcattctgtgtgtaaaaaatgtcttgcggctgggtgcggtggctcacaccagcacttttggaggcccaggcaggtggatcacttgagatcaggagttgaagaccaagcctggccaacatggtgaaacctcatctctactgaatatacaaaaattagccaggtgtggtggtgggtgtctgtgatcccagctacttgggaggctgaggcaggagaaccactgtaacccaggaggcagaggctgccgtgagccgagatggcaccattgcactccagcctgggcgacaagagtaagactccgtctaaaaaagaaaaaaagaatgtcttgcttgatttttctgtatcactgtgaacagatcttctagaattcttcccctaatatccttatttccaaggcagtatatttacttacctaccagtatttattatctcctaaaagctaattaagttgtaagatgttaagataatgctcttggcttcctacttacaacctctgtatgtttgcaagaatacagcactggttattttcataagatttgtgttcttgatgataatttacctgaaccattttaaaagtaaactgaaaagattcccataatcataatttcagttgatctcttttgagaatctagattattgaaactcagctatattttaaagaagtaaattgcaaaagttttgttctgggtctaacatagtgcccagattctttgctctaaaaaatagtgcaacaggaagtatctgctctccttgctagtaccagaatggaaccaagccgtgtgccagcaaccaggttcatctgaaactaattattatattgggaggaataaactgatcttgtaaagagcagaagattgttgaaattactctcctgctgagcagacaaaacatggatgccagatttgactagaactgggagagagagagttcagggtggattgagcaaacagattgaggggtttggaagggataggaagttgggaaatggaagaaagcatcatagtaatgtgggtgatgagagatttagaagaaatccctgcttcagtggttcaagttttatgtaaattttatatttggggctttgagaccagagcttttagcaaagacactccatgaatgcatacattcttctgcagagattacagtattcctcagcttgagggatagggtgcaagcccatccgagtcactgaggaaacagatttgcagaattcctaagctctagaaggatgcaggtttgcttctttgcttagctctaaatcatggatggtaaaggcttgcttcctaagaaatggtctgtggtataactactgatggttgtgccatgcaaaattatattcagaaaaaaaaataagtgacctcaagtgctcactagtcaaagctgttgttccaaaagaatatactaaacataaatatattcacaattattttgtcttttgcacttactaatgatttaattctgtacttttttaacacagatttctgcaacttgagagttgcataatcactgtaatttagttgcagctctaattttgttggtcatttacttggcaaagacttgaatttaaaaatgtggttttaggaaacttgtaatgctttataaattactgtactcattgagtatactctttgtgacacctggtctgtactgccttgactccagaacctggacaattttataagtaatgaaatacaagttagaatattatgttggtattatacatggtagtataactagaactctccgtaattattatgcatgttattctctttctggagtaagttctgcatgaattttattttttatgggcttaatccaatattctaaattggtccaaatttccctttgttagactcagtctgacacttatggcagtagtgctatgtcctgatttctacctctggctgtgctgcaggacaaagccagctcatgtgatcagtattcagcagtgaggctgatgtgtgattgaaatttagcaatggagcagttgtacatagtacttgaattaacactgagaagtggctggcattcttatctcatgtccatttactgattttcttctgagcttctgtttgaggagctgaagcctcgttgacaccagggctgacctgcccggctctaagcagggctaaataactcccacatagctgaaggaaggagggcccttccctgatttcccgtgacttggagaagtgtcagcatctggtcgtagttaatgaaccacaatgaagaggcaaactctgtcaacatgaattgtctttaagtgtagcatggcagcttctatagcaataaaaatggcaccactggctccttcctttctcttacatgtatagattgagtattcctcatctgtaaatccaaaatctaaagcactccacattctaaaactttatgagtgcagatgtgatgctcaaaggaaatgctcattgagcattgcagattttagatttttggattagggatgctcaacaggtaagaataatgtacacattccaaaattaccaccaccccccaaaaaaaatcccaaatctgaaatacttctagccctaagcattttgggtaagggatactcaacctgtatatggtactctgggatagatagctgggagaggaaggagaaacaccgtggttctcccatgtaaggtaaagaatggtgtaattcacagttcaagtgaagtgggaagtaggtggtgggtgggcagctatttgtcatttattcactcacgtaaccggtatttactgagttcctatctggttccaggccttgttccaagggtaaaacatacaattcttgcctccatgaagccgacattccactaggggaattggggataaagaagccaatggtatgtgtaggatacattaagtgtttataacacagcatagttaccctttctggatataaataagtgcagagtgtaacgtgtcatatataatataatacacaggatatttttttcaaatcccagacttagatgtcaggaaattgcaggggaacaggactcttctgattgacttctgctacacttccctttcctctctcagttatagttcatctcctcctgccaccttcctttcacgctatagccagagcttttatcttgtgtattaaaacaaaggaaactttttctttcactcaactcgttgttttatggtccatttgatcatatccatttgtttagcaaaaaatcataattcttttgcctttttatttctgcccttttttattgtggaattttaattcacatgaaaaatactcatcatcaagcctgggcaacatagcaagactctgtctctacaaagaaaaattttttttaattagctggacatggtagctcatgtctatagtcccagctactcaggggactgagacggaaggatcgcttgagcccaggagttcaaggctgcagtgagctatggttgcaccactgtactccagcctgcgtgacagaaccagaccctgtctcttaaaacaaaaaatctgaccaggcacagtggttcacgcctgtaatcccagcactttgggaggccaaggcaggtggatcacctgaggtcaggagttcgagaccagcctggccaacatggtggaaccccgtctctactaaaaatacaaaaattagctgggtgtggtggcaggcacctgtcatcccagctactcatgaggctgtggcaggagaatcacttgtgcccaggaggcagaggttgtagtgagccgagattgcgccattgcactccagcctgggcaacaagagtgaaactacatctcaaaagaaaaaaaaaaatccttatcattgcattcataagctgatttgagattcggtctcttcatcatcagtagaatgtgtgtgggagaaaattagggaaacttaatggtaatcagattcctaggggtcaccacgtctgtccccatggcccatggggaaaaacctcctgatctctgactttgtgtcacctcttttccatgcctccttccttgctgcacttggccaggaacaactgcgctctcccagtcgtgtgcccaggctgagcaagggcttgtgtgactgccgtggagtccggcacaccccccatctctaggctccctgtgcactctatcctgttcacatgatacagcggccatgttcatctagcagggaccccaaggagcccagccacacagagggagcaccagcagcttataggacctggcacttttccctctggtgttggccaggcttggttagtcatggctaattaggcctccaaaccatggccaaaatcactccctgaagtattgtcttttagaaagcatcctcattcattccttcgtttgacaggtatttattaagtgtctacctgtgtgccatccactgttctaggtactggggccttgtcagtgaagaacagcaaaagatccccacttacttagaggcaataactaatagataactaagatgttagaaagtgtgataaaggctgggcatggtagctcacacctgtgatcccaagcactttgggaggctgaggcgggtggatcacttgaggtcaggagttcgaggccagcttggccaacatggtgaaaccctgtctctactaaaaatacaaaaattagctggttgtggccgtgcacacctgtaattccagctactcaggaagctgatgcacgtgaattgcttgaacatgggaactggaagttgcagtgagccaaggtcacaccactgcactccaccctggtgacagagcaagactgcctcaaaaagaaaaaaaagcgtgataaactctgtgaaaaaaaaaaaaaaagaaaaggtagagcacaatatgggggacctgaagggtagagaaagaagtggaaagctgctttgatgctaactggggtggtcagaatcggcttttctgcttctgtaagtgaaagaaatactgaaattttctgagtgaagaaatgaagccatatgaagtgcctgtcatgttcaaactggtcttctactggcgaagtgataaaagcccatcaataaataggtaagggagcatgagatggcagccgaggactttcttgcagctgtcaacatgaattctattgtccagacaagaatagaaaatcagataaagtacaacgccaagagttgtaaacacttgatgtaaactatggactttggatgataatgatgtaagagttcatcagtcataacaactgtatgtaccagtctggtgcaggagactggcagtggtagatgctgggggctggtgtgaggaagacaggatataaatgaaaactctctgtgtaatcttattgggaacctaaaactgctcttaaagtctttttgaaaactcagacatatttttggcattaccttttttttattggaaaggaaaaatgaaaacctttcattttattaataattctatattccactcctgtattttcttctcttggatgatgatggtgatattatttctcacttttcaaaataataccctggactgagtatgggatcagcagcttctcctcctagttttcaaaaatgattctactatttgattgaaaaattgagcactgcaagactggaagagggcttcttgtcacatctagcctgaactctgactcccacagtatacccaaagtattcaggaatcaagtcctattgctaaacatctatagagactctaaccccataaccttcttaggtatttactataaatcactccttgcttacacattcatctgaaatggaaaccggtaaaaattgccaatgcgttgacgtgtactgaaagtagtgatatcacaaccgagagaaggtggattcaaactctcaggctaattttgtattcattgggaaccagaaaacacaagaaagacaacattgccaaatcaaaaaagtaacaaattgggagcagacgtggggtttgttttcacacttctaggtacattttctatgaacgggggagaatgaaagcataaagccgtggacagtgccccaaggcagttggtggttttgtggcatggatatagaactttatatctgtcaccaaatagaaaatgcttttgaaaatgactcagccaagtgggatgctgaagaactctgatgcagtaatgtgttacatgtggtgtgcttagcccaagattttcaggtttttaagagttttcgggtctgaaactgaaaactgtactaagagatgatgattttagtatttcttagtagagagaattttaacaacagaatccactctcttccatgtgtaaaaagaaaaaggatcatacaacattctaggtaaagaaagaaagtggcttccagctataaaagctactgttcacactcactcttcctgtgaatgtacttctgcagaagtgagtgaaaatgaatgtttaaatcattagggagaaagctgaggaaatttttctggaatgagttgcttttggacttgaaatgcagattttccatgcattgcttgattgtcttccatatatcaacatttgtataaagaaattcataatagtagcaaaaaatttgagatctcttcctaagcctttttttttttttatcactgctgaccttttcaaaccccagagctatggaaatcatctgttcatagaaggagaagtaaacacttgccttgcagccaaaaaataggcagaagactgccagaaagtgaagtctgtgactaggctagctgaccttgcataccgtatgctgacatccactcatgctctggtgctgggcgtcctacatctgactcctttgatgtcaacaacccgagtcctttttagatcatggaaggttattgtaagcagtgtttttgtacttgagacctaaactgtaatgcttcatacacatattccagaaacagttactttttagacatgtgatagaatattaagcaactatcttggtctcccactatgagtggactggagatacattatatatctgattgcatgattttattaaaacagtagcaagaataatgtataatagcattcactgagttcttattacaagccaggcactatgctaagtgcattgcacctgtcttctcatttaatcttcacaataaatctgtaagtaggttaagtattaattggtttaattttggctgcaacaaacagcttagaatgagggcatttattatacgaatgagaagtatagtacaagattgttacctcttgcctcctgtaggtccgtatttaaatgctgtttccttagtgaaccggtttctgaccgttctttctcagattcactcaccgtgtaatgaatgaattaattcacttcctgttcttttttccttttgctttttttatttctttaccaccttattctacttctttaccttgtttattgttctttgtcacactccattgctagactttaaggccagtgagatcgggattgttttctgtattttttacagctctgtatgccattgggaatacagatgctactcaatttatgatagggttatgtcctcataaatggaaagtcaaaaatgcatcaaatacacctaacctaccgaacattatagcttagcctagcctgcttctagcacattctaaacgtgctcagaacacttacactagcctatagttaggcaaaaccatctagtacaaaaaaaacccgattttataataaagtgttgaatatctcatgtaatttattgtactgaaagtgaacagaatggttgtatgggaactcgaagtacagtttctactgaatgcatattgctcctgtaccttcataaagtaaaaaaatcgactaggcgcggtagctcacacctgtaatcccagcactttgggaggccgaaacaggcagatcacctgaagtcaggagttcgagaccagcatggccaacatgatgaaaccccatctctactaaaaatgcaaaaaattacccagatgtggtggcacacacctatagtccagctacttgcgaggctgaggaaggagaatcgcatgagcctgggaggcgagtgagctgagatcacaccattgcatttcagcctgggtgacagagcaagactccgtctcaaaacaaacaaacaaacaaacaaaaaatcataagtggaactatcctaatttggagaccatctgtaattagttggggcacaatacgcatttggcaaatgaatcaagggaggaagggacagtctgtagctcatcctggagtactaggaaacattcttaataagattactccaaactgaatgtgatgtacacttctgtgaagccttccctattttttgaagacttaattctctaatgcacaccctgcataactactgggtgtagtagtggctaagaagttatgctggtgagtttggctacatgggcttgaactcttgttccagcacttctaagctgtgtgaacttggtgagtgcttcagttccctctctgtatagtaagaataataatagcacctacatggagttgatgtgtgttggcaagtatccgccgagaatggagtagcccatagaacatactcaatgaatgtgagctattgttactattttagcatttcttatactggtaccttagttacagcagtccttccttatctgcagttttacttcatgtggttttagttaccatggtcaaccacagcctacaaatattatagtattttgagagagactacaatcacataacttttgttacagtatattgttataattgttataattgttataattttaattataatataatcacagtatattattactattaattcttactgtgcctaatttataaattaaactttatcataggtatgtatgtatgtatgtatgtatgtatatatatggaaaaaaacacagtatatatatatggttcagtactatttgtggttccaggcacccacgggggattttggaacacatcctccaccaatgaaaaggaatgattgcattgtcattggtttccttattatgtgagcatctaaaaggagggaaacatttaacaactattttatttttatattgtcaatgcttacaacatatataacatgcagattaaatacatacttgtgaatgaaattgtatggtatttccaagttcatgtcctgatattgatgaattactgtattctatcttttttttttttttttttttgagacggagtctccttctgtcacccaggctggagtgcagtagcgtgatctcggctcactgcaacctccgcttcctgggttcaagtgattctcctgcctcaccctcctgagtagctgggactacaggcatgtgccaccacacccgactaattttgtttgtttgtttttagtagagacagggtttcactctgttagccgggatggtctctatcttctgaccttgtaatccacccacctcggcctcccaaagtgctgagattacaggcgtgagccaccgcacctggcctctatttttaaaccccatatttattttaaatcatatagaatatagtgtagtaattcatttatatataatttgctttaattcttcaccctttgttttccctgagagtttcatatgactcttttccattcacccacaaagtagttccagctttaagtcattccctgtatcaagggctagtaagctgacagccagcactgatgcttgtttgcatttgagcattggagctcttatttctagaggtacactgtctattttctgtggttttataactgatctttcttggcctcctatttgaatatagaaagagaaaaattagaaaatatagaaaaaagtgagaattttttggctgattttatgttgcctctgaggcctaagtgtcaaaaagatgaatctggggtttgatatgtttggcctgtctgtagggctttctcccagtcctcactggcagcaccttttagtgtaagaaaagctgtatgaaaagagaaagcgtacagcatggatctaaatttagaagacatttatttttcttaatcccagatataaatacgtaaaactattacattaattccgagactatccagtggttatatataattatgtaaagacaaagtaatagagccttttaaaaacttagaacagtgtaaaacaaaatgtatatttcacatttatcttttgtgagtaattggaagaaatttacgaatgaagttaagattttcccttaatacctaaagaactgtttctgaacatcgtggaatttatttataatggagctaaaacactccacttttttgacattgttccttatttcatagtaaactgtaattctttacctacaggtgtagaaaggtggattttgggggctttcttctttttttcctttaaaaattttagaagtatttcttttctataacaaattcaaaccttcctcatacactttttctgttttataacactgtcagcccatggtagaaagaaataggaagaaaatgtctttaaatttagaaatatactttggttctctttttctgtaaagaatcacagatgacttatagtgtttatagtttttgcttttgttaaaaaaaaaaacagtgttttgtgtttcattaaatatatactacttttcagtctaattcagaatattgctttaaaatgtcccagatactcagttttgaattttcatgtataatatcaaggttttattataattgaacaaacatctggcacacacaatggctttctcacgcagcacctctcaactccaccccgtttctccattcatggagtggggaagatacatgcccagcacaaactgcgtgtttgcaaagctgttaatgacataaatgtcctttccagatacaaaacctgagctttgtgagctccctcaatgaggaaaactgtttgaaacaaaccactttccccattttcctggtcattcactgaatgagcttgttgatacagttcgaaatgtaaatgctggcatacttttattggattaaaaaaaaaacaatctaaactgacttcagtcatgaggatattcattcttgaccttatttgggatgataaagagagaatcttctatacatttaccctgcttttttgtcttcaaagcctactgaaaatgagaatgagggatataatttatttatttatttatttatttatttattttttggaggccgaatctcgctctgttactcaggctggagtgcagtggtgcaatctcaggtcattgccgcctccgcctcctgggttcaagcgattctcctgcctcagcctccccagtagctgggattacaggcacgtgccaccacacctggctaacttttgtattttcttagtagggaagggtttctttcaccatgttggccaggctggtctcaaactcctaaccacgtcagtctcccaaagtgctaggattacagacatgagccattgcacctggctgatataatttaaatactttaataattcttaggactcttggctgttcaaaaaaatcaagatgtttaaaaatgcattttagattttactcctctgtaaaaaaccatttgctgtttatttttaaacgtttgaaaggacatgtggagtggggaaaggaaccaggccttggagcccactctcagtggttcagatagactctgggaagggggtgagtccagtgaggaccctggagacctggactgatccagacccagtgtctccttatgaatgctttacagtaaactatgacctatcttttgaacatgaaataggtcttacttccgtcttctatcattttttaaaacattcataattccaaagcctgatgtcttagaattattactaggattgcattctcttctgaatatataacaatgctgttatacttctaagaaaacgattttttttaatgacataataattctccatcaccttctacaagactaaagaacaatagaatactgaagacagaggattcaaataactcccatgacatagagtgggtcatgtacaaatggagttgagtttttaaggaaagatatagtaaattacatatgtttcttatttttgcttatattcctattttaaaaaaagtagcttgacttcattttgcagttggagaaaaataagttatagggtattagaatgtcttccaataagcagataggaagtggtggtcaagatgactactcagagtgccttaatatttcagtctaatatatatgccacaatacctgtaacccatgggaaatagaaaagcaaagttagcttttgaaatggtaagagagtctctaaccaggaaatgcagcagtgtggattatctctttttttttcagtaaacattcaagttggtgtttaaaatgcatgtagagggccgggtgcagtgactcacgcctgtaatcccagcactttgggaggctgaggtgggtggatccgaggtcagcagttcgagaccaccctgaccaacatggtaaaacccatctctactaaaaatacaaaaattagccaggcatgatggcacacgcctgtaatctcagctacttgggaggctgaggcaggagaattgcttgaaaccggaaggtgaaggttgcagtgagccgagatcacgccactgcactctagcttggacaacaagagtgagactctgtctcaataaataaataaataaataaataaataaataaaataaaaataaaatgcatgtagaaaagtgcctaaatcataaggccaccacttgacaagcatttatagtgagcatacctggtaaccagccccctgaacctccctcaaacttcctcgtgattattccccaccctcatatccaatactcatacatagcacttaccactatcctgacttcattattgtagattcgttctgcctggtgtattagtctgttctctgctagaacactgctaggaagaaatacccaagactgagtaatttataaaggaaagaggtttaattaattcacagttcattgctggggaggcctcaggaaacttacagtcatggtggaaggcaaaggaagagcaggtaccttcttcacagggcggcaggatggagtgagcgcaagcagggaaaatgccagacacttaaaaaatcatcaggtctcatgagacttactcactatcatgagaacagcattggagaaaccgctcccatgatccacttgcctccacctagttctgcccttgacacatggggattatggggattacaattcaaggtaagattttgggtggggacacagccaaaccatatcacctgcttttgaacattagctacatgtaatcataatatgtactcctttgtgtctggcttcttttattcaacattgcatttgtaagcttcgtctgtcttgtcatgtgtagtagtccatttattttcattgctatatagtatttcattgtatactacattatgtatccattctactgttgatggtcatttggcatgcttcctatgtgaggctgttgtgaataaacttcctgtgaatattcttgaacatgacttttcatgggcataatcactaatttctgttggatatcactaagaagtataatttctgggtcataaaatgtatgtatgtttcactcacatatatatagccagtttttcagagtaccagtttacactgctaccagcaaagggttaagagtctcagatccacattatcatcaataattggtattgtcattcctcttaaggtttagccatactgagtaaaggtatctcattatggtctcaatttgtgtttcccttgtgaagatatatctttaacaacttatcatacctttattggccctttggatattgtttctgttatctaattctgcataagaaacttcttccaaatgaagtgctcaaaacaactattttaatggcaacttcaggtgaactcaagttgttaattttaatgaagtccagtgttttaattgttttatttcagatcagtattttttatgtccagaatctttgcaaaccctaaagtcattaaggtactgttatgttgtcttctgatagctttattgtttcacattttaaatttggatttgtaaggcccctgaagtttttttgcatatggtgagaaataggggtcaagatttcttcatttcctaaatggacatcaaattaggtcatcactgtttattgaaaagagtgcctttttcccactaatatgaattttttttattaaccatagagtcagatatatatgaatatatttctgcattattcatattatttaataggtttatctgtctttgtaccatttgtacattgtcctagttacagtagctttataataaattttaatgttttctgctgtcagttctaacttcttcaattctgttcttgagattgtcacagctattcttggccctttgcatttctatataaattttataatcaggtgatcaatttttacaaaactctgctgggattttgattggaattgagttgaatcaatagatcaatttggggaggtttggcattttacagtatttagtcatctaatctgtgaatacaacacacccctttattagggtttccttcatttgtcttagtgttttgttggagatttttgtataaagtctttcacagcttatttaagacttattcctaggtcttcaagatttgcatgtggttgtgaatggtattaaaatttttttacccttataattgtttgttaccagtatatagagctaaatttgatttttgtacattgaacttgtatccatgaccttgctaaatctgcttgttaattctagcagtttatatgcagatttctttgcatctcccacatatacaattatgttgtataagtaatgctagttttattccttctcttctggtaagcatacttttatttccttttcatgtcttactgtactgtctaggacctctactgcaatgttgactagaagtggtgacagcttgcttgtctctttcctgatatcagcagcaaagacatttaatatgatgcttgccataggttttttttttcttaatagatattctttatcagataaagaagttcccttatatatctagtttgctaatgttctttatcatgcttggttttgaattttaacagatggtttttctgcatctgttgaaataattacattattttcttctttattctgttaatgtggtgaattacattgactggattttaaaacaagataaaaatttgttttccttatagcagtctaagcttcagtaatctagggctgataatacaggtctataatacagggacccagacaatatctttttttttttgctttgttcttccggactcaggttttctctatcatggtctcaaaaaaaaaaaaaaaaatccttgaagaattcaccggtaaagtcatttgtgcctggaatgtttgtttttgtttccttttgtttttgtgcctatgcattataaacatttttaaattgcagttaagatttcattaatagataaaataatattcaggcttttgacttttcatgtcagtttcagtaagttttgttttccaaggaatttatccatttgggtaaaatttcgtttttatttgcacaaaattatttataatatcctcttctctgtatatatgtagtgatcttttttaaaatttcagtaatttgtgcttatgtttcgctcttgatcagttttcctagggttattagtcatttcaaagaaacaacttatgtggatttgtttcctttgttttctattttattaatttttgcttttatatttattattttttctatattttttatatttacactttggggtttaaattgtctttatttctaactacttgaagtagatctttaaatcattagattatcaatcttctaatatttgtatttataggtatatatttctttctaagaatggctttatctgctatccataagttttgatatgttgtattttgttatttacataaaatatttctaaagttcattgtcatttttttcctttgaccaatgaattatttagaagtatttcacttaatatccagatgtttgggtattttctggttaactttttgttactggtttctaccttaaaaccactatggccagagaatatactctaaatgacttcaatccttgaaatttgttatggcacagaatattatcaattttagtaaatagtccttgtctgcttgaaaacaatttatattatgcggctggacctatatgtcaattagggccagtttgtaagttgtgttgttaaaatcatctatatccctaccgattttttgtctgcttactatataaatgactgaggagtatgtaagaaaactacatgtatgtaagaaaactcggctagattaaaaagcattttaaagggttttatgtgtatttttttgttttgagagttttgggttttatttgcttgtttgtaattgcaattgttgagaattgcagtgacctcctaacttaaatatgtgtatactattaattaataattatcagtagcattttatcttacataatataatttcaagcaaaacacttcatcttaaaacaagattttattttcattcagaaaaaataaaacgttgcaagttttcaatattttaaaaatatttatgaataggtattttatttttgtttgtacagttgtatttcactcaaatgtttattcctgttagggtggaatatatatttatacacaagcaaaataattaaaatacttatttaagtatcctcaaatagtagattgcaagtatgtgatttttctgattttaagagtaacataagccaggtggtggtggtgggtacctgtagttacagctacttgggaggctgaggtgggaggatcatttgagcttaggagtttgaggccaggccagcctggttgatgtagtgagacaccatctccaaaaaaaaaaaaaaaaaaaaaaaaaagagagagagagacagagacactctcattatagaaaatttagaaaattctgagaaatataaagaaaaaatcatttatcaaccagtgttaattaatgttaatatttgacatatttcttaatagtttttagcatttaaaaatgaaattatatactttatttatttaattttttttttttatatggagtcttgctctgtcgcccaggctggagtgcagtggtgctatctggcctcactgcaagctccacctcccgggttcacgccattctcctgcctcagcctcccaagtagctgggactacaggcgccccccaccatgcccagctaacgttttttgtataggattaatgagagggaggaggagggaagactgttttgactgaaggatctctctaaagaaacagcatttgagctgagctcagggcaaagcctctgagacagagaacttggtgcactcaagggagtggaaaaggccatgcctggttctgagagaggaggtgtagtctacagcgatcccaccgtaaatacacctctcatctgatcttgaaagctgagcagggtcgggcctcattagtacttggatgggagagagaggctcagcaagggtagagctagggaggcaggtacagaatttgcaacttcccacaggaaatgtaaagagtttgggtgttattctaagtgtaactgaaatagactgatagattcggagcaggacaatgatatactatatttcatctttctaaaaagatgcacattttttcacctttaatactggggcacttcctacagttgaagtgatttttaaaaagcagtgcaaaataggttaatttgtagagtttttttttttctttcttagtggttcagaaaataattttgttctttttaatgagtggagtcttctatttgatttaattcagtaatttatattttttaagtacagtgtttctgttttccaggttgctttttggcaatggggttagaggagcaggagaaaactcaggatatcttctaggatattgttataatagctcaggccacacatattggtagctcaggctagagcagtggcaacatgatggagagaaatgaatgactccaaaaatgctctggagatagagcctagtgctagattagaacatagagttgaacccgatgtaggacatggaggagaactgttgaagaggggtcataggtcctggctttagcaagttggtatttggtgacactatttgctgacatggtaaaaaaacgaagcaatttttttgtaaagatcaagagtgtgagttggttatattaaattagagttgcctgtgaaatatccatgtgggtgtgtcccatagggaattggatcaagttaattctaatgttcagaagagaagtctagtctggagataaaaactggaagtcatcagatctagaccgcatgtgaagccatcagaatggatgagaccaccaagagagatcatagaatgagaaaaaaagaaggtctaggactaagctctgagaaatgccaacatataggggtcaagtaaaagagaccctgtaggaggagtccagggagtaagaggaaacagaggatatggtactgtagaatccaagggaaaagagttcttcaaggagagagtggtcaaccgcattgaatacaactgagagctctactaagaggacaagaagaatcctttgggttttacaaaatggtgaccttatcaggtgctgtttcagtggaatcttgaattcaggagccactcaagaatgaatgagaactgatggagtaaacacagcatgcgtagataagtcaagaaccttggctgttaaaaaggagtaagaaatatggaatgatccaatagagagggaaagaaggtgatgcaggggcagaggccacatggacaagcgcagacagcacgtggcaaaggcctctatgccattacccatggaagaaaactgaagaggtttaagcagagaactatttgattggactgtttcattaggtaaattattctgtcattgtgggagatgaatttggggtctttaatgagtgtctgaaagcacaaaactcagtttggaagccattgcaggaattcgagtgaaagataatgtgtccttgaataaggctggagaggaaaggagagactggagatacaaccaaaagataaaatcagaagaatgtggtgactggatgtggagcagtaatcaaggatgactcccacatttttgggtaactaggatgatatatgtgatttttaggatggtttccaacaggatatctttaactgtagatggtgaatacctgttgtctacatagtggttgacaaaaatggagcagtgttgttttagtttctctggaatataggattgaggcttgtctgggtaatttttacagaataatttaagtaggctgggcatggtggctcatatctgtaatcccagcactggttggccgaggtgggaggatcacttgagccgaggagtttgagatcagcctgggcaacataatgagacctcatctctactaaaaattaaaaaaaaaaaaaaaaaatgccaggcatggcagcatacacctgtggtcccagctatttgagaggctgaggtaggaggattgcttgagcctaggaagttgaggctgcagtgagctgtggctcactgtgagagccatggcactctctctcacagtgagagcatggcactgctctctagtgtgggcaacagagtgagaccctgtctctaaaataaataagtaagtaagtaaattttttgaaagtagtacatctccatgctggggaaaaaaaaaaaaaaaagatgtctcattggccagccttcttttctagaaggtaattatgggaaagttgaatttcaaataatttgttacctatgtcatttcttattgcttatcttaggctgctagctttcaaaacagacttgtgaccatcaaggtccccgtgtttttttcctgcccttctctgtcaagggatagcatggtagtcagactcggcccagggatgtcgtctgctgtttctggcctattcccatctcctagaacaaagttattttccataacacatatgggctatattccccagccttgtcgatgttgccagacctcagtggaccttttttaaaaggatctttccatatcctattgtattgcctggaccatctcccaatccagtttttaatttcctattggctaaattttattttctttctttaggccttgtgctcatcttccgcttaatgctggcttccctcctgtgctgtgagagagaccttaatcgcttgtgggccagcagccatgccattttaaaattcttttgggcagctattcagctggtttaacatctttcactcccacttgttggctgagatttactctctcctagccggcttccattcctttcagaaaggagtgtgagggctgcatttccattgtaagccccttttctttggatctgttttcctaagattctggcaccaaatacttaaccaatctcagttggttaagaagttctgagctaaaatagtgggccattttcttcttatgaagagttccaggagcaccgatgctagacatggtcctgtctaagtcctgggacctcctgagacttgcaaccatgggtgcctgatgtgctttcttccaagggtctcctacaaaaatatcctcttcatggcccacagtagctctagtgtctagatttcaagtatgatgatatttcttgtattaaaggacagagatgcctaagtcttatttaaggacaagaagacttgataaaactggaagccagtaggtgatgagtcaaagagtaacagatggtgtgttctgacctccatcttcatagtgggcaaactccagtgtgctttttgggctcacagtttggttagttctcttcatcatctaggactaaccttttttaactatcatcatggtgacaggtaagagaatgtgatggctagaaccacagacagattcagaggattcttctgtgaccaggccctgttcctctgccagctctcccgctaactgactatgtaaccttgaggcaagtcacttcccctttctagccctcagttttccggttattaaaatgaagagattgaactggataatcttcaggtttccgttaagtcaaaatggaccatatgattcatctaaaaatgttctaagacaggaagcccgtttcttcacaactctcagtagctttggagattttcctatgaattatccattaccaaaaaatgacacccccattcccactatccacttctctggagcgtcctggcagcagacggaaagctcattagtgagctgcttcccctaatagatgagtacgttttgctcagaataaggaagaaggaagtcaacaaaataagagaaggagatgttaagaaactaagaagaagcactttcctaaaaatgtaaaaccaaaaactgaagaatatatctgaaaaaagagcaccaaatcattttactaatgaaatagacacaaatacccctttctttccaatatacatcattttcagaatatgtacagatacacatagacttttctgcatgtaatacaagacacctaatggaaccattgagatttgttgtgaatttttgtgttgagttcttaaaattaaaacgattttaattttttggttcttaaacaagatttacatgaccccaacctcttttagaaaaccctgccttctttccatacttgttatttatttcatagttcactttacataaatgagaaggtgacacaggtgtctggccttacacctttatttgagaattcgggagtgcatgggttcgagttctactctagtatgtagactccctgaatgcagtcagtaggtttttaaaaacttttggttcattgagaaaatgtcttaagtaaaaagcatctgggcaaggaaaatggatctgccaagtagatcaataaagaccctcaaaagcgtggatctattagtcattgacaacattgctactttttaaatgagccactggtagttcccgtcacccagaactatgttctatttttctttctgacatttatgtaattttttattgggaaattcacatcagggatcgattctccttggtttgcataattctttcttgactttatttccattgaaatatcaatatttatatctgccttcttcagtaaagtgtaaatagcaacacttgcgtgatgaatcagcaacttttataataccacacctgatttttctggattgacaattgacagttgatcactagacaaatcacgcctgtaatcactaacccattggatagtattaccaatgatatcatgcatggcccttacagatcactaagcaaaattgcttggtagttttaacagaatcacccttcattaagtgaaaacatatgatatttggatgattcaaaatatagtttcatcttccaaattcaactttagcaaaaaaggatgactttcacttgttcgtttagtcttgctgggacttctactctaatgtaataaattttcttaacatttagctttatttctctagaattactcgtatttgtagcagttcttttcattgtatgtatatacgggactaacaatggaaaaatatctcagagagctcacatcatcaaagaaaattctaatgaaataatgttttttcttgtagaggtcattaaagtgaaacaaatgtcctcttattaagctattacctcacctcattgttgaaaacatgaaactgctgagaattacattatatcatttttataaaatattagttgctgaagagctagtttccagcaggcattccacgttattttttcctattcattcaaatccaaaatattgctcatctaaactttctcggttaatcactgttacagtaagtctgagactgcaagacgcccagtaattcataaccagcttggggcttgttcaccttcaggtcaattatttggttcctgtgcacagtaacgagaaatcatcatctgctataattgcatagaattaataaaaaggaaagcaaggatgttccttcaggaatctggactgaaaagccaccaggtttctagtacataccttctctttctcctccttagctgtccttccactcattttagtagggaaataagttgctgatgaggttaagttaaaggttcctcaccctgagaaggagccctcgataagcacagcagtggcacaaaatgctctgggactggagaggagaggccctgagatctgcttgtggagtagttaaaggaggtgctgcagaggaggtgtctcttgggctgactcctgaagggccaagaggcatttctaagtaagtccaggggaaaggggtggcatggagattccagagacggaaggagtggcatggagattccagagacggaaggagtatgcaccaagtccatgaaaaattaaagaccgtaggttttcaaagacctctagtatgctaattgagccagagtgcaaattgggaaggaggttgtctggaaactgtggccagacatataggcaggaggcagatgaggaagggtgctccatgccctactaaggagtgtggttaccctttagccaagaggagattctgaacactctgagcaagggaatggtactggtgagtttgcattttgcagagagcacattggcagttttaggtggagaatggatagagggagggaggcaagactggagatgggaagatgacccaccaagagtatgagtatcaggaaagatagtaaagacggcatgacagggaaggacagagaataggagaaagtgaagggtgatattaagatttctggcttgggtgacagattggatttgctgatgaaggaaataggagaaatggagttgagatgaggaggggagtgataataaattcgtttattatgaatatatccaataggtattagataagtggttctaaaggacagaggtaaatttttgagagagactgggaaatcatcagtatgtaaatggtaattgaagtatttccgagtttctttccagcccttaaatcctgtggttcaatgaataacataaataatctctttgatgtacgcccatctcagaaagcctacctttagcagtggcctgtgttaagtgatttggtgacgcgatgcagttcctcctcaagttgtgatcagtaaatagtgatctcagcctcatgctgacattgaaaatcaatcagaacagatttattgagtgtcttttttgtgtttactgttgtaagggagattcattttttagactggaaataatttcattgatttgtcctttttttttttgagacggagtttcgctcttgttgcccagtctggagtgcaatggtgtgatctcggcccactgcaacctctgtctcccaggttcaagcaattctcctgcctcagcctcccaagtaactgggattacagtcatgcaccaccacacccggctaattttgtatttttagtagagacggggtttctccaagttggtcaggctggtcttgaactcccgacctcaggtgatctgcctgtctcggcctcccaaagtgctgggattacaggcatgagccaccgcgccgggcttcattgattttttaattcaagtcaccaaggtcaggaaatggagtttagtaggaagacagtgaatacagttttaggcttgataagtttaagttcatggcagaagatccaatggaaatgattaagaaatgtgcttgcaccccatctctactaaaaatacaaaaaaattagccaggcgtggtggcgagcgcctgtagtcccagctactcaggagactgaggcaggagaatgacgtgaacccaataggtggagtttgcagtgagcagagatcgcgcccctgcactccagcctgggcgacagagcgagactctgtctcaaaaaaaaaaaaaaaaaaaaaaagtgctccgtagaagaatcttggctggagaggaggatgggggatttatcccaaggagcatggtcactgaaactgggagagtgtgggaagggtggaggagaggagtgctgagcacacagcagatttcaggcagggcgggagccttggcagacacccactttcaggctgccaaagggcaaggacaagctcaaggcagaacaagaagaatattccgtcactgaacgtgggaagagagtgttcaaggagtgggcattcagccagactcggaggtcaggggtgactgaccggaagatgatcatgagatttagtgatgagctggtcactggtgctttttctcataggagtctcagtggcataaagagttaggaagtaagattctaggtcattgaggaggaggaggaggaggaagaggaatagtagtaataataataaagttgacatgtactatattggatgtctccctacgatacatgccaggcagtcttcaaagcactttgtacgtgttattttgtttaatgctcacagtaattgtaggaacttaccaatgttattaatattattcatattgatactattatttccatttacagatagactgtaataggaaataaagacaatgagtatagacaatcctttgtgacattttgcagtgatacaaaaagtttaattccccccaaactaaattctgtcaagtgaaattgaacttgtcattttctttagcatttgttgtctgatttcattatttgaacataaaagtacaatcttcacatatatttggatgctgttacattttcttaattgtttctccaaatcttacattttggcgtgactgttaagtccagggcagagagagcagagtaccaggcgtggctggtgtgagatgtggcagtgcccaaggagaagaaaagcacaatgggcgatgatatgatcaggtgaaaactattttcaagcaattttaacatttttgaaggcagtgagggtaggatccaggggaggaataactgaagatgttggagaaggatgagcaggtgggaccttgaggcagagactggtcagggcgggagaaggagccccacccagaaaggagaagggatgtaggttttttgtttgtttgttttgagttgagaaaataagtttaaaagagaaaatgcggccaggtgcggtggctcaagcctgtaatcccagcactttggaaggccgaggcgggcagatcacgaggtcaggagattgagaccatcctggctaacatggtgaaacaccgtctctactaaaaatacaaaaaattagccaggcgtggtggcgagtgcctgtagtcccagctactcaggaggctgaggcaggagaatggcttgaacctgggaggtggagcttgcagtgagccgagattgcgccactgcactccagcctgggcgacagagtgagactccgtctcactcaaaaaaaaaaaaaatatatatatatatatatgtatatttatatataaaaataataaaagagaaaatgctcaattttattaatagtaactctccccaaactaaactctgtcaagtgaacttgaacttgtcattttctttaacagttgttacctgatttcattatttgaacataaaagtgcaatcttcttcacatatatttggatgctgtcattaacattttcttaattgtttctccaaaaacttgcatgtggcatgactgttaaatccaggggcagagagagcagagtaccaggtgatgggtggtatagatgtggcagtgcccaaggagaacgggaaggaaagaacggagaaggaaattagtaaccgtaagaataaagaagaattctatctaaaagtctgttgtaactttgcaattgaggcatcacttttataagaacatttttattaatgagaaaaaaaggcagaagatcactctcatcacgtttatggagaacaaaatgaattggcaagtcagccaatcagctggagcagcctggacggttaggaccttgaatggctgtaaattggtggcatcaaatcttttcttttggcactgggactgactggctaccctgctgacttcatcagactctctcttgacttcctgaggatgttgtgtagtctggatcaaggttatccacaaggttaagtaaactattgctcatttccacctgtaactatcagatgcaaatactattagcatttactgcaactaaaacaagtgacaatattttcacatgttttctctgtaggaatataaggtcccttggaaataaagagtcgagaacgtttaggtaatactgggcgtggcacttgcagccatcatttcagtctaaaaacatttcctaaggaaaagtactaaatgtttttttcatagaacccaacattttggctgttaaaccattttcatcaaaacattttatttatatgtaaaatattttaaaagctgttttctgtgtaaacatgttcatctcatcatcacacactaatcaggatgtgttgagtgcctctgtttatccattaatatctggtgtttgtcagcctgtgtttgttttgtgtctgatgttccatgtcttttttgcagatattgatgaatgtgtaaacaacactgtttgtgacagtcacgggttttgtgacaatacagctggctccttccgctgcctctgttatcagggctttcaagccccacaggatgggcaagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaattttaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactcccttcagcacaggaaatagagtctggtgtgtggtatagattgtctgtctttgaaatgcatccccttagacagtgcgtttaaggcaaagtattgccaggagcttcagtgtccaggaatgatacctgtaaaaggatgctttgaattgtgcaactgtatttcctcagtctgttccgggattgacagggctggaaggaatcttgaatatcatcatatgtcctggaatatggtccaacaaatgctcacacagaaaataatttgtatttcattgtctgaccaagatgtgatttcttcacgtcaaactcattatgaaacatatttgcaattagagcaattaaatgggaaagagaagaaaggttatcaaattcaagactttatagatagcaagacttttctttttctttattcttagagaaaaatagccatgttcactacatggcaggtggaacttgaggagtctattgcctatttggtttgaaaatttgcaattaagacattagttcatttgccatccatattaaacttggaaaacaagatttttaaggtttaatgataatgtcacttaataactgcttttgtggaattatgaaattcagttaattctcaaccaaaaattatttacaaagcaatggtgtggtttcatgcataagcagtagctagtcaaaaacatagataattattcaagaattattcacaacaagacatagttatttaataatatagctaagactatcctaatcttagttcaaactcctgctttggccacctttccaccaaaatacagttgtttgacgtttggataatattttcaccagttgggtcttgtgatgtggcccctacttttcatcttaactttaccacttccttcttcacctgttgtttccagcaacgtcagactggttgtggttgcccatgtcactgtgcaattatttgactgttgttcactccttctgctgggaatatcctcctgacctctccttccctgagccctggatttttctcactcgttcttgaagactgaggttcagtgtcatcttccagacaccatccctgctccattcctcactctcaagctgagctgtgacctctgcttccagagcaccttcagcaaattctattatagcacttacaacctttgggggaataatttaataatgggtataccacctgcagaccgcttctgcaaggctatgacctctatatgattgaaaactttctcacttctccctgggcagggcacgatgcttggcttattataggtgctcagtaaattttgtttaactaccaactgtttaaatatcagatgttgaaccatacctggaaaccatgtcagctatctggagtccacatagctccagagcccctgcttaatgttcatttctaaccagccagatgagcacaccaaacccatgctgacatttcagcttggcacacaaaacaccacccttagagaaggaatatttgttatcattttggtgaactcaacaaatgccattttatttgtgtttgtatttattatttcaaaaatatttactaagcacctatgatacgcacttcacactgggtgttctgtagagctacagggatgagtgagcacctgccccattatcacctactcatccttcagctatttgctccagtatcatttctctaacccacccccacatttaaggtctgctgttccatgctttcactgagctctgaacttttcactcctcacactcactgaagcatgtacaattattttgttcatttccctaactcgtctgtaagctccatgaaggcaggagttgggactgctggctcatcattgttaccccacatataggccgtacaggcctgccccacagaagtaagctaggaaatatttcttgattgaattattgcagtctgatgggatagagtttattagccatgtcaataatacatgttggaaagtacaaagttccactggacatttacctaaaattgatcaatgtgaactggcaatttcttaagtttttctggtctcaatatgactgtcggttgattaaatatttcaactctgctttatgttatggtatttttcacaagtgaaaccagttcattggatttatatctctttatatataaatgaaatggaaaactgaggtaattatccaaataagtcaagatgtataagctttttgtccaattaactgggtataccaggtgaaaggacgatttttttttttctggaatgatttagataattgctcaaatttttaactttgattaagccatctcaaagtatgctcatgaaagctgatgtttatacacgtttaatgcataagacatgtgagcatttcagactttaagtcaggtgctttactgaattggatacccatgaataaaatattgcaggaggaaagagggtaaaaagcactatgggacaacatcaaacataaaattagcctttctttagggctgtgtacttgcaaaatgttgaataaagtgtacttgtcactgagattccttcactgtattttaattatgtatatttaagtacagaagaaaaacatttagcaaaatagaaattacacagtggaacatcaacagaatttgaaaaggtgtcatgagatcagtgattagttattggaccaatttgtttcacatgaatgattaatgtagcctgatgagtatctataggagtctttccttcatttctcaaaggaatatgtaatctgaattctattgataattatggatgctttggctaccagagaactgtattttcagatatttaagtatattttaaaagtttttaagtgaacttaattctgtggttactgaagtgtcagtgattctaactttgcttgaattaagaactgagagtaggccaggcgtggtggctcacgtctgtaatcccagcactttgggaggccgaggcaggcggatcacttgaggtcaggagttcatgaccatcctggccaacatggtgaaatcctgtctctactaaaaatacaaaaattagccatgcatggtggtacgtgcctataatcccagctactcaggaggctgagtcaggagaatcacttgaacccgggagacagaggttgcgagtgagctgagatcacggcactgcactccagcctgggtgacagaatgagacgccgtctcaaaaaaaaaaaagaactgagagtagagtgttgcgtcatttaagacttcattatgttgaaaagtcaggaatgataaaactagatggtcagtgggcacatactagttttgcagtacaattccagagtatcttttaaaactagattgggaattggctgggcgcagtggctcgcgcctgtaatcccagcacttttggaggccgaggtgggcggatcacgaggtcaggagatcgagaccatcctgcctaacacggtggaaccccgttgctacttaaaatacaaaacaaattagcggggcgtggtggcaggcacctgtggtcccagctattcaggaggctgaggcaggagaatggcgtgaacccgggaggcagagcttgcagtgagccgagatcgcgcctctgcactccagcctgggcgacagagcgagactccgtctcaaaaaaaaaaaaaaaaaaaaaaaacctaaattcggaattgtcttgaattttcatagtcctttcgtacagaccaaatctgacagctctaccttaaagagccccttccctaaaagagcagaaggggtttgactgctctctggggatcgccttcttttcagcaagacactattagccctggcacagctggtaaaatagagagctgtcgtgaatgaggcacacatctcacttggtctgtgctcccttttccagatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacaggtaagtcccagtgacactgtgcaagggaatgacaggctcctctcaaagacctgcacccacacagctttgggataaacgctgggagtgagataagaagcagccagatgtcctgacacagtgctgtctctggaagcttccatgatcttctgtgcctgccttgtcagtggaattaagatgtgggtgatgactctttgggctagatggcctctaatgttctatccaaaccagagatgcctccagtaaggtaaaggatccaaaatgatgaggacatttgctggggattgcttaaaacttagagagctatcagctcaggatttaatatggcaccatctcattaagttgcataatcctccatacgttcttggcccttagagaaatgtgtcttgacacttctctaaattaaaagcaacatataggcctcttaggatctacaaagacttccacttggaattcttaaggtgtttttccagaatttggcctagagagtagctatgtttgcattcgcttaaaatttgatttaggctgtgtcgtcactgtgcaaactgaaatagagagttggactgttttccagataaattaatcaacttcccaatcacccttttaagtttgtgccatgtagctatagcttggttgtattttagggaaagcaaaggcccaaatggtcctttgagagccaagtaaaatgaaacatagaccatttttttttctttctcagtcagttttatccatgcttccataatagctttcactactcctctggaggatacacttgttctgtgtaaaatagctatctttgcaagtaataggaaatgaaatatgaaaatattttcacccacacatatttcctcagttattaaatatagaaaggtgaagggtatagaattaaatgaacaggctataattcaaaaaccttgtgaaagagaagagacaggttattactggtgggaggatttctcttcattcaagtgaccaccacaacaatacatattccataaagaagagacttttcattttaattggatctacaatagcaaaaaacaaaccaaaaaacaaaaaaatctggttggccactaacagaattggttaactaagtgtctttttcttatttttgtttggttccatagggtagcacctcacctatagtgttattttgaatgaattaattcatatatcataatatatagccattaaatggtctgggtgatgcttagatagtcatgataaagataaatgtatgtgatacaatgttaagtgaaaaaatacaggatattccaatgatcacactctgtagaggaagggagagtgagaatacataaaaaggtaattgttggaccgaaccaataactaattgagcttattcatttgtatagctcctggcagcttttccttttatcatgcctcaatttgtatagttgatggtgaactttgattatatggagtcttaagactgtcttatgacagtcttcatttttaaaaaattttctagcagtatcctgagagactgagtttagccataaacttcagcagaagccttctgtctgatttcatcagagtcaataattgatcagttatttgaaaaaggtgattaaaaactagaaatcataaaaaggtaacatcttctaaatttaatttttaactcaaaggatataagtacatttggccaggtgcagtggctcacgcctgtaatcccaacactttgggaggccgaggcaggcagatcactgaggccaggagttctagaccagcctggccaacaaggtgaaaccctgtctctactaaaaatagaaaaattagccgggagtggaggcatatgcttgtaatcagtaaggcagaggcatgggaatcgcttgaacacatgaggcaaggttgcagtgagctaagatcacaccactgcactccagcctgagcaacagagccagattctgtctcaaaagaaaaaaaaaaaaagtacattcatacaccaatctttgaagagaaaggctgtggtctttttttgtgtagaggttcatttgtggagtttgtgtggctatcctgcataaaccccatctgttatgtattacttacactttctttgtagaagggagtgagaatctaaagcctttttcaaaacaaatgaatgtaaaatccctctaaatttttacagtttttctcaattttttacacttgtccacacctaatttgacagcatttcttttactgaatcaactttatctaatctttctaaagctttaacttgccctagaaacagctcttctggttacattcatattgtactggttgatgtaatatttaattaaattatgtaagtacagtaatcaatacactgacacagaatgtttgagtgtatacctaggtgagtcttggtttgtgtactgcacagcctgtaggagcagaagtgtgtggacctctgcaagaatagccgtctggctctgagcattctcccttccatgagcatcagcagtgatattttacagagggcaagaaaacatcagttaacacaagttggttaaatgtaggccagttaagagagtttgtaccctgtccagtaaaagaatctgctattccacagaccaaaacattttaaaccaaatttaaataaaagtttttagactaggattcaaattaatttcattatatgcataatatactgaagctgagagctcatccgtcctgaaaagtacttaggaagggaaagataaatttccagtataggctatcacatttttattcagctataaaactcccccaggacaatctatattccaacaatgagcagtagcatgataatctgatgtggtatcatactgaaggcagaactagggttatggggtaggatattaggaaggcaggtttcaggtcagtatccagaagagctttccagtaactaacaagagctagtcagcaaaaagctgccccagaaaatactggagtgcttcccgcggaggcatccaagaacaggtgggatacccactggcagaagagcacccacttccagcagggtattgccccagatgaacctttaaggtactttggaactctaatgtcctagggtttttatttctaaactttcttgcttcccacatatatattttttaggtctgccttaatgttttttactgcctgggcctttggccactaatttacattgctgtgcattgcctaaaagcatctgaaaaagaagtaactaaaaaatgtccataccaggccactcatcacatttaagaaggtatggatatgaaatatagtctgatgctattatttccttagtgcctgtgataattgctcaataaaaactttatgtctttgggcactctaagggaagcagtaaatatttaatcttggcaactgcagccttcagaccttacccacaaaatgctgttcttttccttgattggtgtacagaggaaattctgtggtaggaactgcatcttattcttaaaacagaaggtataatgaaaagaatacaatgaaaaatatatatatattataatccatacaggtattctccactttaagacaagcaaacaaaatcaggaagtataaagcatataggttggggtggttagttatattataaagtaattcttcactttactcaataatttatcataggatttctttaaatatcagttttcgctaatacagttcgctaatacatcttattcccacatcatgagctatatcctagacttctgcatttagaaaccaccttagtgattttccagctcaacttttttatttataggtaaagacactgaggcccagagaaacatctgaaatgtcattcttaaggttatatagctaatgaatggcagaattggtccaggaacccaactcaggatcttctcacttcaccatttctaattttagggctgaggacaacaagacatcaaattcttctcaaaattggcttttctcattttgtttttcattattaagataatacacattaatcatagaaaattggcaaatacaaaggtaaatttttaaaaagtctcctgcagtatcaccatccaatatctgtcaccatgttgacctctggactctgaaaggacatccatattcccctgtctcaacagaaccgttttccatttgaccttcagtgcactgaaatcaggccctctgacttttcatctaagtgagccgtcagtgagcttctatatggtaaactccttagtctcatcccagagtcgtcttctgaaacatttgacagtggtttttcatcttttcccccgtctttgccctgtgattgatttcatgacattactgttccctgcatcctcctgcatcttggactagtcttttcctgtctcattctcaggttcttcttctcctgtccattccttaaataataacatcccaggcagttacatgcttagctgtcaaattatttatgttattcccctgggatatttcatctgctttggagtcaaccattacttatatgacattgcctgctaagtaaatatcttctgcccccacctctgttgtgagtgtcatgctcctatttccagctgcctattggactttttcttccagggtgtcttgtaagcctctctggctgacagttattcaaacctaaattaatcaccatttcctctccttgtgtctatttatttatttatttatttttatttttgagatggagtcttgctctgtcacccaggctggagtgcagtggcgtgatcttggctcactgcaacctctacctcccgagttcaagtgattctcctgcctcagcctcctgggtagctgggattataggagcataccaccacgcccggctaatttttgtatttttagtagagacgggatttcaccatgttggtcaggctgatctcgaactcctgaccttgtgatccacctgcctcggccttccaaagtgctgcaattacaggcatgagccactgcacccaactctgtctatttattaattgctagacatcgatactagaaattctgaagtcatacttttttttgtctccccattcgtcatccaagcagtccatcataatatcctgccagttctacctccagggtgtccttcaaatctctccctgttgcggatgctacttccctgggtcagtctttcagcatcacttacctggatcattgcagtagcctcctaccttctctcctcgcctctctcatcaattcctgctccacactgctgccagagttaatgttttcaaaacatagatatcggtttaaatcgttcagtctttcaactgcttaccactgctttatagcatgaagtccaaatgcattagcagggcagcaataccctttatcttctgtaatgtaaatggattgtttagctttccgtcctacactcctcatacctacatccaagcccatgccctgctcatggttaccccaaacaattacgctttcccaagatgatgactttgccactactaactctttctgcctactgtgccctcccccttgtaagcccttcttttttttttttttttttttttttttgagacagagtcttgctccattgcgcaggctggagtgcagtggtgtgatcttggctcatcacaacctccaccttctgagttcaagtgattcttgtgcctctgcctccctagtagctaggattacaggcctgtgccaccatgcccacctaatttttgtatttttagtagagacagggttttgccatgttgaccagcctggtcttgaactactgacctcaagtgatctgcctgccttgtccttccaaagttctgggattacaggcgtgagccactgtgcccgtcttcttgttggcctttcctgaaatatctctcaagcctttttaaaagtctgcttgactgtcaccgagttgtcacacattccccaaatccccaagatggaattacaggattctgcctctctgctctcaacacgccttgcttttgtggctaacagtctctgcgtcttattctctctgcatccactgcaaaacagctcactgctgagcacggcgcctgatggatggtagacactcggtaactgttgaataaattgcctctccacattagaagcacatgtccctttcataacccatccctcccattcctagctacttctacagaataaaaataatttttcatttttttaaagatttaataggggcacacttaagtggggaaatgtctattcacacttccgtgtaggaagtgctgcttcagattgcttgagttaaattagaagaggttaaattaaaagaaaaaaagaacatctccccactgtcaaggaacacagaatacaactcatcttggtagttctgacaattgaactcaaatagcatccctgttcccttcctagagaggtacactacaggttttgtgcatgtacgcctttttttttttttttttgagactgagtctctctctgtcacccaggctggagtgcagtggcaccatcttgactcactgcaagctctgcctcccaggttcacaccattctcctgcctcagcctcccgagtagctgggactacaggctcccgccaccatgccctgctaattttgtttttgtatttttagtagagacggggtttcaccatgttagccaggatggtctcgatctcctgacctcgtgatcctcccacctcagcctcccaaagtgctgggattacaggagtgagccaccgcgctcggccgtgcatgtacacattttttaaaggcaggaagccacatgtgacaatcagtcaactgttatatttggcagagtctgttttttaaaatgtgtttagttaacctgttaaataaatttaacattgaaagacttataaaaattatttctgattggaaaaacaaggacttttggtaggaaaaaaatattaaagaaagtaagaccacagtatttataatgcaaatattgtaaaaggccataaacctcctgaggtcgtattgtgtttttgtaatgaatctataccatatatgtaggtaaggctgaggaaaatacgttcatttgtttaaaaaaaaaatatctagtcaagtttcttcccacatccagcgatgcctcatgagaaggtatcatctttttggtatacaagacctactgcttttttaacattatctgcttgctatagatagtacctaaagtcatatctgagtttctgaaaagagatgtcagtgttttaatgaactgacatatcaatcaaagtgacaaactaaaactatacacacacacacacacacacacacacacacacacacacacacaccattgtatcttcatttatttttatttttttgagacaggatctcgctctgttgcccaggctggagtgtagtgtacgatcatggttcactgcagccttgacctgctgggcttaagtgatcctcccacctcagcctcctgagtagctaggattacaggcccacgccaccatgcacagctcgtttttaaaatttttttgtaggacgaggtctcactatgttgccgaggctggtctcgttttatcttcttaatactacaagatatactcacactgttgcattagaaatgcattttggatcctagaacttgctataaactaaacctgacgaggaatggtttgtacatttccttttaaacgtttccatacactttgtgtgtcactttggatgtgctttactcatgcatttatcctcgcaggccctcatgacgcccgagtgtcaggaatgttatgggtttgtgttgtgtgtcatctgcttgttcccccatctccatatgtgcttcctattctgactcatctcagtgtactattctctcgtttttctttctctgcagtacagctatcccttggtatttaagggggcttagttccagggcccccactgataccaaaatccacagatgctcaagtccctgatacaacacggcgtagtatttacatataacgtatgcacatcctcctgtatacattgaatcatctctagatgactcataatacataatactatataaatgacatgtaaattgttacactatactgttgttttatttgtattatttgtttttgtatgttttttattttttcaaatatttttgatctgcaattgattgaattcacagatgtgaatcccatggatacagagggctgggcccactgtactttatttggcttccaggagccccttcattcatccatttctgctcatttttcttccccctgcttttccactctagagtaatatccccgactttttcttctcctcaccctctcactgtcccaggctcattttctccaatctcttgtaatgccttcactagatgtcagctccaccaggcagccttccctgatagccttgtctacccatccctctgcagtgaggcctaggtgtgcgtgtgtgtcctgggagtgaagcctccagttcactccttaagacctctttaagagcaagaactatgtggagagatcctcttttaaagtgtttttatttttgtgcttttttttttctaaacttcactttgactgctttggcatgttttaccatctgaagttatccactttctgttaccgaacaccaggggtttggtctaggttctgcagctcactgcacagaaaaccaatcaccgagaccacaagtatttccaaggaagaaggctttaattgggtgctacagccaaggagatggtagctcagtctcagatccatctccctgatggactaaaactaggggtttatgtaacagggaagaaatgtaacaatgtgtaagaaaacaggagcaagggagggacagggaagcaatcgtgatgaatcaggggtcagcatctggttgtcaggatgtggtgatctggtgagtttcagttctttgatactttctttgagaggcctgaaagtcatttcctgagaaaggaactcagataaaacagatgttaagtttcaagctttaagatcagaaatgtctgccgggcgaggtgactcacgcctgtaatcccagcactttgggaggccgaggtgggtggatcacgaggtcaggagatcaagaccatcctggctaacatggtgaaaccctgtctctactaaaaatacaaaaaattcgccgggcatggtggcaggcgcctgtagtcccagctattcaggaggctgaggcaggagaatggtgtgaacccggatccactgcactccagcctgggcaacagagtgagtctgtctcaaaaaacaaaaaacaaaaaaccacatttctcattttccgagttcttgtgtgagaaaactcgaaacaaggcatatgaatttctaagttttccttgacatctccttgaaatattacagaattctttctcattaaaacattaatgcctgtagcatttttaaaataaaaaaggaaataaagtgtcctgggtaattctgctgaaagtaatttactgaacatcatcacacacacagagttttatccattgatctcttttcaggactataggcagcgtttctttgggggtaactatttactcatgtgtattagcagtgttactcttgggtcattgtaataattctgactgttaggaaaaggtacagagaagattagctcataaaaaccttcagaacacattgtaaatggaaagggagagcccatttaaaaagctcatgtccactttgaccaactacatgttgtagattttctcaccccaacagtaattcctaagattagacatgtatggggaaacactaaagatggaaacggccctacaagcaaatggcccacaccctctttaggctgatgaaccaagagagaaggagctcccagacagggcttggtataggtggtgccttcagctcaaacctactccttcctattcagagccaggggacatgattgcactatttgtggccttgttgctgaacccccagcagcagagattatctgcggccctcttcccatttatctcaaagatgaaaaaacacagagaataaagggcaaagcagaacaaacccatgctatgtgagataagaacctgagctccaaagaagggttttggggaaagtagtagacataggccacttggaaccgacattagttttctcttccgggaagtgaggatgctgtatttaccagcaccttctatctcatatagttaccctctggatcacatgaaaaggcctctgtaaaagttcctacagaaaaaaacatagaaaatgtccaaaaccgaactttcttgttgttaccggccacacctctagaataaaatatgaaaaacttgatctttttatgcaaatgtgaagccagcctcttcatgcaaattgaaaacttaatctgaaaatactgaaggaggagtaatatattttttagaagtctgtggcatgagatatgtagtacagctaatcttactcaaaatatctttaagaaaaagagtattcattttttagtgcttgccactttctatagctattgatttgaccttttaaaattagtttccaatatagaaaccctccacccctggcagcaatgaactaaactcatgtaggagtttctttaagaaattacattatcacatatttactgaccagagttttatcccaatagaaaaatgctctaggaagttaattacttaaagactaggaagatagggaaattgtagcttttcccagaatgacctttgtggactagtttttagaaaataatttgcatttctttccaaacagggtaagtcaagatgagggcttgactaaccctcagtttcagctgtataaacattgaactttcaaatgtcttagaaaataagaccaaaacttataacaaccagtgtaaaaaataattatagttacattattgattatttcccttatgggaaataatctctttctccaaaaaggcaaagattgttttatttcttagtttgtatgatgtgagtgtaacaaacattttagtaaacaaaacaatgtttaccatatatgtatttgtctatatatatgtgtgtgtgtttaaaatgcataaaattatatttaaatatatttcaaattttaaatttatatatatttataattttgacatgctttggactcgagaagcctatagtttctaattacctgtgagtataatcttcattgaggccttattacaaagtattccgttttgtaataaacaccatgacatacttacaactttgtacatgagggaaaaaaatctgaggcttcttttagcacaaaccatagaataaacccgattaccaaaaccctgttgcttttttgatttgtatttctcactattatttattaatagctagctacatttttggaccagctgaataaaataattgagcggaactggtagtagtaacaggctgacaatttattcaccatgttgagggagagattctaaaattttctatagggctcataattgatttaataacaatttaaaatacgtactcttagttttcctaagtaattccatgtctaagagcttggaggcccttctaacgaagatccgttccgttaagagtacgcaaagtgaatttcagtcctctgcacacttgaagcaagctagaccagatgagggaagtggcaggttttacccaatttcacacacaaggaaatgatttaaaaccacttcgtaaactgctgcatagaaatcagcatttgagtttttcctggacgcttgttctaggtttgcatttgtcatcagctattaatgctgacttacagtccaagctgaaatctgtcaaagacaaaataatcagagaattggccagaatcaactggatgagggatctttatattctcactgatgctctgtgttctgagaggagtatatatttcagaggtttgtttgctgctttgcttgcttttaatgccagaagaggaaagagaaagggcagtagcttttcggatagaattttatgagtttatattttagaaacacgtttactatttaatatattaataaaatttccattgtcaactaggccctgcaaaaataaacatataggaagctattgtaaaaataatttatttaatttccttgctaatataattatctactaacttcaaaacaaaggtaagtgtaagtatgtgtggacattaaactcttatcctcatcagtaaatgtcttccttttgaccttagagtttgagtcccaagaatctggaaatagtagagttctagtggcaatatttcattagaattaatctaagtaattattatgacagtagtcagcttcttatttgatgtggcattaaataaaaacagttaatacattcaaactggatcataggcagtaatttgaactccatagtatacaggagagaagggatgtgactactttccaagtctagtcacaaaatagtgatcattttttaaaagcacagacttgttcaaagatttcgtatctgattgaattcaatcaatttcattattatctgaaagtgggtggattttgttcttattgtttgtattctttcatatcgccttgttcgtgttttatcacacagagggttaagctgaatctgttagaatatgttttcctctaggacacagttgagctgggactagaacccagatttgaaattctaccctgaggcttagctggcactcattatgtcattcagtcatatatttgcaacaatttaagtagttagatttttcagtgatgaaaggttatttaataggctgcaggttacgacagtattttcctagttatcttctgtgcagtcttcagaaaagattgggagcatggttgattccaataactacctaagggttaaatattatgtgtgggctcagacccgtggtcaagtatttgggaaaatttttattgatttaagtaggtgttatagctcagtaacaaatggccctatgtttggcaagaaaaggagatatggaaactctactcacagccaaatctgcaagaataaaataattggttcacgtaaaaggaaatggttttgacagatttacactcttggggtatgttagaattccaccaaaactaaggattcaagtgcatttttatctcaaagtggaagaatctgacactgaaagtggaaagcattttctataaagcaaatgctattgacacggtcactctttcccccattgcattctctacttgttgtcttaggtagttctgatgtgtcctattgtcactctactttctctactccatttagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactggtaagaatccgcttagtggtagagtcacacttgtgtttggtcacatggtgtccctgggccttgaaatgataacactcattcccacagccaactcaaggcgacttaccttatagtgagtttcattcagggctagagccagcacctgcatcccatcttaatatgaatccttgaacttctcttcatcatcgtgtactttgacagtcaggttctttgtgatattttggcagaaagttaattcagttttattccactttaaaattaaaatcagtctttgttgctgacaatgatacagcattattcgtaactaaagcttgtgtattgaagctatgattttgtgtaattgattcttactaaacctttaagatactatacatcacagtagtggaaaaataatagttataatttcaagtaaagcatgagtaagaaaatattagtgaacttggaggttttttaaattaaaaagtgtaagaaaacctatgaagtcattagatttctttgcacttaatccatcattttttgagattgtactaaatttatttgctggaattgccttaaagttactgagtctgagaaagcaaaactgaatttgaaacatgcattcatggaagatgttgaatctttttttttttttttgtctcttctaaaatcagctgagttcactgaaatgtgtcccaaagggaaaggttttgtgcctgctggagaatcatcttctgaagctggtggtgagaactataaaggtcagaatcaagtggaaacaaattttcagcacattgtgtacatgtcagatattcaagtgaaaacatggcttgggtttcacagaattagagttctttttagtcatgaaaactgattacaaagtccttaattctaccattaaaagaaagtccccatggacttgcagtcagaacacaaactgtatgatgctcggagtttgacattgggaggtgaacttctgagtttctgtctcttcatccctgagataggaataatttctcaaaggttataatgattaagatatatatctgaaagtacttaacaaattctgtacctagtagatacttactaaatattttattctagatgcttaatagaaatcatatcaattatgatcatataaatttgaccactgtttgtctttatggtcatcaacaaagctaaggttcttgtatttttagactttatcctactgttgtggggccttttaccagtgtgcacaagttcataatgagaaatggaagagaagacaaccaaagtagacatgttttatgtatttgatgctacggttatataattctaaaataaatgtgcggccttttaattttggtgaatatccacatgtatgaatatttcctcattaaccactcacttttgacattttcatgatagagatattaccttttatatacaaagtgattttttttcctttatagtttaatactgaggactgctaagtagctgggaaacacactgtaaaatcatttttattgtccatttttggaaaactagtgtttgaataatatggtataattcagtagctggataagaaattccatttgtgttcttttaaatacatctatgatttggtccaattaaataatgagaagatttggtttataatatgtgttgaatggtttccaaattcacaaatatacattactatgtttttgcagggatgtagttaaatctcacttcatattaaggtacagagctttgatttcaccataaattcatcttctcttttatatcaaaataaattccttgtcttcctattttagcagtgctgtaaatggttggaagaagattggattcagatccaaccagccatatgttctaggcttgactttgccattttccatctgtgttaactttaagcaagtcatctatggagtcttcaggttgtaaaatgaggactagatgaccttagctctaaaatgctagaactaatgctaataatagcagtaaaagcaatagataacacttttgagtatctgcttatgccagagcatataccgagtcctatccatggattatctcatttcatccttcctctcttattaggtagatgttcctattgtctccaatttatcattgagtaaactgagatagcaaaagctattaattctgtgggggaatgggtctgctaaccccctcagcaacttgtgctttcttttatcctcaagaaagacttgcattcaagttccaccaaactttattggaaactttctacatctcaactagtgaatgggccagaatatacattacagaacacatttcttaaaaggtatatatccttttgttgatgccactatggaaccatagaccatttcatcaaatatgaggtagcatctcagaaaccatatttacaaatacacttctcctataatgttttgggcattgcttctcaaatatcacagacaaactacatctgtttatgtttttatgcctgccaattaggccttattttaagaaggttatattgctgtttgtgtaggattctttggaatgtaaatattataatatctaacttaaagccccaaatctggttagactctttttaattgaaagatcaaacctaactcctttttgtatttctcaatttttttccccgtagatgcagatgaatgcctactttttggacaagaaatctgcaaaaatggtttctgtttgaacactcggcctgggtatgaatgctactgtaagcaaggggacgtactatgatcctgtgaaactgcagtgctttggtaagctttagggggatatagtatggtgtactgtgaaaatatacagatggaaaaaataactatgctatgtagtaaaaacaatttccttgaatctaaatcatgtgttgaaaagatgtgtaaacgttttagggatctttttcttaagcacaattgaagaaaataaaaagaaaaaaccacctccatactactgtttgaatgtatttcaaacaaagagttaatattcactgtggaattatgattcaggccactggtataactgaagtgttcttttggtctgtggaacatcctgtttcatcactcataccgtgcaagtgacagccattttaaatactgacccagactttaatgcttaagcagaaaaccatatacactaggcagaaaaacatagcaaaaggaaataattttaaaagttatcataaagagccatttaatcttaaatttctaagcatatcctgttcatggatgttttctttccttatttaatgtcagcagcagcagcagcaatgttgtttttcagtcagagcagcttacatttttatagacagagccactctcttttggatgataatgtgtggttaattaaaatttggcagcacctggaatctggactaaatatagcaatgtgtaaagtttgggaagtgtatgaggtacaactgatggctgattttctttagtaatacttttttttgctcttaagatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacggtatgtttccaggagatgcaaacctgtgtccaaataactatcataagattttccttttaactaaaatgtgaactattggaaaatagaaaaatggattccttgggtattttgaaataactaaaatgagatacaatgagatacttacagaaatagtaataagatgcatatcatcagtatgtaggagatttaatagcctggacatactcattaagtatggactatggagtggctgagcagatggcagggttgttccatggcttagggttcatcatccctaacctgcagaggcagctgagggaaatgtaattcagggaaagataattaggtgcactcagcagagtggaggatgtggataaggctcagcagaacagagggtggagttcaacagggtggtggagagccccgaagtccactgacaaactcctgtcctccctgatgctactgataattggcaaaaagccgctgataattggcataatctgtcattcgcctcaggagactgctttggatgaagtcaattgaaaggtaggaattaaagactctaggatgaagggtcactagtccagggctttggcagattaaatggataagaaggcatgaatccaatagctgttacatggaaagaaatggtagggtttgacaggagtaaatgaaaaagtgaagattaggagagtgagaagcctgatggcttatgaaggacaagcaagatagtgggcattttatataaaagtaggaagctatagagaactattgtgtcgggaccggatgggcagctggaatttcaactgatggaatgacacccagttggagatgacagagaattgatccattgaaagaccagactggattcagacttttacttggaagtcactcttagaaatagagatggaaactttgagacttgctggcttccaacacagtgtttataaataggaataactgtgcgattttcatggaactatgtcttccctttcagaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcaggtgagcccatatccaattccttctgcaggaggcctttggggacaagttcatctcacctcctttgtagcctgacatttctcttctgtatctttgccttcactcctgatatcttactttcatcccgtgtgtgtgtgtgtgtgtgtgtgtagggcagaactgcataaacatttggctcctggtttacctctactcccgaccctgtcgttaatttttgaaactctcattccattaccccaatgaatgataaatgacccaaaaaaacataacttagcaatcagtggcataggcttagaatttatatttcctggcagttcattttttactacaattcttctcattcctaacagtttctacttagaccaaaatgtgtattagagacggtagaaaatcattctaggtcaaagtccaaattttcatgtcaatctctgtatgtggagatataagaaacgggttacaacaaaaagggaaaagtacagaaagtaattgaagaagtatttcaacaaatctcctttcctttcaagttctagatctatctgggtttaaacctttggtcaaatggaaaagatgagacaggctaagctcccagtttcatcccctctcccagtttggaggaggcctggaaggtgctggctttgtgcttcctggctaggctgtttggtgaccgttgagttgtgcactgattgctaatttcccttttttaccatcatagcaccttctcattaaaggaaagcactcgaaagtgtccagtatatccttttgtaaagttgacttgttaaagctagaaagatcatgtgcaagtagaaagcaaaggagtttattatgaatatattctcagaatggtcgagaggggaaaaattgcttgaaaagaggaaatgcattaatttttagttaattcaattagaatatttctttcaagctctttagaaaattagctttgcagcttagaaataacttaaaaccaacgtagcatgaaagagaaaataattgggaattcccgtaagaagaaaatgaatagccaaggataaagagcaaatacacaaagcactagatggcaatgatagcagcccagaattggaaagagggcaggtctggggccagttggcactgagtctggaatccagcactgccatagcagctgcatgacaaggggaaaataacttcaccctgtacagctcatttgtaaaacggaggcgtctacatctgtcctgttgggttgttgcaagggctgggaggatgtaggtagagcagggggtaattactagctttactggttgtttcgggccctggaagcagatgccacggggagataaaagtgaaatcactaagttaatgtgagttcagtgaggcttttgagtcattttctcacaatgctatactacctcaaatcttttttatttatgcagtggttttatattgtctaatttttttccaaaaatcacatgtattcctcctaaagtattaaaataatcaaagaggttatattcccctccacctaccccatcacagttgaactctgctccttaaagacactcacttttgacagttgggtttttatcatcctagcattttcttatatattaattatcattatatattgatattagttattgctgtatattaatatatttatatccaacagagtatttataactgaagtctatgtcatcaatctaagctacactttgcttgttattttgcacttcagcatccctgagattggggtcatctgataattatgacatataacaatgtccacgggttatttttcccaatttttaacatctgttatatcaagatacattttacaatctaggatctcttaaaatagatgaaagttagaacttaaaatttttttatattgatatatttaggggtgcaagtgtagatttcttacctgcaagtattccatagtggtaaataaagtctgtgttttttgtgtacccttaacaatagcgaacactgtgcccaataggtaatttttcaacccttaccccacttccagactcccacattttggagtctccagtgtgtattactccattccatatgtccatgtgtacccattgtttagctaccatttataagtgagaacgttcagtatttgactttctgcttctgagtaatttcaattaggatagtgacctccagttccgcccatgttgctgtaaaacacacgattttattcttggttacggcttagtggtattacatggataaagaaattttcttactgaggcattcctacaggtgcatatgtggaggttcattgcagcattgtttataaaaggaaaatcaggactggggcaagatggggcagggaaaggttaggggaggaagaaaaacaaatgcccagcacaagagatggctaaataaatcatgtacatctataaaacagattccatgcagctgtttaaaaattaccatcttttggccgtgcgcggtggctcatgcctgtaatcacagcactttgggaggccgaggcgggcggatcatgaggtcaggaaagatcaagaccatactggctaacacagtgaaaccctgtctctactaaaaaatagccgggcctggtggcgcatgcctgtaatctcagctactcaggaggctgaggcaggagaatagcttgaacctgggaggtggaggttgcagtgagccgagatcgcgccactgcactccagcctgggcgacagagcgagactctgtctcaaaaaaaaaaagaagttacatcatttgaatttaaattagtacagcctttatggaaaacagtatggagatttctcaaagaactaaaaatagaactacccggcgatcccactaactgggtacctacccaaagggaatgtctttatccattcctccattggtggatacttaggttgattctatctctttgctgttgtgagtagtgctacagtaaacacacaaatgcaggtatcttttggatataatgacttcattccctttgggtaggtacccataaacaatgctgcaatgaacctccatgtatgcgtctgcaggaatggcttagtaagaaaattttgacaaataaaaataccaggctaagtgtgtacactttaaatttatgatattattctggctggcaccatggcttacgcctgtagtcccagcatgttgggaggccgaggtgggtggattgcctgagctcgggagtttgagaccagcctgggcaacgtggtgaaaccccatctctacaaaacatacaaaaattagctgagcgtggtggtacacacctgtagtcctagctacttgggaggttgaggtgggaggatggcttcagcccgggaggcagaggttgcagtgggccaagatcgcaccactgcactccatcctgggcagcagagccagaccctgtctcaaatagataaataaaattatacccccaaaatactgtaaaaatttacactcaatttaattgactaggtttaaaaaccttcaagtattttgttatgagaaatgaatttttgaataatgtagcaatattctaaaaatgaattttattttaaatatttattctaaaaatatggatttcagaatattgcataaattgttttcaactaaagttttcaaaaaacattttaaaaagtagattagaacaaatacatatgaagtacatattatataatatttttggaaaaatacagaatatcaggggaaaaaagataacacatgccaaatttaaaaaaaaaagattagcttcattgctatactgtttctagtttgtatatccacagttattatgataaaatgtccaagaagaatctctagtgtacatggtcagccaaaccaaaatcagtgctttccaatccgttactttttaaaaaacaatggtagtttttttgttaactgtattgtaattttaacctccagcatacacattcattgacattaaagatgctgggtgggctggttggcgagaacaactacttaggctcttgaggcccctgtgaaggaccccagggttccaggaaacgcatgttgaaaactgctttcgaaatatatctgttggagtatataggaattagggaggtagccccaaaggaactttttttattttttgacagagtctcgctctgtcacccaggctgaagtgcagtggcgggatctcagctcagcgcaacctccacctcccaggttcaagagattctcccacctattacaggcgcgcaccaccacacacacaaaaataattttttgtatttggtagacacaggggaacttttcttttatactaccaaaattacggacctagaactaggcttatggatcatctattctgaatccagagagaagtacacagtgaaattaaacttttccacaggtcctatgattagttggcattcccttcattggcacctaatcatgtagtcacatttacacaaaaccatctcttgttgcaaagcacatgtttgctggagtggagtgaactaagaggagccccagggcatcagggttagcacatgtgccccagaaccaggttgccctgcctttgcatcctggtttggcaacttcttttccccatgaccttgttaattttctctctctgtacctcagtttctcatgtgaaaataatatctgcctttcagggtggttgtgagaattaaataatacgtgaacacttcaaatagtgtttgacacatggtaagttttcagaagatactaacaactatggctgccactaataggcgtctcagatcaaatgcattttcaaatgtaattaaaatccaaaggatcttataaaatctacagttacctaatagcatgtgaacataaattaagcgtagacaaatgcagaaataattgttcttaatgtaagactgtcttttctagaccactgcttcgtaaacattaatgggcatgtcagttacctgggggagcttatcaaaaaacagattctggtttctcacttgcaaaagatggggcggggcgcgagacacaggattctgcatttctgataagtcccaagctgctgctgctgctgctgcttcctctgaggaggaagcaaagctctagagccatctaatagcatctaactttattttgttaaaacctacgttaatgctggtagttatctatcataaaggaagcaaagaatatgtgaattttaaaactagtttgttcatagtttctgccattgaaccttttaaatatactgttcccggatatcttaatcgttgagaaggaccacgttgtctatctcttcatctaagcactggactaatcccagcctgtcagacatcatgcatcccattttccttaggagtgcagtactgctttggggaacaattcgttactgatggaatcagtgctggaggaatttaaggaataaatcgcaccacttgtcatcagctttaagcattaaagtgcagtgtaaaataaagctttggctccagagcgagctttcacacttctggtccaacaggtcacgggcactaattcttgctaaagcagcaactacatctgagagtactggtaggtgcaggaggtaggagtggctgcttaaatagtgttctctgaagttagatggcatcttgcatattggtaccacatgcaggggaaatgagtgtgatggattgtgtcaggggagctttacataaggagaattgcataattgtagaattcatacatttctggggctgcttaggatcccatttcaatgctccactacagaggccagaccgcagactgcactaggaggaagttcctgatttttccttcaccatggatgtatcatggactgactgtctccccattcagacttctggaggccttccttgccccattgcagcccctgactcctcttctccttcccctttcacagtacccgctgatcctgcccactcttaaaatgatttgggtggctaaactgttttgggaggatcctcaaatttgtggtctttattgtgatgtcatgtcagcctctgagagacagagctgtttgggaaaccaagtcaggaaaaacgagccattgtatccatttcataaatgaagacagagtggtcattgtttgatcttgctgagaatttctagcgctgtgagagaagaaagtcatagagttatcagaactttgaggcctttggttgcatatggagtttattggatatagattttttgttgcttggtttttctcagtctaagtgataataaaaatgataactaacatatacatagcacaatgcctggcattttcaacatgttttccatctactgagatatttaacttgccaagccatcttaggtatacagttacagtagtcctctgccttatctggtttcagttacccacagtcaaccacggtccgaaatattaaggggaaaattccaaaaataaacaactcataagttttaaattgcatgcagttctgagtagtgtgatgaaatctggtggtgtcccacccagcacgtggaccatccctttgtccatggtgtccatactgtgtatgctacttgcccattagtcacttagtagcagctccattatctgatagaaatcgatcgtatatataaggttgagtactacctgcagtttaaggcatccactgggggtcttggaacatatccctagtggataagggagaatactacccctcctttttctgacagaggatctgaggcacagcaagcttaagatgcctgtcagtggtcacgtaccagtaagtggaagcttcaaatccaggcacccttgctccagaatctacgttctaacctcttcagtgttactcgagtctctttccatgatcccaaagcacatcttaaatagtctcccttagaacagaaaagtaacaaagtgaagaattaaagctgagattttaaaattgtctcacacattgtgtgctaaaagaaaaactgattttagagctaacaatgagcataataagaggcaatgtgtcatcaaatctgtagccacagacacattggcaggaataacaaaaaactatatattcaatggactaatgaactaaagcaagtcaataattctcagtaaataaaacttttagtgatgcctatcacttaatctaaaatgattttttaatgtttttattttttgctactcttaaaagtataagcttaatcaccgggtgtggtggctcacacctgtaatcccagcactttgggaggcagaggtgggcagatcacttaaggtcaggagtttgagactggcctggccaacgtggtgaaaccccatctctactaaattagccaggcatggtggcgcatgcctgcaatcctagctactctggagactgaggcacaagaattgcttgaacccaggaggcggaggttgcagtgagcgaagatcgtgccactgcactctagtttggacaacagagcaagacttcatctgaaaaaagataacataagcttaaatgttctggaaaatgtacgtaagaatcacaagatagagggtgccattatctcatggaaatcaaaatccgttgatctgcaaatgaaagaaaattatacatatttgaacatttgaatcttaagtacccagggatcccagtgtctttttatattgttaaaataattagatttctgataagtaaattgttaaagtaattagacattgtaagtaaacggaacaaagacttgataaacgggacaactagtgtgttgggagaatgccacctattggcgatgtaatgtactacagcacaggtaatttcttgactactcaggtgtagaaagatggttttaaaacatgaggtcccaaaggaaacagaaggtgccacaaaataaattgaaaaatgttaacaaagtttaatgaaacacgaacattgatcaacatacagaggcatggtcctctcagtgttgctaagagagcagtttgaagagacagacttacacatctgaatcaaaaattctagttctgggactgatgaaagagcaaatggattttgtttaatgcctattgaataaaagaataaagcacaaaggcatgatgtgaataggcacttagtgaggatctgttgagtcaaagcaatgtcagtatgtatccaacttcctttgagaaaggtagactgtgctataggggaatagaagatatttgtcagttattcatactcctttaaataatgctaggaagaattatcattactgtatataaattatatacagcttgtggtttataagaagagataagtaaatgatctgaaatgaaatctaaattatttataacttacctgttttcagttttagttaaattacttacatgttctttattttattatttattgaatgcctactatgtactaggcaaacaattctggaacaggtgtaaagttgtatttaatgaaatgcataattagtataatttattcctaaatattatgtattttaaatctgcaaatgatactttaataaattcaccatttgctgtgacagaaaatttttcaatccttcctaatatctaacctacccaagtattcatatcattttgcaaaagtaaagaatttggaatgtcttcaaacaattcggctagtgatttcttccatatctgtgcatggctcttagacgctcccaaagatctcagggcaagaagtttcgtaatgcccttggaggtgtgaaggaagacagggatttgactcatggactaaacttgaaaaaatattgtaactgggccatagttgcaaaaggcctgtcagcagtcacggtttaaaggcttttccaagaaatatgtttccaaagaatgttaataatcactttggaacaccctacttgtgaaacaatgagtggtcactgcctttggtttaggcaatccagggatctctttctgcttttggtcctggctctgtgacattgcactgggcacattacttcaacctcctttatccaaagttgagacctcttcgtgaggttatgataattaatacaatcactatgaaagcatttatcatttcaatcatagatcctgaacattataattaaagaaacaataaccgctagtcacttacaatggaaaattaaaatcaaactagaaagatacaaaaggaaatcgagtggccgtcatgcgggcacagagaatatctataaaacaggcaagcgttccagttctgtgggactgaactcttggtatccatggaactagattgaatggatgttatatgaaatggccagtaagccagttatgttgttcctcattgaaaggactcttggcccggcacagtggctcacgcctgtaacctcagcacttgggaggccaaggtgggcagattctgaggtcaggagttcgagaccagcctggccaatatggtgaaacctcatctctactaaaaatacaaaaattacctgggtgtggtggcgtgtgcctctagtcccagctactctggaggctgaggcagaagaatcgcttgaacccgggaggtggctgttgcagtgagccaagattgtgccactgcactgcagcctgggcaacagagcaagactccttcccaaaaaagaaaaaagaaaggactcctgtatttatttagaaagctttctctcacccctcccaaagaaaggttgaaaatacttttactactctcaaaagattattgcaaaataaaattcattagtgaattcaaactgaaagtagctctttgatgtaatgtgatccgtatgttaatttcctcacttgaaatcctagtgatttcttccatatccatgcatggctcttacatgctcaagagggttaaatgtgataatgcatgggagaggattggcctacagtaaatgcgccatagcgaaaggcgttagcaattattatgaatcaaatccagttctaggaaatgagtcaacgttcatcatgcactgctccctggttatccagtgctagaagtctctttgaaaggggccaagaatcaaagacaatgagggataggagggtgttcagggaattgcacagacccgaatacccctgtgtacttgcagagaagctccacctgtgcccggccaggctcctacagtgtaagttaggaagtcaaagagaggctttatgcacacaaaggaccattatgttgagttgtttgtttgtttgtttgtttattttgagacggagtctcgctctgtcgcccaggctggagtgcagtggcacgatctcggctcactgcaagctctgcctcccaggttcacgccattctcctgcctcagcctcctgagtagctgggaccacaggcgcccgccaccatgcccggctaatttttttgtatttttttttttttttttttagtagagacggggtttcaccatgttagccagggtggcctcaatctcctgacctcgtgatctgcccgcctcggcctcccaaagtgctgggattacaggtgtcagccactgcgcccggcctatgttgggttttaatgaacattcaatgtactcaatttttaaatgttaaaacctagatattcctaagaatttgatttcaactttcacattttatcatcctatttataagtccaataaccttctataaaataagatcaattttatttgttgactgtttatatgtctcaaagaacggattaaacttaaaagttatttctacatataaattctattaattaaaattttgaacactttggtctccatctcacaatcctaataagcatttcctcataaatatttaattagctcttataagtctaataaaccaaacttaaaacacaacaaattgaattccctaataaatttaaataatgtttaccaacctaatcaaattctcctaatcctcattcaacttaaaatccaaaatctaaattcagttttgagttgaagttgcaaggcctgtcaggttctctgatgatatgattctcttaggcactaacacatgtacaataacaagaaaaagccctcaccctaagacgtgtcacagaaagtgttaacattctaagcttaattaacttcattatttctgtagcagaattactgtgttaggccagctgaggttagtggctgaaaaaattcaggaccctgattgccagttggaaatgagagaatgaaaaccaggacttgggacctgcatcctctcagtaatgagtctgccctgcccaccataggatgcggagcaccttcttgcttccgtgctaacgggatcccaggtgtttctcatgtgtgtttttttataatcagtatcttccattgcagtgactttcaagggaataataggacagaaaaaataaataggaccttttatccaactatacatgccctcccgtaggaatcagataccttctcctaaggggatatcctcaccccactgagattccctagtagatcaatagctgccagcaggatggggcttttatggatggtcagggcctcctttactaaactggggaagaggtactggatttgtgaaaggggccaaataagcaggaatgaatggcagagaagccaggtacaaaaagcagggacagtacgtacataagaggaaaaatactagatgctaaattgtgtgtttttaaaaaataaccatgtttgggcaggtgcattggaaggaaagaaagcaatgggcaaggaagccacattccagttatgatcctattgtagtcattgaaagcagaagaaaagcaaacatggtttgccgcaaggtgagaatagttaaaataaaatttttaaaaaccctgatagaggggaaaacttactccttcatttcttgctaaactgctgaagacagagctctggaggagtgtcctggaacaagctgccattcccaaaccccaaatccctggattgcgggtgagtcagcaagtatttggaacgccgaccagggaggaccagtggaccttgctagactgcactgtagcatgaactctctgttttgaaagctgattgaagctactgcctcagtgtcctcaccagccattagagaacagttcaaggcgagagaagtttgattaatgggttactcgttggtgacatgagcacttctgaaattttacttcttgtacagcttgagccttggagtgtcagttgtattcatggcacttttcctaagagctatactgcatggaagtgctagggaaagtatttggccactctctgttataaaaaatactctgaatagaaaataaatttcattatgataataatcttactgatgtcctattaaaatctttctagtttgagcgaaaggagagaaattcaggcatgcatgtaaacaatctgatcctaaaaagcaacacttatttttagttaacaagtgtatcagtctgtttttacactgctataaagatactacctgagatgggtaatttataaagaacagttcttcatggctggggaggcctcaggagacttataattgtggcagaaggcaaagccagacacttcttacctggcgacaggacagaaggagagaaagagcgaggaagtgccacacttgaaaccatcaactctcctgagaactccctcactatcatgagaacagcgtgggggaaactgccccatgatccagtcacctcccaccaggtcgggattacaattcaagatgagatttgggtggggacacaaagtcaaaccatatcaacaagcaatcatatttatctcaaaagtaaaagtcttagcagttttacctttctcctgtgaaatcagagattatgaataggcattccgttttctagaatcgcccattcagtatgatactaaatgatttggtctagtgaacattttactttcatatatatatatatgtgtgtgtgtgtgtgtgtgtgtgtgtgtgtgtgtgtttgtttgttttggagacagagtctcgctctgttgcccaggctggagtgcactggcacgatctcggctcactgaaacttctgcctcctgggttcaagcgattcacctgccacagcctcccgagtagctgggactacaggctcacaccaccacacctggctaatattttttattattattttagtagaaatggggtttcaccatgttgcccaggctggtttcaaactcctgagctcaggcaatccacccgcctcagcctcccaaagtgctaggattacaggcgtgagtcaccacgcccagcatactttcacatcttttaaataaaatttgctcttctttttttccttttgaaaatagggctagttgaagcatactctaagaagcatgaactgtgatgagtctgactttgagaaaatcactgtgcataattgcttaagcactgttctaagtttgaggttttgaattcaactaacgtttgaatttcttttgacctcttcttaacgaacctaataatacaactatggctagaacaaagctgctgactgcccatgtctgttaaacagtgacctcatggccagagcaggcaagccgggcagaggagggatgaagtaaattttattctccttttatgccgcagacagattgtgccccttatgattgggagaaaaacatctagaaagttcttagaatgaccaggttcttgtatttacaaatctgcagggagcagaagctagaaagtaattgttctgctaagcatcagtagccactaccttaagaaagaagcagattacaaaacattagctcattgggagggcttctgacacaacaaagccttctttatgcttccttctgggcttcaagtctcagtggcaggctgagctgttttgagcagttgtgctgattgtacactgctcatttcaagaaaatactaggttggtgcaaaagtaatttcagtttttgccattgctttttttttttttttttttttttctttttccaagacagagtctcattctgttgcccaggctggagtgcagtggtgcaatcttggctcactgcaagctccgcctcccaggttcaagcaattctcctgcctcagcctcctgaggagctgggactacaggtgcctgccaccatgcccagctaattttttgtatttttattagagagagggttttaccttgttagccaggatggtctcaatctcctgacgttgtgatccacccacctcggcctcccaaagtgctgggattcataggcatgagccaccgtgcccggccctgccattacttttaatgcattcatgtggtaatctgtgagccccttccaaagaaatcactgccagaggcagaagttgctaggactgtatctgatagtgaacagatccagaggggaaggaaagaggagggtcatctcagattgaagtaaatggcagaatacaaagaaatcataaaacagaatcaggatttcaagatagtccatcttttactttgcagtgatgtcttacttcctgttattgaatgaaatacattttcatgactagtcattgactatgtttagtgttattttcatattacattgattagaacttgctcttccaataatgttaatggatagtggtatatctttgttattcagaaccttgagatctgaacttctgaatattaagagagttttaaatattagaagagctttctctgctatgaagctttaaaaaaataagcaagattaaaatacgttaaaacacaattttctttataatttaatagcttattacttttagtaaaagaaaacaaaatttatcctggcttgacctttggaatatcataaaatttctgtaaacttcagtttcctcagcaaaataatacatgggaagattagatgtccacgcttacagtttgttaaattacatgtttgtcatcattctgaaaaatatctagatgggcaccacctgcaggtaacagcgtcatctagtggtgattaccttatattacagccacaggtttcaaagacaaattgtctttccaagagttttgcagcccatgataagaatgttttctgctcaggccagatgcagtggctcacacctgtaatcccagcactttgggaggtcaaagcgggtggatcacctgaggtcaggagtttgagaccagcctggccaacgtggtgaaactctgtttctactaaaaaaatacaaaaaaaaaaaaaaaaaattagctgggcgtgatggcacacgccttctgaggcaggagaatcacttgaacccaggaagcggaggctgctgtgagctgagatcacgccattgaactctagcttgggggacaagagtgaaactccgtctttaaaaaaaaaagaatgttttctgtttaaaatcatagaatatgcaagctagaaaggaccttcgagatcatctagtcttattgcctcattttgccagttaaagttagttgaattccagagttaacatattaaatattttcccctcctgtattttttgtttctcttgactttttaaaaattgcagtgaacttcacagaacatgaaattaagcactctaaagtgaacaatttagtggcatttactacgttgacgatgtaatgcaacctcccctttattcttaagcacatgcttagttcctgtttttaaacaattcttacttggttaatgaagaaaaaaagttctttgtatgtataacttaaaaaaaaaatttcagcttgtcagattgttgcttcagagtggtatttaaagagcaggaaaggggaaatgaagtggtttacctgtccctgcagctgaaaaaatatgaagtagatcagtttggaaatttaacatgctgaacactcttttcatttgcctctttgtttattgtgttgttcagtcttgtctcttatcaattttagaagcctcattcctgatttcctatgaaattgcttggatgtaagacttaatatatttcctatgccccagatacattggcaatcattattttaaggttattgtgtgtggcataatttaatactattacagtagtataaatgtttggatccaggttttaaaatgcaaaggaaccactatttttttggcatttctacccaacaaatctcttttttcattttgtcttgctaaataaacagcagtctgttgggaaactctgggagtaactaaaatgaggagggtaacattaggtgaaggttgggagtggggagaacgtggttggtctatggcccgtgagtctccttagagtattaacatttacaggagtcccacagaatataaaccttgccaagactttagacttcattacttccctgtcctcgacaagtacaatttaattgaacattaagcaatttgatctctttcacctaataaatcgagcaaattcaataaacataaatcctgctaatgatggagctgcccctggtggagctgagctcatcagcattcatggttattactctccctggaattttagtcacaaatgcttattgctgaactaagtgcttacctgatgcttaaggtctagggagtgtatttaataatttttttcccagggtttcaaaaggacagctggggagtagaaagaacatggtttggcagatagaccactttgggttcaaatccctcacctgaccttgggcaaggcaagttatgctattaaaaagtgtagttttcttattggaaacaaaaggagctaattacaattatttcatagagttctgagttttaaatgaaacagtgtatgcaaaagtagtgtctggtgcgtaggaacttaatagtgcatgttagctaactctcttgtttttaattgttcagtagcctgcatctacagcagttagcgccctactgcttctttttttttttttttttttttttttttttttttttttttgagacagagtctcgctctgttgcccaggctggagtgcagtggtgcgatctcggttcactgcaacctccacctcccgagttcaagcaattctcctgtctcagcctcccaggtagctgggactacaggtgcacgccaccacgcctggctaatttttgtatttttggtagagacggggtttcaccatattgttcaggctgctctcgaactcctgactgtaggtgatccacccgcctcgggctcccaaagtgctgggattataggcgtgagccacggtgcccagtctagcttccctaatgctttcttatctattatacatgcttatgactctctctgagttaccttccttcctcttctacctggttaacctcctggctacagatggtgttttcaagctgaagcctttcccagctcttccaggatgactttagtcatcgtctctgtgatcctgataagttattgcatgtgccctgattgactatcatcacatctttccgtactctcaggtcccaccctgtccgtaatgaagcaatgaatgaatcacttttaatagagctaaggcaaagagtaccttaattccgtgcaataaatggagaaactaaggctaaaagaaccgtgtccagaccaagaaactaggaagtggagaaacaaggactagaacccaagtctttggattccaggtgtttgcagtgtatccagttttgcatcacaacaccacatattttagttttagggaaggagggttgctgcctgttcaccagagactgtaagcagtaatgtattccgggataaagagcaggacagacacccaggcagacatccagtctcacagtattgtggcaatacccaaggaggtctctcttccacctttctttactggtacagagtggaatgttctgtaaatggccaccgtttttctaatttcataacttttactaatttcatttaaagaaaagtgccattggctgggcgcagtggctcacgcctgtaatcccagcactttgggaggccgaggcaggcagatcacgaggtcaggagctcaagaccagcctggccaacatactgaaaccccgtctctactaaaaatataaaattagccgggcatggtggcgcacatctgtagtcccagctactcgggaggctgaggcaggagaatcactcgaatctgggaggtggagattgcagtgaaccgagattgcgccactgcactcatcctgggggacacgagcgaggacttccgtctcaggggaataaaaaagtgtctattacaatgctggcttatcagtcactggaggagacagtcatttcattctctttatctcctccctctgtttcctagttgtgtgttttaaacaccattgtcgttaatccatgtttaaacctgtaagaaaaatacctggtctagaaattgtagtagcatgtgacccacttttctgcttctttttctcttttttttcttttctttctttttttagatagggtctcactctgctcaggctggagtgcagtggcacaatcacagctcactgcagcctggacttatctgggctcagatgatcctctagcctcagtgtgccgctatgcccagctaatttttgaatatttttttgtggagacagagtttcaccatgttgcccaggctggtctcaaactcctgggctcaagtgatctgcccacctcagcctcccaaagtgctgggattacaggcgtgagccactgcgcccagccctgacctgtttttcttaatgcatgaaaattggtccttgtttctcttatatttgaaaataacacagttcaaacttcagagcgttgcatttttagccctgatgtgtgcaaaacgaaattgcaacctctctaccatttctaaaaacagctgaatttaatttgcctcagtcagaactaaaactttacctcctggtctcctcacatgccagggtagcattgtgacatgtgactgtccagactgccctgcacatgtgtctgtcatcaagaatggagatttcttatagtaaggatatggtaatgttccttccattgctgccaacagcaggggccccacacccacaggctccaggggataatttttaaaccttttcttttttcaatttaagatgaaaagcaacagcatttgtcatatgaatcagccatgccagggaaattaatgtgatcaatggcctggatcttgtttagactacttagcgacggcgtcccatagcatcccttatgtatctttcatagctttgatcaagagctaagcatttgcgcttggggcatggggaatgcagtgggtcggggagggtctttgaggtgtgactgtttccatttcctgttcatttcacattggtatttggctagattccagatggacacattgtatggggtctcaaatgggattgcctccaaagtgcacctctcagggcaagccctgctaagcaaaaacttttcctttgcaccgagccccagacaaggaggtgactattgttcttgatgcacagaagtcaagggtgttttggagaaagagaaagattctaaggacagaaaatgtgttcatctccacatgttgagctggataaagtagcagccaagagtttcttgtgggaagttatggaaatagtttagggatctgctattcttgggctctgtactctcagccaaccacagttcatgcagttccccaagctggactgtagcagtgacctagtcatcgagataaccaaggccaagcacctccaagctgtaatgggttctgcttgtggcttggggtgcccagaggcccagcacatgctagaaatttgcctgtaccgagatcctaaagaggatgacttgcccaagtcctgatatttccattgctttcctgaaagatggtgaaatccacttctataaacctattctcttctgttaacttattctctatgtaagacatttctgatttaggcctatattaaaaattcttggacatcagtttttcccctgtactttgagttctgatgatctaatgttaaaatgtactattgttcatactttatcactgcacaaccaagtaatgaaatttaccaaggcagtcaacagttttgtgccttgtttgagaggaagtctaggaagacttctctatttactgagctagtttccctctacctatttaaaaactccaaatagtcttgaaacaagatttaaaaacacctgtggaccgttcttccattgctctttactgcacaattatttgcctgttgatcactgcttttacgttttgttaacattaaaatgtaaatcactcactcattataatactgtctttaaaaaaaacttcatttatttccaaatgttcactagggacttagtgatgtcacccacaggaaaaaattggattctccattttcttgatgcttcaaatttttaaaatagtttcacaacattatctcatttttttacatatcagtaacacagatgtagtcaaacaagaattcttgttcctgtgttacagatgtggaaactgaggcttgcccaaaactgctaagctgggaagtaagtggtgcagtcaggacttgagcctcagcttccacctctgaagcccatgttcttcccattaccccacgatcctggccaagaatcagggcagatgtgcatgatgggaagggcggcgtggatggattaggacagacctgtgcaggctcccagaaaaataattcaaaatacatttcctggtgatgacgggactttagcacatcttcagatacagaagagaagacatggtgcagaaaggatgttttgatcactgaccaaaactgtcttggagcttggaatgtgaatgtgttagagaaaagtgaagcagcaaagggcaacacgctctagcattttaagaggaaaaaacgcatggcaggggaagaaaggaaaggaaggaggatgtggaatatcccagaagtacctcccccaacccattaccctccactgcccgcttccctagccttggtctagtcagaagacttctttaggaaccatttggtagttccaaaaaacaacttagttttctttcttgatgcctttgggtacgtgcttttaaaaactaatccaaaattctgcaacataattcctacatacctacttagtttcagttcaggtccaccttttgcagggagctgttcctaaacattgcataggaacaggagcctgcccttcctcttcaccctcaccttcagtcctttcctctggcgttgctgtagagtgacagcttagagactcaagcccatctcatttctttggtggaggaagcatgtctaggggagtgcactggattgaaggtggctgccctggccagcccctgatcatggcattcgacatccccggacctcaagtctcagcaaggcttctctgacagccaacaggcatcagcaggatgctcagccatctctggatttcactttataaaataagtaccttggccaagcacggcagctcgcacctgtaatcccagcacttagggaggccaaggtgataggatcgcttgagcctagaagttgagaccagcttgggcaacattgtgagaccctgtctctacaaaaaataacaaaaattagccaggtttggtagctcatgcctgtagttccaactactcaggaggctgaggtgaaaggatcgcttgagcccaggagtttgaggctgcagtgaaccacgataccacaatggtgccactgcattccagcatgggtggcagagcaagacccttttttttttttttttttttttgagacggagtctcgctctatcacccaggctggagtgcagtggtgcaatttcggctcactgcaacctctgcctcctaggttcaagcgattctcctgcctcagcctcctgagtagctgggactataggtacgtgccaccatgcccagctaattttgtatttttagtagagacagggtttcaccatgttggccaggatagtctccatctcttgatctcgtgatccacccaccttgacctgcgtcatgagccaccatgcccggccgacagtttctttaaaaataagtaccagaattaattcatttttaacatctcctctagatcacaactgtggcttcaatataaaatatggaacaagtctgtctttcagatgtacaacaaatgtatataaaaaataatgggagaagatgacctcagctcttgaaacttgtaaacatttcagcaatcttgctctcgcaaagaaatccttaattctgcgttttcaaactttaagcagaactgacagccatttgtgctctctctgtttgaagtagttcttttcttttgagtcaagaatctttttccaggttcggctatttccttaatgaaattaatatttcacacagaatggtttcatgcaaaagtgctgggacgcctggagtctggatgttgttcctggaatgcttccacataaggagaattttagacaggggcagccagaatcctaccctatccagtggttcaaggtcttttctggcctcacgcttgctttgggcagttctcagaatgtgtgtgtgcacgtgtgcacatgcatacacacacacctttgattcgtcaccctcattcctccagtcatttaagtaggagctgataaaagaaagccttcagggttcacagtattgccttggtggggtttttttttttttgtatgttgcaagaataaacacaataggggaaaattccaggcaaacgtggccattgccttgcgcgacaatagaggaaaattccaggcaagtgtggccattgccttgcatgacaatagaggaaaattctaggcaagtgtggccattgccttgtgtgactgccccactcatgtccatctggtcctggggcctgtagcctgcctgcacctcacagtcctaacagagctgttgacatccgtggagccccagaatttcaccaactgctagatgtatctttgggaagtgtattttgtggaacatactcagaacatgaggctgtcctttctacagctttcctccctagaccttctcaataactctgttcttaaatgtagacaagagcctgggatcatgaaaagcattgaaacctcagtaaccccgggacaaatggagaaccaaaatcctgtgcactggtgggtccttgggggaggagtaaaggggagtctaggagtcagggggccgtggggctgacccagtgtggaacagcaatatggcctcaggaggtgaaaaccacagatgggtctagctggggtacagagatggtaaggacaggaattccaaaggagctgagatcattgcaggggagacaaatgtgaaaactgtacactctggagcttcgtttctgacttcaaatcaggttctgccacatggcagctgtcatgtaacctctctgtgcttttgtttcctcactggtaaaatggagatggtagaacataggatggtgtgcgtcttttagtgcatcgatgtgtattaagtgcttagaacagtatctggcatagagcaagcattatatgactggtagctgttgttattaccactaccacggctgttcttattatcgtgattattatgactctcagcatagctataatgctatccatagagactgtagagttataatcgtgactactaaatttaagcagcatccttgcctggtgctgtatcatttttggacaccagagatatatttattcctgtctctagagagcgaaaaagcacctctctgtcagaatgactactttctactttaaaaatgtttttgatgataactcttgatggctttagataaagccatccttccaaaaggcctgaagcactctcagatggctccgttttgtcagccctttactgctctgggatgtggtctacccactgttaagctaatatttttgatcttcaatttggaaccttaattatgctgtacagcagtcgttgtacgtggatgcataaaattcccatcaaaagatattcagacactttccaggctcagtggtacgcaggagatggagacacacgtggaagggtgtgctggcagattcccgttgctctgagctgtgagggggtggggcaggtgcgagctaacagtggtggggcctcatgctgcttgtctactccttagatgactatgctcagctgtgtaacatccccgtgacgggacgccggcagccatatggacgggacgccttggttgacttcagtgaacagtatactccagaagccgatccctacttcatccaagaccgtaagcaaaataaccttgttcctttgatactaagttgtggttgaagattaatcagtggtcctcaaaatgtaatggcaacttgttagcaatgcagcatttctggtcccaccccagacctgctggtcagaaagtctagggtgggacccagccatctttgtttcacaagggcagtccttctgcgtgggtgagtctaagaaccactgcatcattcgtgagccgagatcacaccactgcactccagcctgggcaacacaatgagaccctatctcaaaacaaacaaaaagaaccattgcatttgatgaatagtcttgctggtggggatactgttatatttacttttcttaaagttttgagatggagtctcgctgtgtcacccaggctggagtgcagtggcacgatctcagctcactgcaacctccacctcccggattcaagcgattctgctgcctcagcctcccaagtagctgggattgcaggcacgcaccaccatgcccggctaaattttgtattgttagtagagactgggtttcaccatgttggtcaggctcttcttgaactcctgaccttgtaatccatccatcttggcctcccaaagtgctgggattacaggcatgagtcaccgtgccctgcctatcattataatttctataacaaaatcatttctcttctctttaagtggtggactagtttgagggccaaggtttccatgagagcccagttgtattgcagcctttttttcctacagggaaatgcaaatgttaactgtacaagttgatcattattataagtgttttagagtaggaggtaagagaagaattgcccttttggtcagaaatgactttttaaaatacattggtgaggggatttatggagtaagaaataatgtgtgccaacttttcctggattagtgagcacagctttcatgggggaggtgggagtgtgtatctgcaaattgtgatcccctttagaacgtaaatgttgtgtgaggaagcctacaaacacacaagctcaaatcagacttttcaaatacagacaatttgaagtctgaaacagcaggaggtccacaatgaaatattagtagatagtagatagtctcacttcaagaacgagaacaggaaaacgcccattttgagagcctcgtccacagctcacagaggggccatcctcacgtgtagcttcaccacaaatttttttttttttgagatagggtctcgctctgttgcccaggctggagtgcagtgccatgatcacagctcactgcaactctgcctcctgggctcaagcgatcctcccaccccagtctcccgagaagctgggactacaggcacgtgccactatgtgcagctaatttttgtattttttccgtagagatggggggtttcaccatgttgtccaggctggtctcgaactcctggactcaagtgattcatccgcctcggcctcccaaagtgcttataggtgtgagccaccatgcctggcctgcaccacatttttaagataggtaattgctgccgaccgaggagtttgacttaggactttagagaaaaatgcagtgaagcttttttctgtcctgggccctgtcacctgtgcacgaagcgtcctagccaggacccagttctggggcaacagcatgagatttctagctgaatttaggatctatttcagttctgcatcaagagcttttattttttttttccttctcttctctttctcttttccctttctctcccttcttcattccctccttgtccttccttcccctccacctttttttttttgaaggatgtagtgtattgatcatctggtagaattaaaaatgttttaaaatgtccatgataagaacattctattaatccagctaggctgcttaacacacgcctgtgtaactcccacccaggccaggagcagtgccagcctccagaaggcccctggtgccttttcccacccccctccctagggtaaccactatcctgactcctaacaccatagatgaacaacactctttcttttcatccacagcacataaccatgcagctctttatgaaatggaccagaatgcactcacagctacaagactgtgcacttagggtttgatgcttctctgtatatgttacgggtcagtaaacgtttacttaagaaaaaaggaagggagaagaattattaaggttgaaagaaagcccagcttgccccattaatcaggaataccaggttaagtctatatgcaactctgacaatcccgtggcttacagctttcctccctagacctcctcaataactctgttcttagatgtaagcaagagcctgggattatgaaaagcactgaaacctcagtaaccccaggacaaatggagaaccaaaatcccaggcactgatgggtcctgagagtctaaaagtcagaagcctctatggcattatagtttggattccaggaattttcatgttgaaatgtctggcttatgtaccttctttttaatgctggcattgctttaaagctcttttttttaattaactacacatgttaagaaataaacatgttggtgtcacatcaatctcttatttagcaacataggaaattgagatgcagttccaagacctccagcttggacgatgtaatggcctttacatttcttacaagttgcagagaaatatttcccccttcccagccagttttctgacctccagcaagggcttttggagcctgctgcaaaaatgattgtgttgggtagatagtaacatagacggaggctgagtgaggtttcttatcgcctttatggttcaccatctctgttacctttagggagagcagtacttctaaaactggaatttgcttgagcagagaataggcaaacatttgccctttataagggccaggtagtatttttttttttttcttttttgagacagagtcttcctctcttgcataggctggagtgcaacggtgcaatcttggctcactgcaacctccacttcctgggttcaagtgattgtcctacctcagcctcctgagtagccctgggattataggcatgcaccaccatgcccgactaatttttgcatttttagtagagatggagtttcaccacgttggccagggtggtcttgaactcctaaccttgtgatccacctgccttggccttccaaagtgctgggattaaaggtgtgagacaccgcaccgagcccagatggtaaaatttgtaggctttgcaggtcatgtggtttctgttgtaggtattcaactctactgtagtttcacaaaagcagccctagatagcacagcagcaaatgggcgtggctgggtttatttacaaaaataggtagcaggccagatttggaccagagactgtagtgtcctgacctgttttagagtcctgcagaagtattttggggagcctgcctgatgtgtggggagtttcaagttttactttttatgttttaatttctgtaataataaaaaaggtattagatatgaagtagaaatcattttgctgtgatacatgggatctgaaaatattgtcgtagattaagtctttattttgtgtgtttcttaactggctttgagtatgtggtgtcacttttttttttttttaaattggggtctcactatattgcccaggctggtcttcaccccatgagctgaggagattctcctgcctcagcctcctgagtagctgggactcttgttctcctttaaagttttaaaatgggcctgccatggatgtattactcaattttttttttatggtacaaatttttttaacttttaggttcaggggtacatataaaggtttgttacataggcaacatgtcatgggggttagtggtacagattattacatcacctaggtgtgaagcccagtacccaatagttattaccttttctgcttccctcctcccaccctccactagtgtctgttgtttccttcttcttcttttttttttttttttttttttttgtggtatttggttatatgagtaagttctttttttaaattttttaaattatactttaagttttagggtacatgtgcacaacgtgcagttttgttacatatgtatacatgtgtcatgtcggtgtgctgcacccattaactcatcatttacattaggtatatctcctaaagctatccctcccccctcccccaaccccgcgaaaggccctggtgtgtgatgttccccatcctgtgtccaagtgttctcattgttcaattcccacctatgagtgagaacatgcggtgtttggttttctgtccttgcaatagtttgctgagaatgatggttttcagcttcatccatgtccctacaaaggacatgaactcatcattttttatggctgcatagcattccatggtgtatatgtgccacattttcttaatccagtctattattgatggacatttgggttggttccaagtctttgctattgtgaatagtgccacagtaagcatacatgtgcatgtgtctttatagcagcatgatttataaacctttgggtatatacccagtaatgggatgactgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattgtaattggtgtgagatggtatctcattgtggttttgatttgcattcctctgatggccagtgatgatgagcattttttcatgtgtcttttggctgcataaatgtcttcttttgagaagtgtctgttcatatccttctcccactttttgatggggttgtttgattttttttcttgtaaatttgtctaagttctttgtagattctggatattagcccttttgtcagatgggtagattgtaaaaattttctcccattctgtaggttgcctgttcactctgatggtagtttcttttgctatgcagaagctttttagtctaattagatcccatttgtcaattttggtttttgttgccattgctcttggtgttttagacatgaagtccttgcccctgcctatgtcctgaatggtattgcctaggttttattctagggtttttatggttttaggtctaacatgtaagtctttaatccatcttgaattaatttttgtataattttgtaaggaagggatccagtttcagctttctacatatggctagccagttttcccagcaccatagcaccatttattaaataggaaatcctttccccatttcttgtttttgtcagatttgtcaaagatcagatggttgtagatgtgtggtattatttctgagggctctgttccgttccattggtctgtatctgtgttttggtacgagcatcatgctgttttggttactgtagccttgtagtatagtttgaagtcaggtagcatgatgcctccagctttgttcttttggcttaggattgtcttggcaatgcaggctcttttttggttccatatgaactttaaagtagttttttccaattccgtgaagaaagtcattgctgtttccttctttgtattcataagttcttatcatttagctgccacttacaagtgagaacatgtggtatttggtattctgttcctgcgttagtttgctaaggatgataggcctccagctccatccatgttcctgcaaaagacattatctcattcttttttatggctgcctagtattccatggtgtatatgtaccatattttcttttttatcccccaaacttatgccaaatctcatttaatctttacaaggtagaaaagtgttcattcattacaaaatacttctactgagtgcagacattgtgttcaatgttgggtatgccattctacatagcatcgtttctctatttttaaatgaggaacctggtttcaacaaaatcaagtgacttggccagggtcacaggcatgagcagaagaccgagttcctctgattcaaatcccatggttcatttccacaaaataaacctataactgagtggggctttagagatcctaaaattcagtgcttttacttcatacgtgagaaaaataagctttctgcccaagtttacaaggtacacatagggaaatgggaatgggaactcaagtcccccaataccagtgtattgttcttacccaaacagataatttaagattcacttattgtatatttttcggtcatctctaaaacccactttcttctctgaagggcatgctctaaagtttcttcttcacctatctcccctcagggcacctaatcttagaatgtaagagaaactctgaccaaatttgtcttcatgttgacctcaggcactttagtcattgttgaaacttcttttttgttgtagttaagagaagtaacaagtaagtctttatttccttgtttagaaaaaaaaaaaaaaaagctggctaagttggttgctttttggtgatcaaggagaccaaactccatatccttgtccaattcctccaagttagaccttattgccctccataagcaatgatattttgctgcctgctgccccctgcagttccactggagaattacttcaaaggccagatagaaagttctagccatatattttttttttttttgaagctactttgtggtactattgggaagagacaggagatgagaggccacatgacagtgtgttgggtcactgtggatttatgtttagaactttcctctgcaaaatgagagctaaacactcttgatgcctggctaaattgtttttacatcacaaaaactctaaagtctagctctgacttggtttcaagagatctaaactataaaaagagccaaacaagagtttctttgtttccttaaaaaaaaacttttggttctgtttttttttggtgtgtgtgtgtgttttgttttgttttgttttttggttttttgtcttttgtttttttgacagagtcctgctctgttgctcaggctggacagtggccgtgatctcagcacactgcatcctccacctctcaggctcaagcgattcttctgcctcagcctcccaagtagctgggattacaggtgtccaccaccacgcccggctaattttctgtatttttagtagagacagggtttcaccatgttggccacgctggtcttgaactcctggcctcaggcgatctgcccgcctcagcctcccaaagtgctgggattataggcatgagcccagactttgggttttctaaacacaagtatgatgttctttctcattcatcaggatgttttgaggcccttttactgaatttttcctttgatcccctgggagcccttttgtaaggctcattccgtagccagagcaaacaaacacatggcagagccagcctgcttctctctggtcttacaaacgccggctgaaaacgtattgcctcacactcttacggaccttcttagcaaatgcttactagactccgatagtgaattctgttggttctgttctgagagtctgacacttgccctactgcaaactcacgaagtttggaactttggatgaacacttttaataattaagagcaaaaacaaaaaccatacttgctttctcgttttatgtgattttaacatagaatatcagaattcaaaatgaggctactctgcacaaaatatacaagttttttatttttatgctattttacacagcaacattcagtatttctaatgctaactttaagatgtctgaaatatgtatggacatatatgtgtctatttggaaaatgaaccatcatctaaatatcatttacaaaatgatataggaagttgagaagctctaacttagcttctgccctttcctttccaggttttctaaatagctttgaggagttacaggctgaggaatgcggcatcctcaatggatgtgaaaatggtcgctgtgtgagggtccaggaaggttacacctgcgattgctttgatgggtatcacttggatacggccaagatgacctgtgtcggtaagaatgacgtgtgttttatgggacattaattttttcctgacaccccgtatctcagtcagtagagaacatttaagatagatttgctgagtttcagtttgagaagatgagaaaagttctggagatgtacattaagtacagtatgaatatacttaatgccactggactatatacttaaaaatggttaaaatggtaaatatgttctgtgtattttaccacaattctttttttttttttttttttttgagatggagttttactcttgtcgcccaggctggagtgcagtggggtgatcttgactcactgcaacttctgcctcccaggttcaagcaatgctcctgcctcagcctcctgagtagctgggactacaggcacccgccaccacacccggctaatttttttttttttttttttgtatttttagtagagacgggatttcaccgtgttagccaggatggtttcaatctcctgacctcgtgatccgcccaccttggcctcccaaagtgctgggattacaggcgtgagccaccacgcctggcctcttctccatcttgaagcagtccttttgcccactttgcttttgttagttttaatccatggtgtgtctgtaaaataggtaacctagcttcttaacagatgtttcaagtgagtgagagcctaaatgggtctcatgtagaaggaggtctgtgaatgttatggaaggctttagacaggctgtatggagaggcctctgcgtaggtatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcaccttcgtcttgtctgtgactgaagcaatgacgagaaagcttccttggggtggtcgggggaagggcctcaggtaagcctcaggttatgtgtcctcacagagcaatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacggaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaatcaccatttttgtagaaaaaattctacctgagagtaattgtcaatgagtacatgtgtataagttgtatcccactctccccacttttatcttttccagtggtcttctgttaatgtagtgtcttttacaagttaatcattaaatttgttagatcttgttatgggctaaattgtttcccctaacattcatatgtgggaattttaacctctgatacttcagaaagtgactagatttggagatcggatctttaatgaggtaattaaggataatgaggtcattggaatggccctaatccagtatgactgctgtccttgtgtcacccatagaaggtgtctgagttaccggtgacgaatccatataggtctgcagcaacctcagttcttgcctcctcagaagaatttgactgaggggtataaggcagaaaaagagaccaggcaagtttcagagcagaaatggaagttgatttaaaaaggctttagagcaggaaagaaaggaaagttcacttggaagagacccaagtgggcacctgaaggccaagtgcagtgtttaaccttgacctagctaggattttacaggctggcccctttccatgcttcttcccttagggtgggctgccggcacacacagcaccctccttacacttgggaagtgagcacacacagtgttgaggaagctgtacatatgcccatctgaggctttcttccctttcctggtggtgtgcccctggaaggttgtactccaccattttgtccttaatgtgcatgcccaggaagttgcatctctttggcacctgcatttaattaacacttaagtgcagcaggtgtgggccatcaggaaatgcccaccccaccccgcccctgggccttggctgccagttgatcacttttagagaggcaatgtggtcactgctgaaccaccacctgacattcctagtgggtgggggaagaaccctctcctgccccgcttatgcttgtctaactacctgtaacacaagaagagattaggacacagatacacaggaaagaagtgaagacacagggagacaatggccatctacaagccaaggagacaggccccagaacaaatcaaccctgcggaaactttgaactccaaccaacggctagactccagatttgacagaaaataaatttctgttgtttaagccgcccagtttttggtactttgttatggcagccctagcaaactaaaatacacatcacaggaaaaatgaatataatagctttcacagttccagtccctgcttatacaaccacagtaatgccattgtttcattgtttcatactttagctgaaattcactttaacttgaaaaagcatctgagtttttaaaaacaaactatcgctaggcatatccagcagaaatatctgcccacataacatttttttctgaaaggttttgcattttaataactacagtaggcctggcgcagtggctcacgcctgttagcccagcactttgggaggctgaggtgggtggatcgcctgaggtcaggagttcgagaccaacctggccaatgtggtgaaaccccatctctactaaaaaaaaaaaaaaaaaaaaaaaaaaaaaagaagagagagaaaattagccaggcatggtggcaggagcctgtaatcctagctactcaggaggctgaggcaggagaatcgcttgaaccggggaggcagaggttgcagtgagctgaggtcgtgccattgcactccagcctgggcaacaagagcaaaactctgtctcaaaaataactaaataaataactacagtaggcagaataatgacaccccaaagatttccgtgtcctaatcctcagaacctgtgggtatgttaccttccatggcaaaggggaaggaaggttatagataagctgctaatcacctggccttaataggaaggctatcctggattatgtgggtgggcccaatgtaatcacaagggtgatttcattgtgattacactgggcccacccagatcatttggtgacttcttccaaaaggaagaggaccttaaaagtagaatgaggccagtcatggtggctcacacctgtaatcccagcactttggaaggccaaggcgggtggatcgcttgagcccaagagtttgagaccagcctaagcaacatggtgcaaccccacctctacaaaaaataacataaattagttgggcatagtggtgcacacctgtaatccaagctactcgggaagctgaggtcaacttccagcctatagaactgaagataacaaatgtgtattgtttgaagctactgaatttgcagtgatagaaagctaatacagtctcaaagcttcatatcttacctgtctcttgcaacatcttgtagctgatgtttgtataggggaaatgtgtgaccagtttccagctgtttccactttccagcatgtgcttttaatgcattttcgtagtgccttccacgtctagaccttgtttttacctagtggtgtgcaagtcccaaaaaagtacagcaagtgtctaaaactgtacagaagacagccacgtatgtgtgagaaaaacaaatagggaagagaagatactattgcacacaaagcaactttgatactaagagatgctttaagcatcttacagtctaacatgatagttttattgcatttccattgtctttgtaggaaattaagggatttgactgaggtgtatcatgaattctattagcttcttcacacagcaaattttcatttttacagattacttatattaagcaggagatgcctgtacataatgaaaatacatagcttgctttatttatttatttatctaattttttatttttttgagatggagtcacgctctgtcgcccaggctggagtgcagtggcatgatcttggctcactgcaacctctgcctcccaggttcaagcgattctctcccctcagcctctcgagtagctggaattacaggcatgaggcaccacgcccaggtgattattgtatttttagtagagacagtgtttcaccatattggccaggctggtcttgaattcctgacctcaaatgatgcacccctcctcaccctcccaaagtgctgggattacaggtgtgagccaccaccacgcccagtcaaaaatacatagctttaaatgtgactatttttaagtaagttttgttgcataaagtttgtttcacaaccctagaaaaacggttttctttttgtggtatctaagattcttttagctcctttcagaagttactgcaattttaggcttaatgtcagtggccttcacacgaggtctaggattctgtgacagtggtcctaattcattggtcatgaagagacaggcacatggtaagatgtagtctagtcattcatttgacatgtattttccagctgcatttaagcatcttatacccaattaagaaccatttctcttcttctgcacgcccatggaagtggtctccatactgtaaaatactatcagtaatattttattcatttgtcataaaatcaaatgtcattccaaaaaaactaaatctggccatctaatttaaacctatatagtttgaagttatgttcttgaaatttgccatgctagttgaaatgagcagcaagtactaatctagcaaaataaacccttaaatatatcaaagttcttttgtacaacttcatgtttctatttgaaaagtttatagaggccgggcgcagtggcttacgcctgtaatcccagcactttgggaggccagggcggggggatcatgaggtcaggagatcgagaccatcctggccaacacggtgaaaccccgtctcaactaaaaaaatacaaaaaattagccaggcgtggtggcacatgcctgtagtcccagctactcaggaggctgaggcagaagaatcacttgaacctgggaggcagaggttgcagtgagctgagattgtgccactgcactccagcctggcaacacagcaagactcactctcaaaaaaaaagtttatagatacaaaagcatatcataatttagctttagtgttttcacacagagactttcttactctaaaattgtactttaattctggtaaatcttaatgactccatgttgccagaaataggtataagaaatgaggctcatgaatatttcatttgagtcaccagccttagttaacatatatgtcagtgtttcatgtactactttgtggaggcaacctgtagccgaccagactatgctactctaaatatgcttttttggcacaatgattttttttttttctttttgagacggagtcttgctccatcaccaggctggagtgcagtggcatgatcttggctcactgcaacctccgcttccggggttcaagcaattcttctgcctcagcctcctgagtagctgggactacaggcgtccgccaccacgcccggctaatttttgtatttttagtagagagggggtttcaccatgttggccaggatggtcttgatctcttgacctcgtgatctacccggctcagcctcccaaagtgctgggattacaggcgtgagccactgcgcctggtcagcacaatgattattttgatgtgattattttcagaaacagcagacagtagaggctctgaaaacagcataggatacttttttttaataagggaaatttataaagaaaatttccatttgtgaggatatctctccttctctgtatcagaaagatgatcgctctgggacttaaacttgcataataagcctcacagttgtttaccacactttccctattcaccttctcataacttgcctcctccatagctttcttcctttattttaactggagatggtatttaagcccaaattctaagccttccatgtatatgagatacacgtgttaatacacttctatttgtttttcacttttaaatctgtcttttgttacaaaggccccagtggagaattcagaagggcagaggaacaaggattttttccccctcatctacaagaccataaccatagatttatgaattgttctaattacttgcagcactaaaattctatgttgctaatactctccaaatttcaaagaagagtgacttaaatatgtcctatagcacctattatttgctgctgaaatctttggcaagaagaagaagaaaatagagatggttgccaaagccaatatcaaagtgatgggtaattgcaattatgagaaaaagggaatagggaaggcatcatctgcaaagtgcagcgataaatcacattctgataagacagaagacagttctcagggaaaaaagctccccgagttaggataaaacatttacaatcattacaggaatgtgagggtcctcgggctttcacttgaaggctttcactgcctttaagattatggctttaccatgggccgggagtggtggctcacgcctgtaatcccagcactttgggaggctgaggccggtggatcacctgacgtcaggagttcaagaacagcctggccaacatggtgaagccccatctctactaaaagtacaaaaattagccgggcatggcggcaggcgcctgtaatcccagctactcaggagcctgaggcaggagaatcacttgaacccaggaggcagaggttgcagtgagcagcgatcatgtcatcacattccagcctgggggacaagagcaagactttgtctcaaacaaacaaacaaaaaagagtatgggttggccattaccaaaagaagaggtgagaatgtttggggaacttcaggcccagtaaaatcagtgtggctagagcagaaagagaacccagcgggagtggtaggttatgctctcaaagaagccttaacatgtgatgtttatgggccagggtaaagttttccttcctactaagatgtctttaaagttctccctcaacctttagtgatctcaactttttcagccccattcccagacatttctttgaatgatgaatattttttctactatcagtaagcaaacttctctcttcctctccgtaggaattgtcctccctggttccttcccttgtgacgttaatagttctctgcaggttaccttaaactataaaaatctcagacccttctaaggcacatacagaacaggatgtcatgttgctcctaagccccacctggaatgtcctgctcttggaagaaaaaacagcccttttcctctcaccatttgcagaggcccaaagagcaaaagcaaaaaaggataatgagatgctcctaaggaaatggcaagcggctgggctttggggaacatgcccagctgggttcaatttcagcatctttcctttaaaaccaagaagttcctagcacgtgggttcctgggggcgttgcatactcagcaagctgcgcagcctctcaaggatagagagggaacagagaagaaagaggctgaaaggggaaaatggttcgtacagaactttcccacgtaagagaactgggtaggcactaattagcctctgctaagattttaatagtgaaaaggagttgctgttatttcatttattctataagcatttgttaaatgcttattttgtaccaggcgttgtgccagccctgggaatatggaaatgaataactagtcatctttgaccccatagctagctcagaagacagatgggactaaccacaaggcaatgaggtaagtatagtaattaatagaacctagaattcagtgttatggaaacaaagcagaaccaactgattctaccctggagggcgtggggatgtagaactgttccgtttttttgtttttttgagacggagtctcgccctgtcgcccaggctggagtgcagtggcgggatctgggctcactgcaagctccgcctcccgggttcacgcaattctcctgcctcagcctcccgagtggctgggactacaggcacccgtcaccacgccaggctagttttttgtatttttagtagagacgggatttcaccgtgttagccaggatggtctcgatttcctgaccttgtgatccacccacctcaacctcccaaggtgctgggattacaggtgtgagccaccgcgccccaccggggatgtagaagtcttaaggagaagatgaagtaattggaattgtatgggcttaaagttcactaggaaaaaaaagagaaccacacagccacttcacctgctccttcctttttgtcaaaggatgtatgtctggtcttccagaaatagcactggacttggcatctcagagcacctacctgggccctaatttctgtctcttccatggccagctatacgacctcgaacaagtctctatcttgtcacttttttttttcagtcagtaatgtgaactctgaaatccttactgtgtcaaaaacgtcaaatgctttttttttttaatcaagtaatctttcccagcttgatttcttaatcctagttaactgtgatcacattaatgatttgctaccttagaatggcttaatgaaacccttgggccatagccatcctctgcagagctgggtgttccaaatggacattccacagatgtataaaaacaggtggtaactgctctaacaacgcaggggcattctgtgaatcacagcttcaacatttgaaagacttgacatgaaaaaagatagattggattctaaatccactggcattttgacaagaaatttcaactttacttttgccaacataaaaaaagaagagcttctttaaatgcaattttaaatgtcttaaatttgagtgatctttaaaaaatttagaagttttagcctccatttgtgcaaatttttcactgatggtgactattagaaatccgagagattaaattaaaactctcgatcaggaactgcaggtagtcatttcaaagataaaacctacttaaaagtttgcagatgtaagctcaagtttctcaataacactttaaaaatactttattaggaagtgttataaaattattcaatatttaattttatacctactatataatcttggttttacaagtattatataaagaaaatttagtttttttaaactaagctccacttaaaggcctcaaatcccctcccgttaatcccagtctgccaaatagacatcctgtgaaacagatgttttgccaatctgtgaaaaacattgggaagcattattttagggtgtatacctatgggtggaacacttcattttattcaatagtcatcctttccctttctgatctgcagagagagttgtgctgtagataaattttcatccatgcataggtctgtttccgagctctgtgtccaattccatcacgttttttctatctgtgcatcaatgttatactgttttcattattatggcatttttataagtcttcatttttgataaggcaaattcctctaccttttttttaggagtatgctcactctttgatttttaaataattaattagcagactttattttttgagcagttttacacgtatagaaaaattgaagggaaagtataaacagctctcatatagcccgtcgcccccactcctgcctgcaggttccctcattaatatcttacgttagtgtaacacatttgttacaatggatgagcctctgttgatgcttattattaattaaagtttatagtttacactaaggttctttgtgttacacatctgtgggttttgacaaatgtataattacacgtattcatcaatatatcatacacaacagtttcagtgccctacaaatccctgtgctcccaccgattcatctgaccctccctcacttccccaccacccgaacccctggcaaccactgatctttttactgtctccatagtcttgcccaaaaaatatggttggaattatatagtatgtagccttttcagattggcttttttcacttaacaatgtgcacttaaggttcctctatttcttttcatggcttaatagatcatttctttttagtgctgaataatattccttttatagatgtaccacagtgtatttatccactcacctactgaagaacatctttgttgcttccaagctttggcaatgaaaaataaggttattctaaacatctgtgtgtaggttcttgtgtagatgtaagttttcagcttatttgggtaaatactaagacgtacatacagctgctggattgtatagtaagaacatgtttagttttgtaagaagctgctaaaatgtcttcctgagtggctgtaccattttgcattcccactaagaatgaatgagcgttcctgttgctccatatctttgtcagcatttgttggtgtcagtgtttcggattttagccattctaataggtgtgtagtgtatctcattgttttaatttgcaactcgctaatgacgtatgatacagaacatcttttcattgcttatctgccatctgtatatcttccttggtgaagtactgtctcttttcaagtcttctgtccatttttttaattgggttgtttattttcttattattgggttttaggagttctttgtatattttccatatatcttttaccagatacatgttttaccaagattttctcccagtctgtggcttctcttttcattctcttaaacccattgctttttataaatttaggatctgtttaagttaaaaacaaaaccctgttgggatttttattagaattatattgattctatagatagtttggggaaaaataacatctttacaatattgagtcttctggtccatgacattgatttagatttcacttaatatttgtcataaatatttataattttcttcatagaggtttttactaatattttagtagatttattctaagtattatattttgttgctgttggaaatgttatatttttaaagatttgtgtttgatatttgtttctggtgtattgaaatacaattgacttttagatactgatcacaaccttgctaaatgctcttctcaattcaaataatttatcctaagattatttggggattctgtgaatggcaattttgtttcttcctttccagtcttcatattttaaattttcatgcctattaaactagttaaaacttacagggcaatattgaattacagagtgatgatagcaggtatactgattttaaagaaaatccttttactgttgctctattaaatataatgcatgcttaaatgtttttatgtataccttttctagggtaaagaatgttcctttcatccctaatttgctaatgggcttaatgtgaatgtaagtgttgagctttattgagggtttttttttttttttttttgcagctaaagaaaaaattccttttgcctttgttacccacagaaaccaattataactcaagaataaacctctgcctttgaaacatgcctgaactggcctctgcttgacagcactacccagtgggtcatcccagaaacccaggcctctcaggattagcaaaaattttcattgatttattgagataataagatattttattattccccatttagccaggaaattaagttagccaactaccggaaattataaattgatttatcttaagcagtatgtaactccaagtgcataccttggtgcaaaattaaaaccatgagttaaacatatttccagtggagttagcctaggaagcattcagttcagagacactggacagacaaatgcagtatcctagcatataggaagagcaaagttatttcatttattctggcagcttagccaccccacaccacatgcaatgtgcctacattgaagacaaaacgctcaacaacctggagaggggatgagggagggagaagtagaaaacaggcagacaatagcaatagtgagattctctagtggcagagtatagcaagtggatgttgtccagtgagccaatggaagcactgctgtagtgtaagagtccaattgtattagaatccattaacttttctgtgtttatcatacactaatagtaaaatatttacttttactgtgtgtattagcttgaaataggcatccttcacattgttttcttgctggatgctttgtcccaagtttttactgacgcctttggtttcaggtactttggctattgtatagaaaattgttggccaggtgcagtggctcacgcctgtaatcccagcactttgggaggccgaggtgggtggatcacctgaagttgggagttcaagaccagcctggccagcctgcccaacatggtgaaaccccacctctaccaaaaatacaaaaattagccaggtatggtggcgggggcctgtaatcccagctactagggaggctgaggcagaagaattgcttgaacctgggaggcgaaggttgcatggagccgagatcatgccattgcacttcagcctgggtgacaagagcaaaactccacctcaaaaaaaaaaaaaaaaaaaaaagaatattgttcatataccgttttgctagttcatttctattagtgtttatgaaagtttattcaaatttatttcaagttatttacttttgctttccattatttgttggaagattgtattgatatctctatagtattctatgtagg

SEQ ID NO: 11843 - DNA, 35574 bp, Human
tggaatatatacatggaatatatatatatggaatatatacatggaatatatatatatggaatatatacatggaatatatatatatggaatatatacatggaatatatatatatggcatatatacatggaatatatatatatggcatatatacatggcatatatatatatggcatatatatatatggcatatatatatggcatatatatatatggcatatatatatggcatatatatatatggcatatatatatggcatatatatatatggcatatatatatggcatatatatatatggcatatatatatggcatatatatatatggcatatatatatggcatatatatatggcatatatatatggcatatatatatggcatatatatatggctatagagatggcatatatatatggcatatagagatggcatatagagatggcatatagagatggcatatagagatggcatatagagatggcatatagagatggcatatagagatggcatatagagatggaatatagagatggaatatatatggcatatagagatggaatatatatggcatatagagatggaatatatatggcatatagagatggcatatagagatggaatatagagatggaatatagagatggaatagatatggaatatagagatggaatagatatggaatatagagatggaatagagatggaatatagagatggaatatagagatgggatatagagatgggatatagagatgggatatagagatgggatatagagatgggatatagagatgggatatagtgatggaatatagagatgggatatagagatggaatagatatggaatatagagatggaatagatatggaatatagagatggaatagatatggaatatagagatggaatatagagatgggatatagagatgggatatagagatggaatatagagatgggatatagagatggaatatagagatgggatatagagatggaatatagtgatgggatatagagatggaatatatagatggaatatagagatggaatatatagatggaatacatatatattccattgcattgttctttacaaacattcatttaattatgtaattgctaattaattgcttggttgttataacaacgaagtatttgattccttattttatctcatcatttaaattttatttcgcatattttcacaatgcactggatctattactgaggaatttaattaaataatcattcgaaccatgggctcgaattgtttactgataaagcccgacgaccaaaacagcctagcgactgctgtttggagcccctcggcccagggcccgtggctgttctctccaagggaccatctcgcccctcagccaagtcgcccggaaaacgagcgctcgaccgcctctgccccgctctcgctctgcacacagcaacggtctggtcgctcagccacttcctccttccagcctcatctggttcccaggccgctggggactcccaacgccactgtccaagactctagggtcagcaagcgccccgggcggagaagggcgaggacgaagagcgccgggccgcgaccaggagcccacccgcgccctccgactgcagacatggggaagagacgcgggaactccaaagtcgctgggtctgcgcaggtgtgtgccgcgatcctgtgaaggtcaaggcctcctgtgagggggagtcgtcctggaatgcgatggtgaagtgctccagaccggccataggccggaaagagtgaggaagaagagaatgcaggaggcctgcgatttctaaggcgcgcgcgcacaggggtgctgcaattaggatggggcaatgggagcttggagaaggggtgctagctaggaggaaaggcgcgtgcgtggaggaacggcgcgtgcgcggaggggcggtgtgtgtgtcagaagaggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtgagaggcggggaggagagtcttggcgcagggcgggaggtagggcacgcagctgggctacgggggcggcgatgctgttgggggcgacagacgcccagtctgggaaaccttcggtccactttgccgcgccaaagattaaacccgacctgggctcgcaaatcaaccaggagaaagtggtgttctgggtcctctcttgccgcttgcctgtggccgtgtacgggtcctcgggagcgcccgggtcccacccccgtgaaatggcggtgccagagctttgtgtcgagtttgattctttccgggaaagtaccgcggctccgctggtctgtttgataataaacaaaacatttcccgaaatgcatttcctcaatctggtgaataggcgcccagtcccacgggggagtgagctaagtgtggccaggatttctctgccctcaggattcatacaggccaataaaaaatgacagtcggagtgactgaagcataattgtcagttctcgaggtttactaagcctgcttcagggcgcatccgggaaaaacgtgagccacaaacacgtctgtgactggttttccagaggttttcaggaggtggggcaggaaggcagtaaggcaaatagttctgtgagaatttagttagtgcccaagaaatctgtattttaagataccatgagtgtcttgaagagaaaaagagagtaaagggagtcagttatgcagatgcctctgggtagatggagtcttgactttgttttgcacctgagaagataagcttgtaattgacatggtcagtgtggaaggcctgaactagtttttcagattaactttggaatgccatttgttgagaggagaggtccattcacattgttggggggcttagaattttatttttggtttacttaactacctacttttttcccaaagaaataatcatgttcaaaactcaatgaaatgttatctcaatgagattgtaatgttgctcagtctttcagaagtcataaaaatagtcatactttttaaactagtaaatgcaattctaggacccaagactaagaaaactgtccaaaatatgggaagacatttttatttatacttttttttttttttttttgagacagcctgttgcccaggctggtgtgcagaggcgtgatctcagctcactgcaacctctgcctcccaggttcaggcgattctcctgcctcagcctcttgagtagctggaattacaggtgcacgccaccacatccggctattttttgtatttctagtagagatggggttttgccatgttggccaggctggtctcgaactcctgacgtcaaacaatccacttcagcctcccaaagtgctgggattacaggtgtgagccaccacgcccgatctatttatgttttagactttagttttaggaactagacttaggttgtagacctgaagttacagttggcatccccttgtttatgggagaccagcaaagaattgacttatgaatgatctgtcggggtagcccttcgcagatggctgagtctttttatccttccttggggatttggctgaagcataatgctagtaacagccattcatttggaagagggtgttgcagtcacttggcctctgggcttaactaacttcccttttgcgtaagaaagttgggagaggtcctgagatttttttttttcttttaaaaaataataaaagaaaaatacaaaggcagggcgtcaccaggctaatttgctgaaattcttcatacttacttgggatgcatgggggaatggcaactattacaaggttgatagagagtgagaggtaattttgtagtgaggaggggtacccaaagagaatcagggctagcatcccagtgcaggagtccaggtggtctgtgagcctgcaagtgagttcaaaatactttacctgttggcttaggaaaccatatacctgtgtggtacatgatatcctatttctcaaacttttccacaaatatgtagtatacttttcctaggatgtgggtactagggtcctggtgcatcccatagtaatttctttgaagtcttttgtttatgaaaaacttgcattaaactcatgtttggtttgatgtgaaaaaagctttcccagaattttcatataaaattgacattccaggagggtgtgcattaagaaattaatttaaaattaggttagcggacaggtggcaagatataatttataggcatttatcatttcttaagctcttagctgtgtgccaggcagtaatctaagtgttttaaaggtataaactcattaagctttcagagcagtgtagatactgttatgcttagttaacagacaaggaaactgagcaacggagagatcaagtaacttgcctgaggctgtataggccagtccgtggaggagtgggaagtcaaatcctgagtctggactaatagccttggggcttaaccagactagactgttttcccaaaggccaaacaatttaaattcctgattgtccacttgtatgttaagggcctaattatcagtatctttcagttaactgtgagcccaaaaatatctgagaccggtctgaaatcaacttagaaagtttattttgccaaggttaaggatgcattcatgacacagcctcaagaggtcctggccacatgtgcccaaggtggtcaaggtccagcttgcttttatacattttagggagacatatcaatcagtacatctaagatgtacatttgattggttcgatctggaaaggcaggacaactcaaagcaaggcttccaggtcataggtagatttaaagattttctgattggtaattggttgaaatcaatggaaaggaatgtctgggatgtcctaaggggttgtggagaccaaaattttatcatgcagatcaagcttgtccaacccacagcccactggccgcgtgcagcccatgatggctttgaatgcagtccaacacaaattcgtaaactttcttaaaacatgaggggtttttgttttgtttgttttctttctgtttttttgtttgtttgtttttagctcatcagatattgttagtgtattttgtgtgtggcccaagacagttgttcttccagtgtggcccacggaagcaaaaagagtggacacccttgatgcagatgaggcctgcagatagcaggcttcagagagaatagattgtaactgtttcttgtgaaacttaacgtctgtgttgttgttaatggtggttagctttttctgaattccagaagagaggagggtataatgaggcatatccaaacctcacttcgcatcatggcctgaagtagtttttcaggttagctttggaatgcccttggtcaggagaaggggtccattctgatggttgggggacttagaattttatttttggtttacgtaactatctactttttccccaaaaaaaatcatgttgaaaactcaagaccttaagtttacagctcaagctgatcctgaaagttatctcagtgagattgtaatgttgctcagtctttcagaagttgtataaatgtaccttttagcctagtaaatgcaattctaggactctagattaagaaaactatccaaaatatgggaagacatttacttacatatttgtacagatatctatatttggatttatgtcagacttaaagatatagtaaaccattttggtcgtgaaaatgaatgtgaaaggttgaaagcaaccaaaattataaatgcattatatatatattagattaaatgtccatttatacatttacatgtggggtaattaattgttaatatactaatataaaacattttaatatactagtaaattaatatattgtatgttaatgttacataacaatttatgaaaaaattattaaaaggagattgccaataataatagagcaaaatctgtgaaaactaaaatcctgtttaataactttatttccaagcccctgtccatttatcagtcagttatttgttggtcttccaaatgccaacatgcctgtaacttcagggtctccttcttttagcagtaaaggattttttttctccctgaggaaatcactagctgtaccctataacattttctattcttgtctcaaggcccaaaattactagaattataatattctgcacaagatattgtaaatactacaaatgccatcagatcttttgttaaactctgtaaacccagttgctaccctttggctgcatagaatctataaattctaacaaatggatgagaaccaagttaagaattctagagtgggataaggggatgtgatgtattctattcagggatgaagttttagagactccaagtatgaaacagaaaattgaggatggggagacctgatgggtaccacattaagtttaaaaaaaaaaaaagtgttttctcagctgtctccccttttgaccccatactataagatctaactggaaagagcaagaagctgtctcagttaagaaagttctatacaagaacccctgtggtagaacaagtctacaacaagataacatgattgccccaaggcagaagtaaaagaaatattgtaggaaccataaatgaatttaaaagctgatcttttaaaaaatatataacttatcaaagtgagagatcagtcctttatgatatttaaggagttcctgtgaatgcaccattatgctggatactctgaaaaaatgcaaatcaagtatgaagcgatataaattctgcccttaaggaacttgcaatctagttggagatttatgtttaacacaaagaagcagtttttacaaatacttcttttgaggattctgggaagatggcagagtagaaagcaccaggaatctgtctcctcacctagacaagaattgtactggcagaatctgatgtaactattttggaactctggagtctattgcaggcttgcaacttccaggggacagacttagatggtaaattgcagttaattttggtctatttgagctcttagtacagtagcagctacccatcttccacctctcaacccttagcagacagctgtgcacgttattagagcaatctgcacacaacttacaggaatcaggtgggcaaaaagaaacacaccatccagatatctgggatctgtgctcttgattggtcattgctccttctcgtcacaaaagcgcaaagagatgggcggttgttgttgttacaccttactcattgttacaaccccctccccactcactcccctgccccatggatttaaagggctagaaatctccctctgcttcatttttctctttcacttttgggagccggatattaaagactaggacatttaaaaacaactgcatttatggggaaaattagaaagtcactgtacatacctagggaaaggctcaggagagaccttaagtttatagctcaagctgatccttggcacaggattaacaacaattacacagcaattaaacaaagcaaacacacacacacacaatgtagtctgggagagtgatgttagcaagatggccaactagaagccccttctgctcatcccctcataagacagccagaacaacaaataaacaactacattttagcaaacttaactaagagtgctagagtgcatcaaagaagtaacagaaatcctagtgagcagagaaaagtgggatggccacatggagaatgggaggaaatgccaggattcctaggatcatctgggaacgaggaggaacttcttcctatggcaaggagataaacaagaagatcccagctacaccatgggcaccaacagatctcaccactggggttccttagagtccagacagcaactaagccaagctgaggaagctgcctagagtctgcacagctgtgttccctccagagaaggagccaacactgtgctccacctgctgtggcccacacagctactgtgccactccaccttggaactggaactacttctggagtgtgtcttgcttcggggacttgtagccatggcttcctttcatctgaaccacgccaggctggtggctcaacatccctaagctaaactttaagcagctgttacacccttccctgtggagtcaagcagaggtggaactactccacctactcctaccccactgcccttgggctagagctgaagcagtatcctatttcctgggaacacactaccttggccacccagagcagtcatgcacccctgtgcctaagctgaagtggtatatggcattccagggaaacagggcctgaaccacccagagcagtcacactccccgggcctcagctgaaggagcacatcactccctgcagaatcagtgccctggccaaaccgagcagctatgcatcccagggctgagctgatgtagtatcctatgtctcagggaaacagagcagtggctgagctgagacaccctgttctacaggccaaataactgtagtaccccgcttccctggagctggactagtcctctagagcctgagctgctgagacactctgaggagtggagtcatcactgtgctgttccctaccccccattcccagcccagacaacagctatgcttcaccattttgtagtacttgctgctgctgctacacttggcctcacagtctggggtactgcttatccctagctattccaagatttagagtcatgacttcatggtgcctcatcccttgggacctgtgttgccactgagccctattagctcatattcccaaattaaaaccataccctgctccccaggcccaaacctccagagaaccccttctttatagtcaggccagtgctatgccctgacccccataggggtagaatcaaagctacaacgcattctctgggcctaagctgccaggaagcacctccaggtcacaaatcctggctctgtgagcaactacgtccaagccctgccacagagagcaaacccacctcagcaaccaagtgtctcaataggtttgtgagatcctgagcctaggacctttgcccagtagccactctgaataccttcatctggaatcaagagctgctgcagctgcatatatatagcccctgtcagacctgacaccaagaggtgttgccttggctgagtctccccattgtggggaagacaagaataggaggatcctaaaagccttcaacactgagaacattaacaacctacactaccactgccacaaacttctgcagcctaggcccctgaggcacccatttactactgacattgaacacaggtaaagcagctgctttaccataccactgcatctgtcaggaaacagtcaccacacccttcgaaaccagcatactgaaacccaactgctaataaaagactttatctttgaaagccactgtctgtaaagtttggaagaggtaattatcctatcaacacaaagacacaaaaacatgaaaaagcaaggaaatatgacaccaccaaaggaaagtaagaactctctaatggtggcccaatgaaaagaagatcaacaaattgctggaaaaggaattcaaactaatgatcttaaggaaactcaacaagatacaagaaaatacagatagttcaatgaatcaggaaaacaattcacaatacaaaaaattcaacaaaaaaattaaaacatgatgaaaaacaaccaaacaaatcctacagttgaagaattcaatgaattacatttaaaaaatacaataaagagcttcaataacagacttggtaaagcagaagaaagaatctctgaacttgaagatataccatttgatattacttaattgtagaaaaaacaagtgaaaccctacaagacttatgggacatcattaaaggaacaaacgttcatactatgtaagttacagaaagaggagaaaaggtaagaggcatatacaaactatttaatgaaataatagctgaaaacttcccaagtctggagagagatacagacatccagatccagaaagctcaatgattcccaaatagatttaacccaaaaaggttctctccaaagcacattattatctgttgtcaaaagtcaaagacagagaaagaattctaaaaatagcaagagaaaggcatcaagtcacatttaagaaaatccccattcagctaacagcagatttcttcacagaaaccttacagtgcagaagaggatgggatgatatactcaaacagccaagaatgctatgcccagcaaaactatccttcaggaatgagggagaaatacagtttttcccagacaagcaaaaactgagggaattcatcactgctagaccagccttatgagaaatgctccagggagtcctacatctggaagtgaaaagagagcagtcagtatcttgaaaacatggaaaagtataaaactctctgatagagcagatacacaaaggagaaagagaaaagaattaaaccttatcaaaccatcaaaccacaatgataaataataagagaggaagaaaggggcaaaggatattattagaaaactttaacaaaatgacaaatgtaagggctcaaatatcaataataatcttaaatgtaaatggattaaattccatacttaaagagactggcggaatattttttttttttctttttttttttttttgagacggagtctcgctctgttgcccaggctggagtgcagtggcgcgatctcggctcactgcaagctccgcctcccgggttcacgccattctcctgcctcagcctcctgagtagctgggactacaggcgcccgctaccacgcccggctaattttttgtatttttagtagagacggggtttcaccgtgttagccaggatggtctcgatctcctgacctcgtgatccacccgcctcggcctcccaaagtgcggaatattttttaaatgactcaattatatgctttctataagaaacccacttcacctataaagacacatataaactgaaattgaagggatggaaaaagttattccaagcaaatggaaaccaaaagctgtcaggaattgctatacttatgtcagattaaacagacattaagtcaaaaactgtaaaaacagacaaagaaggttattatataatgataaagggaccaattcagcaagaggatataacaattctaaacatacatgtacccaacaccagagcacccagatatataaagtaaatattactatacgtaaagggaaagatagactccaatatgatagtagttggggacttcagcaccccactctcagcttcggacagatcagcaaactccaagtacagtgaactcaaagagaccacaccaagaaacagtcaaacttttgaaagccaaagacagagaagtgacttgtcatacacaagggatctttgataacatgatcagcagatttctcacctgatactttggagaccagtgtattcaaagtgctaaaaaaaacaaaaccaaaaaactcaaaaccctgtatatggcaaaattgcccttcaaaagcataaggaaattaagatgttcttagatagacaaaagctaagggagttcattaccgctagaactgccctgcgagaaatgcttaaggaagtcctgaaaggtgaaatgaaagggcactagacagaggggacagtgcagattcaggcaggtgcaatggcttctggggaagacccagccagtggggctattgccagcatccagtcagctgccaccttccctgaccccagtgtcaagtgatgcgcagggtgatccaggtgtgtgaggggcagctggatgtccagactgagggcactggtgccatcagtggctatcctaccactcaattcatgacccaggtggtgatccagggtgatatcaccagttatgatgcagttaacacagaggggaaagctgctgagatacactatactttcccacccctgcagtgggagatggggcagggggtaccacatcagggagtacagctgctgttgttactacccagggctcagaggcactgcttgggcaggtgactcttcctggcactggtcaattatttgtgatgatgtcaccacaaggagtactgcagggaggaagccagcacttgattgcccctaggactcaaccttatttatttggacgtaacaccattgtaagtcaagaagcatctctatctatctatgaacatacaatgtgaaatcaaattgaggccataaaacagttgaacctcatcataagagtgactcatcggtgtcacttctaagaccaagaaaaattctatttttatgcagagaccatttgttttttaattaaaagacaactctatttcaaagaggaaaaaaaatcaactcttttttcagctctctcagatgcagaaatgtaattatcagcatccctgtgctgggagcaatcattagtttttttagatttttaaaatatacttcattatgtttcactgtattcattctttaatcagggatgtgagggatagaataacatttagaatatctgtacagtttgtatataatgttcttatttcttgttgcttttataggtggaaaaaatctaaaatctcctcaaaaagtagaggtcgacatcatagatgacaactttatcctgaggtggaacaggagcgatgagtctgtcgggaatgtgactttttcattcgattatcaaaagtatgtgactctacttactgatttgtcagaatgacctgaataatttttacaagtttaacaacaccataatttttagatttggaaagtgtttggtttttctattttttagaaatgttacgcctattttacataatatttttaactttgtttctgtagagacttagtcaaatacatctttgggtgttgaagcaaaaaattggggatgagggtggtagacagcgtctctaacccatagccattccttctttcttctgggtgttccagcttcttttttttttttttttaattattatactttaagttttagggtacatgtgcacaatgtgcaggttagttacgtatgtatacatgtgccatgctggtgcgctgcacccactaactcgtcatctagcattaggtatatctcccaatgctatccctcccccctccccccatcccacaacaggccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagctccagcttctttcaatataagttggggtctgagctagggtatatcttgaagatatggcattgtactccaaaaggtccatcgaagaccttggaataggccaccaggtttcctgtgatcaggctttcctattatctccatgatatactatattttaattttaggtacactttttttttttttttttttttgaggtggagtcttgctgtgttaaccaggctggagtgcagtggcacaatcttggctcactgcaacctccacttcccggtttcaagcgattctcctgccttagcctctcgagtagctgggattgcaagcacatgccaccatgtttgactaatttttttatttttagtagagatggggtttcgccatgttggccaggctgatctcaaacttcttacctcaggtggtctgctcacctcagcctcccaaagtgctaggattacaggcgtgagccactgccctggcctagatacactttgtaaatatattgttaactgggcatggtggcatgtgtctgtaatcccacctacttgggaagctgaggcagaagaatcgcttgaacccaggagacagaggttgctgtgagccaagtttgcaccactgtactccagcctgggagacagcaagactccatctcaaaaataaataaataaataaaataaaataaaaatcgatatattggaccttgcatttctaaagactcagtttttctggagtgttgatgtctcttccttagtactttctacttaattattcaagaggagaggcaggcagaaggaggaatatagaagggaacacagatcaggaagtacagtactttgccttccgattatgtgttggggccccacctgccaaccatgttcccctgtccaagaaaaagcaggcaatgaagaaataaggcattaggccctccggaaccaggagcccaccacttcagccacagctgtgacactattctcgagttgtaactaaaactggcatatgaatctcacagcttcagtaattgtgtatgcatatataaacaaatacacactgtatatatgcatatatacactatatatatacatactgtatatatacattacactatatataatacatactgtatacatacatatacacacattgtgtatacatacatatacacacattgtgtatacatacatatacacactatatatacatatacacactgtatatgtatatgtatatacacacacaaattcatatatgacttttctcagaattgatcatttaaaattttttatctctagagattttcattaaattgaactttgagtttggttaccagttttgttttttcccttagtttggaatttccttatgaacaactattttaggtagagaaggaattatttcagatacccttatttaatgttacttgtataaagaaactatttgcaaaatatgcatccaacaagagcttaatatccaaggaactcaaacaatcaacaacaaaacccaaatccatcaaaaggtaggcaaaagataggaatagatatttttcaaaagaaaacatacagtggccaacaagtatgtgaaaaaatggtcaacatcactctaatcatcagagaaatgcaaacgaaacctgccatgagatattgtctccccgcagtcagaatggctgttattaaaaagttaaaaaaggctgggcatggtggctcacacctgtaatcccagcactttgggaggccaaggcaggtggatcacctgaagtcaggagttcgagaccagcctgaccaacatggtgaaaccccatctctactaaaaatacaaaaattagccggatgtggtggtgcgtgctgtaatcccacctacttgggaggctgaggcaggagaatcgcttgaacccaggaggcacaggttgcagtgagctgaaatcgtgcccctgcactccagcctgggtgacagcaagacttcatctcaaaaaaaaaaaaaaacccaacaaatattgaatatatttcatgccaaacactcttctgactgcttagactgcctcagtgaacaggagaggcaaagatggcatgaagttatattatgaaacggatttcatgaagtaaatattacattagttacatattcatatttcatattctgttctgagctaattattgcatatgataatagtttttttgttgttggttttttttttttgagacggagtcttgctctgttgcccaggctggagtgcaatggcgcaatctcggctcaccgcaacctccgcctcccgggttcaagcaattctcctgtctcagcctcccgagtgcctgggattacaggcatgcacccccacgcccggctaattttgtatttttagtagagacaggatttctccatgttgatcgggctgatctcgaactcctgatctcaagtgatccacccccctcggcctcccaaagtgctgggattacaggtgtgagccaccgagcccggccaataatgatttttttaagaaaatataaaagtagcttctgctgcaatatcttgattagatgtaaaacagttttaatggagcatgcttcagcatctcctgaagtaggaaagacagatgtaaacagtgaggttgggttgaaattatattaagttttaaatttttgataaggttttctgtttataatgagagtttctggatttttagaaatagattctgatgtggaaccttttcaagaatgtttaaggtatttttaatgccagctctaatctcaggcctcagatatgtaaaagtggaagtgaaaactggccaagaatgaagtatttcatatgctagtgtatatttttggtaatttcttaaaaatgtttccattttgaaaaacaaggtagacttgtatttggttcagcaacaaaattattttggtattatctctggtttctaatatctaaatcgtctttaaaatggcatctgtgatattattaaaaataaataaatcagctaatgaattaggcttgacaaaaatgccttcccagaagatagtttctctgctacttatggtcaatgggcttaacataggtaaaagttctcaaatctgctaaattggccgggcatggtggctcacgcctgtaatcccagcactttgggaggctgaggtgggcagatcacctgaggtgaggagtttaagatcagtctagccaacatggcaaaaccccatctctactaaaaaaaaaaatacaaaaattagccagacgtggtggcacacgcctgtaatcacagctagttgagaggctgaggcaggagaattgcttgaacctaggaagtggaggttgcagtgggccgagattgcaccactgcactccagcctgggcaacagagtaagactctgtctcaaaaaaaaaaaaaaaaaaaaaaagaaatctgctaagttcgtttctatccctcactttccctgcaagctcttcttcccctttctgggcaacatgtccttttctgctttaggcactccatgcccactttatttttcatgtttgccccttttttgaaaggaagaatctaatatcacttcagctttctgattggccagttccacttccaaaaatttatttgtttatgtaaacattttcagttttgtggtttctgatgatgtaatagaagaaattacggagacaggcaagcagaagggatggtttgcttttggagagggcagaggaaaccttgaaaccatactgattctgaggtctttcttagggaaggtaagtctattcataggaggaggtcagaagggaatcatcaaatccaattccccagtttctatttaattttattttattagagacagggtcttgctcggttgctgaggctggagtgcagtgatatgatcatagcctactgcagcctgcagccttgaacccctatgctcaaatgaccctctcacctcagcctacccagtagctaggactgtgggcatgtgccaccatgccctgctttgcctttttttttttttatttctcatagagacagggtttgctatgttgaccaggctccaaactttcaataaggaagataagatccagaaacacaaaatagtttaccaaaagtcacacagctatttttaacagagccaacatactaaatccacttttaccttatgggtcatttatttctctgcttcctgaagcaaccacccacaaaattatataaagaactgtattttaaaattcagtttcataagtaataacttggcttatatgcattgaaaaagagtggaagggtgtatgctaaaatgttaataggacattagctcaagtagaagaaataactcttaaaccaaaaatagaaataactcttaaacaagagttattaagagttaagaaataactcttataccagtaaatagaaagtatttgacacttacatttatacatttgctcactcattcatttgttttttttactttaaagaactgggatggataattggataaaattgtctgggtgtcagaatattactagtaccaaatgcaacttttcttcactcaagctgaatgtttatgaagaaattaaattgcgtataagagcagaaaaagaaaacacttcttcatggtatgaggttgactcatttacaccatttcgcaaaggtaagaaaaagttgctagctgaattatattctttagtaaatattaccagagcagttcactttccaagccattcatttgcatgatgcaaaatctaacatcttttaaaaagaacaaaaattcccttaaacctatatcttcttcctgctatggctccatttgtcctactttccctgtagtagtggttctcaaagagtgatcctcaaggccctttcagggggctgtaaagacaaagctatatttatgacaaatctaagacttagttgcctttttaatttttgttctttcttgtattcacagtggagttttccagaggaggctgtttgatgtgtgatgtggtgatatggtcactgatttaacatagaattcaatgtgaaattcatctgccttctttattaatccaaacattcaaaagatttggaaaaaaaatgtaaaacagcaccactctgaagtttctatgttccttttggcaaatgtttgttaccataaaataggtttatcattgttatttctttctttttttttttgagacagagttttgttcttgttgcccaggctggagtgcaatggcacaatcacggctcactacagcctctgcctcctgggttcaagtgactctcccgcctcagcctcccgagtacctgggattaccagcatgcatcaccatgcctggccaattttgtatttttagtagagacagggtttctccatgttggtcaggctgacctcaaactcccaacctcaggtgatctgcccacctcaacctcccaaagtgctgggattacaggcgtgagccaccatgcccagtccattgttatttcttaatggattaattagttaaaatggattgaaaactttaccagttttaatgtttaatatgctaatataaaaatatacagcccacataaataatggctgtttgggattctcgataattcctttaagaatgtaaaggagctgagtgtagtggcccacacctgtaattccaacactttgggaggctgaggtgggaggatcacttgaggccagaagttcaagaccaacctaggcaacatagtgagaccccatctctacaaaaaatatataaaaattagccaggcatggtggtgcacacctgtagtcccagctattcaggaagctgaagagggaggatcacttgagcctgggagatcaaggttgcagtgagctgtgtttgtgccactgcactccagcctgagcaacagagctagaccatatctcaaaaaaaagtggggatcctgagaccaaaaggtttgagaaccactgccctgtaccaagaatgatctgtactccctttctatactaatcttccaattccctgtcagccctctccattcaaattctgttcctcctcacttaaaaccactctttttggccaggcgcggtggctcacgcctgtaatcccagcactttgggaggccaaggcgggcagatcacgaggtcaggagatcgagaccatcctggctaacacggtgaaaccctgtctctactaaaaatacaaaaaaaaaaaaaaaaaaactagccgggcatggtggcgggagcctgtagtcccagctactcgggaggctgaggcaggagaatgacatgaacccgggaggcggagcttgcagtgagccgagatcgtgccactgcactccagcctgggcgacagagcgagactccgtctcaaaaaaaaaaaataaataaaccactcttctcaaggtcacagcagcctccacaatgccaagcaaattcccagtcctcttctggcttcatccctctgtagcatagatgtggtcatcactcagtttttcctttactggatctctgggacactgctctttcctggttctcctcctgctcattgatcgcttcatcttcccaacttttcagtgttagactgctgctgggctcagtcattgaacctcttctctttctgtatcactccactggtgatcttacagctttctatcctatctgtatgctcttaactcccagaagtggcaggcacatattaagtgctcagaattatttgttgaatgaaggttttggcattgtattaataaagttccatagtaattgttttgatttttttgcagctcagattggtcctccagaagtacatttagaagctgaagataaggcaatagtgatacacatctctcctggaacaaaagatagtgttatgtgggctttggatggtttaagctttacatatagcttagttatctggaaaaactcttcaggtgtagaagtaagcattatttttacctctgtttaatcgatgtgagagaaaaattaggcgaattaatcctaaaatttgactttatacttttttaaagaaccaacttatatttgtgttataggaaaggattgaaaatatttattccagacataaaatttataaactctcaccagagactacttattgtctaaaagttaaagcagcactacttacgtcatggaaaattggtgtctatagtccagtacattgtataaagaccacaggtaaggaagatgttttgttttagattcaataaatatataaacagattgtcaattttggcatcttccccatattgctgaagtttacatgataggtcaatatatgttaaaaacattgtaacatttacataagcaaaataaatgttacttgggatttttgtctcaaatagtaatgaaaattaattctacttaaaagttcaggctgggcgtagtggcccacgcctgtaatcccagcactttgagaggctgaggtagctggatcacttgaagccagaagttcgagaacagcctcgccaacatgggaaaaccccgtgtctactaaaaataattagctgggcgtggtggctcacgcctgtagtggtagctacttgggaggctgaggcacaagaatcccttgaacctgggaggtggaagttgcagtgagccaagatcgcgccactgcactccagtcgggagcaagggggacaaagagtaaggctccgtcttagaaaaaaaaaaaagttcaaatattttgtaatgacaaaacttttcatttgttcagaatccacatgaagcaggaggtagctgaactatgagttctgcaagtgggaagaaaaggtggggaagtagttgctagtagacaagttattgttcaagaaagcatacctttgtaagtggaatgttaaaatatgaaagtatcctgatacatttagtaacatctttccaataattaaggtcaagggcaggagctgggatttgtttattttaattgtaaatttcatatgcttttttttttaatcaaacattacggaagggtttaaagtgaagtcttcttctcccttcttatccccaattccattcactagagataagcattgcttagcagtttgtgtatatcctttcacaacttttttcaggatttatgtaagcatatacacagacccacagtttcttgggttttgttttttaaaattacaaaataaaatcttactagaagtattttacagcttgcttacttaacccagtgtgttggggatattctatatcactcaatacagatctattacgttcttcatttgatcttagccatctattgcattctttcttttttacttatttatttatttatttatttatttatttatttatttatttttgagacagagtctcactctcttgcccagaatggagtgcagtggctcaatctcggctcaccgcaacctctgcctcccagcttcaagcgattctcctgcctcagcctcccgagtagctgggattacaggcgtgtgccatcatgcctggctaatttttgtatttttagtagaaatggggtttcaccatgttggccaggcgcgtctcgaactcctgacctcaggtgatccatccacctcagcctcccaaagttctgggattacaggtgtgagccactgcgcccggcctgtagtctttcaaatggctgcatagtattacatagtgtgaatacaaaccatatttaactattaccttataatgataaaatgcgagcctttatcttcttgccagttatctcacttgagtaaaaatgtgtgcttttttttatctgttctttggcttctagttgaaaatgaactacctccaccagaaaatatagaagtcagtgtccaaaatcagaactatgttcttaaatgggattatacatatgcaaacatgacctttcaagttcagtggctccagtaagttccattccataaatttccttttgcccagtttgttttgattatgcttcttttcgctctgcatcagtcaccaggtccttgcacacagaatgaccgactgggaggtgggtacgatatattggaaacgtgagaaatctcatttctaaccccagttctgccagtaactaactggatgacattgagctaatcgcttaacctccatgggcctcaatttcttcacttgtaaaatagatggattctaatatctggggttcttactggcttaagaaaaaaaagaaagtgtaactagttgcatgtgttatttccccaatctggaagactcgacagttgaccctgatctttttctaagaactcacttcttccatgagtccttaaaatgatctcagtccactcacttgttcaattcaaaaaattagccttcctattttctttattactttagtggttttgacaaaattttgtagtagatacttcggtgggaaagaaagttggaaagaactatgttctatgtggttgagcagaggctagctaaacatggatgaagtccaggcgctgcataaatgaaagagaactggcctggtgcagtggcgcatgcctatcgtcccagctactcagtgggctgaggcaggaggattacttgaggccaggaattgaggctgcagtgttgtatgatcacacctgctagtagccgctgcactgcagcctgggcaacatagtgagacccccatctctaagcattaaaatttttaaaaagctgataaaagagaactgcatgtagtttatattgattggaaaattgtaggagatgaatagagaaaagagaagaggaaaattaagtagaaggaaaaatgggttatggggagaaaagagatggaaagaaagatatacattggtggcagaggagtagagagagcaaaggcaagtatagctaagacaggaaaggaaaagtcagaagaaactggaaagaaacagaaaaaatgagggagaagggaagtgtaagtaccgctatgatcaatttctatcttttagtgttaattttgaaccaagggtgactggtagaatgcaaatgcatttatgtgcatatgtgccccacaatgcatatataacctcacaaaccaatcaggaaactgttcagtagtcttttgtgtatacctcactttcagaagtgaataaataatagggtcaccaaatagataatgagaggtatttctgatagctgatctctaagcttcttttgggtacttaccatattgtacaaagcactgaagaaatggaaagagtcagcagaatcaaacgtggttcaaaaattgaaagcagttagccaacattgcaaagtgttgtgtggtttaggactaaagagtggtatacaaattataagggttgcagaaattgaaaatgtaaaggtgaataggggctaaagagaccaaagaagccataaggaaagagataaggtatgaacaaggccttgattgttaattcagattttttttaagtagacaactattagatgttagttttctgtgtctgtaactaattaccacagacttagcaacttaaacagctgtttattgtctcaaagtttctgtgagtcaggagtccaagcgtggcttagctggctcttctgctaagcagtcaaggagtcagtcattcatacaagacttgggggccgctcccaagctcacatgttgttggcagaatttatttctagagctcatggtggctcacttcttagaggccatcaggaagggagagtctgacctctagatcctttttttttttttttgagacggagtctcactctgtcacccagactggagtgcagtgacatgatctcagctcactgcaacctccgcgtcctgggttcaagtgattcttctgcctcagcctcccaagtagctgggactacaggtgtgcaccaccacacccagctaatttttgtagttttagtagaaacggggtttcaccgtattggccaggctggtctcgaactcctgacttcaggtgatccacccgcctcagcctcccaaagttctgggattataggcgtgaggcaccgcgctcagccattttttttgtatttttagtagagacggagtttctccatgtttgccaggctgttcgcaaactcctggccccaagtgatctgcccacctcagcctcccaaagtgctgggattagaggcatgagccaccatgcctggcctagatcctcttttaaggggttcatctgattaggtcaggcccacccagaatagtctctcatttgattcaactgatttgggaccttaattacatctgtgaaataccttctcttctgccacttaatgtaacctaattatgagaggagggcctccatcgtatttacaggtcctgcccatgctcaagaggaggggattatacaggatgtgtacaccagggggcaggaatcttgggggccatctcagaattttgccttctccagtggggaggatgtccttctagagtagcagaacatttggacaccaggtggcaatgggaagaaagctgaataagtagaatgggacaagattagggtcaacctcaggctgtcctgtaggcttttggggattttgtgttggggtgatagttaacctgagctctggatttgaggaaggtgcatgcggcgacatggtatgtgggagagtggactaaggagacactaaagagagataaggaaaccagtcaggaggctattagagttctgggcttgaactgagatgcttttagctgttggtttctgggcaagttacttaacctctttagtctcgtacttatacttgctcttataaccccgcagtgtgtctctattttagcacttaatcagtgtccattggtatgctggcgcatgtttagcagctggctttccagaaagaaaaagtcctattttgtagtgtttgctgatttttatgatataaatattcccaccatggccactttcaagccaccagcctgatgtccctgaatatggagttgggaacatatgcacagtagcacaccactatcatatagctacaatagataaagatagccccaagagcttagaaaataaaatgtagtaaaataattaggacaagatgaatttatttattacctctgtctttaaaacaattttttatttgcaaatttatataacttaatttttagtaatggtttttctttaaaaaccagtttgtattttaggaggccgaggtaggtggatcacctgaggtcaggagttcaagaccagcctggccaacatgacgaaaccccatctctactaaaaatacaaaaattaggcaggcctggtggcgtgcacctgtaatcccagctactcagggggacagaggcaggagaattgcttgaacccaggaggcagaggttgcagtgagccaagatcctaccactccactccagcctgggtgacagagcgagactcggtctcaaaaaaaaagccaaaaaaaataaaccagcttgcagcattcctggaaattctaactaacagatgttcttgcatattgatatgagccacctccagcagagcacaacatgaccacagtctggaacagtctttggttttcttttatgttagatgcatatctcttccattgtttgtgagtttcctgagtgtggatactatttatttctgtaaccttagcccctaacatagtgtctggcaattgtaaatacttaataaatatctaatgaatttaaaaaatatttgtcttaaaagcgcctttttaaaaaggaatcctggaaaccatttgtataaatggaaacaaatacctgactgtgaaaatgtcaaaactacccagtgtgtctttcctcaaaacgttttccaaaaaggaatttaccttctccgcgtacaagcatctgatggaaataacacatctttttggtctgaagagataaagtttgatactgaaatacaaggtaaggcagtagtttttactggagattgtaattctctggtgcaagtttttaaaattgtttttctaattgaacattatttctttacaaattttttctagctttcctacttcctccagtctttaacattagatcccttagtgattcattccatatctatatcggtgctccaaaacagtctggaaacacgcctgtgatccaggattatccactgatttatgaaattattttttgggaaaacacttcaaatgctgaggtaaaaagactgtatagtataattttgtaacttagagttataattatgatttgggtaaataaagcttgaatgtaaaatttgggggaaatttttaaactttatgtgggctggatgcagtggcctgtaatcccagcacttcaggaggccaaggcgagaggatcacttgagcctaagggtttgagaccagcctgggcaacatagggagaccctgtctcaataaaaattttaaaaaattagcctggtgtggtggcgtgcacctatattcccagctacttggggtgggagggtcacttgaacctgggaggtcaaggctgcagtgagccatgatcgtgccactgcactccagcctgggtgacagagtgactgacagcttgtctttaaaaaaaaaaaatgtgattaactcagatattaacaaaatgaagattatgagcatttttcatgttttgcactgtagagttatgggtgagctgcatctgggccccagtttgcttttaaaatacagattcctgagcctattgttactgaatcattatctctggggatggaactcaggaatttgcatttttaacatgattcccatgtattcatctaaacctgggattctcagcactattgacgtttgggctggatagttccttgggagggggctgtccagtgcagtgcaggatgcttggcaacattctggtttctgcctactagatgccagtagtgttccttcctagttgtgacaaccaaaaacatcttcagatattgtcaaatgtcccctggtggctcctccaaggggacaaaaattggttcttatgggacaaaagaatttatgtagtacagttgtttgttttcctccaaaaccattggaaagcattcttccaaagttcagctttgcccaacaaaatcttattccttagtatttaattttatgatgggggaaggattaggaaaaaattgcccaaaaagttgtttagttggggaggtaatgaaaaaagggttgacaaacactggtctaaaccctaaaattcagataccactgacaaagataatatataccgtcagataatatacgtgtttcccagatcacttccccctcgtggacttgtagtcaagaatcgacctttaaaactcctgtccagtcaggctggtaaattctttaacttcacctcattttctattggaaatctaagcaaattccattgatttggctgcttccctttttaattgtctgacaaccctgtaaccatagcttaatgtagcccattgagaattatggtcggttttcagatgtctgtagatcagacaaacctaaatttctatctcactgctaaactgtgtaaccttacgtacgcagggtgctttacctcttggagactttgcttcctcttctctgaagtggtggtaatcataacaactaaatttttcaaaaggatgtttataaggtttaaaaggaagtaacaaatatgaaaatacctagcacattgctggacaagtagtagagattcaataaattgtagttgccatcttaacctatactggataatatatcaataattgttactatagaaactcttattgaatacttatatgtaaggtactatgctaagtattgtacatgaattgtctcagtcattcttcaaaacaaccctgccggattatgtgattggttacattgctgtttggcaaatacttgggacggtgacttcttccctgcaccaccagaccgtagatgctggagcccaagtagatgtgctgagaacagaggccttaagtgtgcttgcagggtttggcttggctcttgcactgctcctatttgccaggaagaaaatgtattccacatagtctctggtccaaggaggattagaggctgctggagctgacctaaaccccatgcacagcctccgtgggagctgcccagccagtctgtagacttgtgagtgagaaactacataatcgttttgtgagccactgaacgttaaggcagttttgttatctatatttttttattttattttattttattttttttttttttgagacaggttctcattctttttcccaggctggagtgcactcatgtgatgtcagctcactgcagcctcgacttcctgggcttaagtgatcctcccacctcagcttcccaagtagctgggactacaggcacatgccaccatgcctagctaattttttgtatttttgctaaagatggagtttcaccacgttgcccaggcttttttggtggtggtggtggtggttgttttggaaatagggatttcctcagcctcccaagtaacagagactacaggctcacaccaccatgcctggccaatttttttgaaatttcttgtacagacagagtctagctatgttgcccaggctcgtcttgaactcctgggctccagtgatcctcctgcttggcctcccaaagtgctgggattacaggtgtgacccaccggcttgttagacattattctggcgatagctgactgatacagatagcagcaataactgtcccgattttatagatcagggaatcaggtagagagaaattaaataatgcttgcaagaccacacagctgtaagtgatactcttaataaggcagtttgaggccaaaacccctactcttaaccattctgtcactaatcagaggtaatacaatggcaattaccccagacttggcatgtacttgtaaatcaattagaattctcttaggaatagatcatatgcttttttggcagcagcatttttaactttctgatttggttatagtggtgtatctaaaacaaatttatatttctcacacatatactctgtaatcccagcactttgggaggccaaggtgggtggatcacttgaggccaggagttcaagaccagcctgaacaacatggtgaaaccccatctctaccaaaaagaaaaaaaaattaggcgtggtggcatctgcatctgtaatcccaactactcaggagggtgaggcaggagaatcgcttgaacccaggaggcagagattgcagtgagcccagattgcaccactgcactctagcctgggtgacagagcgagactgtctcacaaaaaaaacaaaacaaaacaaaacaaaacaaaaaatacataccaactacgtgggagaggccaatgttagactgaacataaaaaattgagaaagcacatattccctgatttcttgaggtgactaaattttatcagtgatttaattatattttctagagaaaaattatcgagaaaaaaactgatgttacagttcctaatttgaaaccactgactgtatattgtgtgaaagccagagcacacaccatggatgaaaagctgaataaaagcagtgtttttagtgacgctgtatgtgagaaaacaaaaccaggtcagaatcttttattgtcttttttaaaaatgtagctagacataataaaagtaattctatactgtacattgaaaattgtaaaacattttctctttactgcaaaaaatatatagaaagaatgttttcttcatgaactacatgaatcaaaagtagactttttagaaaatatttgtaacgcttaactctcaagtcggtgttgttggatgctttatatttcatccagtatccctataattaatttccttaatgtattgctctttaacatttaataaaactattttaaatttttagaatataatccttaacataattatcatgtagaaatcacttagttcaattgtgagttttttaatgtgggaattggtttagtctcattttctattttacagtttctagtgttgaccggtagaggcttagtcacagaatatctattaaattttgctagttgtatggtgtaaaagtgctgaaggatacttgcatgtttggcctgtatgtcaatattgtatttctccctgaggatctcttacttcagttcccacgccaatctttaaatgtaaatgtcattgcctatggttgctgtggactcagtgctaccagaaatatttttaagagtattatttaatagattttatatttcctttcatatggctagtctttcacacagctgtcagcactgttaaggcatttgtatgtcaaaatatatgctaaatatcacgtatatctttttaggaaatacctctaaaatttggcttatagttggaatttgtattgcattatttgctctcccgtttgtcatttatgctgcgaaagtcttcttgagatgcatcaattatgtcttctttccatcacttaaaccttcttccagtatagatgaggtatgttactttttttatttttttgtcaacagctaggaaatgaacagaaaatgtgtttgatttcaacaggatatatgtaggttttcttgatatccagaaaataatagagactgatttgggtatcttcttcaaagctttagtcaattaactttaaaaacagtaatttcatgtaataacatagcatgagatagtaatgattgtccttaatttcatatttttctggcaattcctagattcactgtggcatttgttttaccgtttaaagcctgtgattcttggccaagcgtggtggctcacgcctgtaatcccagcactttgggaggctgaggcgggtgggtcacttgaggtcaggagttcgagaccagcctggtcaacatggagaaaccctgtctctactaaaaatataaaattagccgggcgtggtggcacatgcctgtaatcccagctactcgggaggctgaggcagggggatcgcttgaacctgggaggtggaggttgcagtgagccgaggtcatgccactgcactccagcctgggtgacagagcaagactctgtctctaaataagtaaataaagtctgtaatgtgattcttctcagtacagacagtcccaaacttacgctgtttcaatttgtgatgcgtttgtcagaacgtaattccattgtaagttaggagcatctgtatatatccagaagactaaaatattctatcagcgtagaaagtatattctatggatgaaatcatacaaaatgaaataactaaaaacatgagactttttttatgacacacatcacagttttttgtttggcacttctatgaagctagcatattaaatgaaagcactgaatggtgaaggcctaaacatagaatctgttcctgggaaaccatgtgctcatctagggtgggttttgtgaatttgagcaagtcactaagggcaggtaagcaagtacccttggctgtaaaccaccccatagaggtgttaggagcaaaggagttaaaccataagaaccttaccactctaaaaatgctccgtaaatattaacaattttactattatacccctgagtttttaaatgtcattcctgtgtactgtaatattcatagctattatttaaaatagacttaaaaactagttacaatagctaataatttctcaattgtgctgcttctggatatatatgtgttggatacaaacatttttattatttcaaaaaaaaaaagtcatgatcccagagtccgcccgctcctgtcctttcccgtgttcttccccgcctaccccgatggcacagtgtacctttcttaggtactcttcaaagactcaccacagaaggtactaagatatgagtgacctcactaatgatgcttttaaacattataaggcaattagtatgttcttaggcgactttttaatatgcatgccagaagataggttttctcagtaatggatgtaagaaactaaagctattacaactagaaaaggaatttttattattttaaataattgatttctactctttccctttttttaaattagtatttctctgaacagccattgaagaatcttctgctttcaacttctgaggaacaaatcgaaaaatgtttcataattgaaaatataagcacaattgctacagtagaagaaactaatcaaactgatgaagatcataaaaaatacagttcccaaactagccaagattcaggaaattattctaatgaagatgaaagcgaaagtaaaacaagtgaagaactacagcaggactttgtatgaccagaaatgaactgtgtcaagtataaggtttttcagcaggagttacactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggctactgcatgtgccacacctgtctgttcgccattcctaacattctgtttcattcttcctcgggagatatttcaaacatttggtcttttcttttaacactgagggtaggcccttaggaaatttatttaggaaagtctgaacacgttatcacttggttttctggaaagtagcttaccctagaaaacagctgcaaatgccagaaagatgatccctaaaaatgttgagggacttctgttcattcatcccgagaacattggcttccacatcacagtatctacccttacatggtttaggattaaagccaggcaatcttttactatgcattaagacctctgattcaaaacttattagaacagtagcttctgctggaatttgcaatcactgaagtcatagaaaataggtaactatctaattagagaaataattgttgtattttaagatctgagagtgtgtacaagttttagtatacatgccatgccagaagatagtgtatgcaagaagtcttgggaccagaaaatggcaatgataggagactgacatagaagaagaatgcttccctaggaaaaaggtcgctggctttggtgcaagaggaagaagaatgttccactggaagcctgagcacctaatcagctctcagtgatcaacccactcttgttatgggtggtctctgtcactttgaatgccaggctggcttctcgtctagcagtattcagataccccttctgctcagcctgcttggcgttaaaatacaaatcattgaactgagggggaaaaatgtaactaggaagaaaaacccaatttaagaaattacataatgctttccaaaggcacctacaacttagttttaaattacttgctactggggattacccatggatatccttaataggcaggaagtctgggaattctggtggcctctagggcagtgttctcacagcaccgttccgacagggaccagtgaaagaaaagagacaaagttagaacgtgctggggagcggccatttctaaggccagtctggtttaagtagtcatttctgctgaaaaaacagatgatcctggtggaagaaaaggttgaaggcagctgccctcgggagggctgtgatgctcggcacatcctgcctggcacatacacgtgtctgcaggccacaccgtgcatgtccccagacctgccgcctggcttctggagtgcttcaagcagagcatggtgggtcattgaggagacccaggaatctcatctgagaacccactctctgccggagaaccccatggtgacacattttcatctttctgaccagaggctgtttttttttttttttgagacagtctcattctgttgcccaggctggagtgcagtggcttgatctcggctcactgcaacctcgcctcccgggttcaagcaattctctgccgcagcctccagagtagctgggataacaggtgcccaccaccacaccccactaatttttgtatttgtatttttagtagagatggggtttcaccatgttggtcaggctggtcttggactcctgacctcatgctccacccgcttcggcctcccaaagttctgggattacaggtgtgagccaccgtgcacggccggcctgacctttggaaaagccttgtcactttggacgtttgcgtctttgaagaggcgatgggagcatatcatgactgcctgccaccattgcttttcagactaccacaactcaatcatgctgtccaggacttctggccctgtgttcaccactgggaaaacgtacttcagactggatagcctaaaaaggagcaatgcccttgtaggatgtggagaagggaaaatacggacattaacattaaaagacaccagtgaaattgttaggtctctaggaagttggagcacaaggcttcacgctttaagaccatctgtggttttcagtgaacaagcgctgagcaccagcagcagaaaacaacaacaaaaaaacacctcgtttttaccttgtcttctagacatgaaaaggcagttgcattccactctgcattatgttctacatgttgctttatcagtatatgcttagctgtaagtgacaagtattttttctgaacagaagtttacttagaaataccatgcacttgggggtaccaattaaccgcctgaaaattagcatattgatagttcttagagagaccagatataatctaagaatttatatgaaagatttgtatcattagagccagaaataattttatattaatatataatacagattaacattatatataatatgtacctgtgtcacttctgacatgagcctgtaaacatatattcatatatgtacctgcac

SEQ ID NO: 11844 - DNA, 119981 bp, Human
atgtttgtgtggactgagcccctaggtaaaatgtatttcctgctgtatgctgtggtcaaaaatgtttgaaaaccacccatctagtgatcaagagcatggactttggcactagactactagggttccgatccctcacaagctgtttgacactgggcaaattcactcattctttctgggcctcagcttcctgatctgaaaaatggggaaaggccgggcatggtggctcatgcctgtaatcctagcactttgagagtccaaggcgggcggatcacttgaggtcaggagttccaggccagcctggccaacatggtgaaaccccgtctctactaaaaatacaaaaattagctgagcgtggtggcgggcgcctgtagtcccagctacttgagaggctgaggcaggagaatcacttgaacccgggagacagaggttgcagtgagcgagccagatcgcaccactgcactccagtctgggtgacagagagagactctgtctcaaaaaaaaaaaaagaaaaaacaaaacaaataaaaacggggataatgcctagcatctttctaaagatgcgattgtaagatttaatgagtttgcatatttaaaaaatgcttagatcactttcaggcacatagcaatttaatcagtgctcactaatatgatttcttgttgaatgaatgagtggggctgaagcctaatctcctgccttttctcagtacaagttgttttctcctattcttccagccccttgtctcgaataactatatgtttacctctttattctgtttgctgtcaatgttccctcactagaataaaagttctatgaggatctgtctgtttctgtcctactcgtagctgaatctaccagcttgagaggagggctggtgagtttggcaaacattttctgtaaaggaccgtatagtaaatatcttaggcttcgcgtgggacatgccgtctttgcgcaactactccactccgcccctgtagtgtcaaagcagccttccaagctgttcaaggaaatgggcgtggctatgttccaataaagctttatttacaaacccaagcaggcagaatttgacccgcaggccgcagtttgccaatctttaaactagttcaaaatactgggcccaatacaataaaagagagtctcctatcaggttcacaccccacaaaagctccttttgatagtttctttttttttctttctttcttttttttttttttgagacggagtctcgctctgtcgcccaggctggagtgcagtggtgcgatctcggctcactgcaagctccgcctcccaggttcgcaccattctcctgcctcagcctcccaagtagctgggactacaggcgcctgccaccacgcccggctaattttttgtatttttagtagagacggggtttcaccgtgttagtcaggatggtctcgatctcctgactccgtgatccacccgccttagcctcccaaagtgctgggattacaggcgtgagccaccgcgcccggccgatagtttcttttaaccatgtaaaaaatatatatatatttaaattttcagctgggggtccgtgaaaaacaggcggcgagcgagagtttgctgacccctgatcagactgttcccacatgtcccacactcctcctgtggggtaaacggagtcccttgggtcccctaaaactggactttcccaaaacgcgccaccaacccacggcgccgcgcgcgcgaccggttcgccaaccctctgagccgcgcgcgcctcccgccaagacccgcccctcttcgcggccattggccgagtctcgcactctttttcaagggggaacgcctcctccttccgacagactctgcagacagccaatggaacgccgtagggtctcgcgccccgccctcttgggggcccgttggaggcgagcgtgggcgggccgttaggaaggtggggcgcggagcctggtaaccgttgccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccaggtgaccgatgcgaccgccccgggcccagcccggccggggagtgtggggggcggcggggaccccgttcgggggccggggggcgggcagcacgtccccgccgctcaccccaaacgtccgggtggtgcgcccgcgggacccgcctccgccaccccgtccgcgcgcgcggcggagtttggggggaccctggcgacgtccccactttccttattgactgaacgcgggggaggtgcggtgccgtcgcctcactttttacaaaacttcctgaggttggggcgtccggggacccctttctcacgcttaccttcaaactcgctgagttgggggcgccccgggaacgtctctcaaactcctcaaactccctgaattgggggcgcttggggaccctcttctcaccttaaccccctagatctctgagttgggggcacccaaggacccctcttttactcataccctcgaattttctgaattgggggcgccaggggaccctcttctcacgtttactccccagatctctgagttgggggcacccagggacccttcttttactcaaaccctcgaattctctgaattgggggcgcttggggaccctctcctcacttttactccccagatctctgagatggggacacccggggacccctcttttactcataccctcaaactccctgaattggggccacctggggccctcttcttactttactccccaaacctccgaaattggggtgaccccagagcccttctgtcactcttagtcgcaaacttcttgcatcggggggacctcgaagactcccttctcatttttaccccaaattcctagatctgacttgtcccggggaccccctttttaatggactcccagacatactgaatttgggggcacccctggaacctttttctcattccttaactaaaagctggtgcgtctgccctggggagaacccctcttgcccttctcaccttttcatcccaaactccccgagcgagcttccccgggaactgtttctcacctttttgccccaaatcctcgcgttcaggtcgcctcggacaccccctccccttctccctgtgaccccatattcctgagtataggggttcgtgcgtccgccagtctttccacgtgcccccaagatgcccctccgcacgtccgcagctctcctcttaggactgatctggaagggagaaaagtttcaccaacgcgagtgaaactttttttttttttcaatttatttattttgttaaagaacctaaactgctccaggcattttctccgaggtagtgcgagtgcgtgtgtgtgtttgtggatttaaactccaccccctgcccccaccgcccaccagcgcgctcgcgggcgcacacacacactcacacacacacactcactcacaccccaaatgctcatttctttctttttcctccctccgagaagcctccgcgctccctcgccaccagcctccggctccgttccttttggttttcctcgctgcaccgctgggaaagttggatttcccgatcctagtggctatttcaagggcccccgagggccccaagcgcccgggccattctggcggctgccggcgcggttcatcttcctattttaacctcctggttgtgcggcaagaatggggaggggagagggcaagatggagctcgggacccagggctggctgccttacccccgcccccccaggcttcattcctactttggggtgttgttagcattgtgcctccctgcaattattttcctgctttgtatcataaatgaccagcgcaggcttcgatgagttcttttccctctcagtcagcttcatctctgtatcaaaccttgtacaagcttcattctctgtttcaactaagagttccccaacaaagtaacagtaataataataatgacacaaaacaacaaagactttttaaaaaaatttttgcctgtacatattgttgacatgtattttatctttttacatcgtgccctgaaacattgtttgcttatggaaagatccttacctcccgtccttctggataaggaggaggggggcatctgtgctttctcctgctctagtttaaagacttgaactgactctaaaataaccttagaaacgacaactcacctactctgaccagagaagtaagagtttatggtaacctccctaggaaaagaatttaagttcttgaattactagggcttcttcatcaacaggcgtggtacggaaggcaacttataatgtatgatgggaaagatcactgttctgtgattctgtgacagttcaacggacttgggttgggaatgagttctgaaatagtttgctcctgcaggaaaagcaatactgaaatattttagttttttaagttctttcttataaaccactgaatctgagaagagagagacagttattacctcaataacaggacaagttctttgaaatcacttgatctttgctttctgcgtgaagggcacgcattaccttaatgtatgtgtgatgtatatttaaatacaacaatataatataatgtgtatgtgatgtatatttaaatgtaaatactcatcttttaacattgtttatcattgaagtactgctaaggatggttctgtccaccagaaatgcaggtgctggggaattgtttatctgggtcttattccttagatctaattgtttagttttacattagcattataattaataaaaatattaaattggcttaactttaatattataatcgagtcaaaattttaaatgcacctgtggattttttttttttttttttttttttttttgagacagggtctcactctgtcacccagactggagtgcagtggcaagatctcagctcaccttaacatgcacctcccaggctcaagggattcacctgtctcagcctcctgaatagctgggattacaggcatgcacccccacacccggctaatttttgtatttttagtagggatggggtttcactatgttggccaggctagtctcaaactcttgacctcaaatgatccaaccgccttggcctcccaaagtgctgggattacaggcgtaagccaccaaacccggcccctgcacctgtggatttttgtttgtttgtttgtttgtttgagacagagtcttgctctgtctcccaggctggagtgcagtggcaccatctcggctcactgcaagctccacccccgaggtttacaccattctcctgcctcagcctcccgaatagctgggactacaggcgcctgccaccacgcccggctaatttttcgtattttttagtagagacggggtttcactgtgttagccaggatggtctcgatctcctgaccatgtgatccgcccaccttggcctcccaaagtgctgggattataggcgtgagccaccgcgcccggccggcacctgtggatttttatagtagctagtgattgttttgctcataaaatgctggggccagaaggaaccacatcttataatatatatttgtttctaaagttgacatctatttattaaatatttaaatatttttaaaatatatattgaaatattaaaacatgtatatataatatatacttatatatttaaatataataaaatttaaatataaatatatgttaaatataaaacaaatatatttaaatatttacaaacatttaaacagtatacccccataggtacccacttacttgtaaaataggaaacttttgaaaaaccaagggaagttctcatcttgcttgtcaggacactcactaaactgcaggggaggagaatgcgagtctgtgggcctgtctctgaaactatgggtccagggcattcccactaaacacagccgtatttctgaactgaactatatgaatattcacccgaagtggggaagagaaggaccataagtaacttcatgtcaattcaggccagcttttgtcaccaagtgagtccatgccaaatttacaaaaaaattgccagttttcagagtttcctggatttcagtattgttgtaaggggttgtgggcttatgtattttttaaaaagatgttttgactccgtctctagaatttaaatggcaattagctcctctgctggtcatgttctcatgttctctcatgtagacatatgcctggtgtagtgaaaggtcttattttgttggatggatggatggatggatggatggatggatggatgggcaggccgatggaatatacactgggaattagagaaaaaactgaaaaccacctacttgcttcttggaaactctaagatcagcaaaaggattctcccaggaaaaaaaatataggggaagacccagaatgaagtgggcgaaagggataagggtaggtgaaggaggagtggcaaaaggtccagagagaggccctaacaggcctatagggaactggagcctgggaagctctggactggcttaggattctaagctcttctctgcagaaaacatctatccagctgcctgctgggtacatccaggtggattctgacaggcaccttaaacttaaggtggccaagctgagcctgtcatagtccccccagatctactcctcccaaagcaccccccaaactcgttggtacatatcaactcacttcttcccattactcaggccaaacctcaggactgtccttgactcctctctcccaagccatcagcaaatcctgttgactccaccttcagtagttccccagaacctgaccatgcctcgccacctccactgccagcccctctggtcccagccaccagcatctagcccggatgattccaccactggtgctcggcagtctctcagcccagcagccagacggggcctgttaaccctgggagaggcggcgtcatgttaagttctacttcatacccctcagctcgaaaccctccgatggctcccatctcatctgcagcaaaagccaaagtcacccctaactccactccccgccaagcctaatacctctttgacctcatcgccaagctagatgccttccctcactgcacttccaccctgctggcctctggaagctcattccagctctgcctggaaagctctttgcccaggtatttggagggctggctctccgactttcttcaggccttttctcagatgtcaccaggccacccacttgagaatgggtgctctcagcctccttccctgctttctctgtctccttagcatttattcctatataacacaccataagttatacgtatttattgtattatcactgtcctcttgttagaatgtcagctcagtaagggcaggaacttctgttttattaacttcttttttttttttttttgtgagacggagtctcactctgtcaccaggctggagtgtagtggtgcaatctcggctcactgcaacctctgacacccaggttcaagcaatttttctgcctcagcctcctgagtagctgggattacaggcacgtgccacaacgctcagctaattgttgtatttttagtagagacagggtttcaccatgctggccaagatggtctcgatctcctgacctcatgatctgcccacctcggcctcccaaagtgctgggattacaggcatgagctgttttattaacttctatatccccagggctgagaagaattttggtgctgagtaggcaattgagaaatatttgtgaaatgaataaacaaatggtttccttgacacttatggggaaagcatatgtagaaatgaagagttgagagctgcattgggtgtggtggctcacacctgcaatctcagctacctgggaggctagggcaggaggatcgcttgaacccaggagtttgagaccagcctgggcaacatagcgacaccctgcccttaaaaattttttttttttttttgagatggagtctcactctgttgcccaggctggagtgcagtggcaccatctcagctcactgcaagctccacctcccaggttcaggccattctcctgcctcagcctcccgagtagctgggactacaggcatccaccaccacaactggctaattttttgtatttttagtagagacggggtttcaccgtgttagccaggatggtctcgatctcctgacctcatgatccgcccacctcagcctcccaaagtgctgggattacaggcgtgaaccaccgcacccggccaaaaaaattttttttaaattaagaattgctcataggtaccttaagttcatattgccatctctgagtcagtagagcccaaattggatgaatctggatgaatggggcaggggaaagaggaaaggaaaagttgcaggtcatagtgctgggtgttgcagaccagggctttggggcacagcagagaaggagttaaattgtggtgccaccgtttattagcttagtggctctggggcaaggtttgacatctgtgaaatcgataataatagctcgtgtggttgctatattagaaataatttctataagctatttagcacaggggctggcatctaataggtgctcagaaaaaagtaactgttgttattattattattattaggatgaagcaaataagtagtaagtggcctgggatgatcagttttttactgtggtttcctgaccaggaccaaatgctaaggaggcgtttagtacatacatcttgcttgactgagtggtcggcctcatgctgtctgttttagggtaggaaattcccttaaattaacctagaaactcatgggtactaatatgtccctctgcaaacataagtgcttcgtaagaacaaaaacagcacgaaaagttgttggagtcctacatcttggttgtggcatgggtccctctgaaatgactccccaaacatcacatttatgatgagttttggggagtggccagctctacagatgagaacattttaagactggtttcccttctctgttatcactggctcttggatgccaacacagtcagagtctggaaatgagccacttggagccggggactggcctggtcttcgtgccaggacttgagttgggcccttaggagcagacggcctggccttgctgcacctcagttgttttttcctgaaagtgcattcctgttttatgatacataggtcttgcatgtttgaaaaccctgttgtatgccctggcaattccttattcttatttttaatgtttgtgaattccatgactttctaaaaagtacagttgacttgccactgcctgtagatgatacataaagcagatagattttaaatgctgtcagtccatttacacctgctacagtccatgtttcaaagtggagaaaaagctgaaaagccattaaaaatatgtagaacttacatgtaatggtccaatatagtgattatttgtcatttattacataatgaagcccagatgtgctatatatggtaagcctatttctactaagatctctgcagtttttttggacgtgtgtgcatgtgtttgtgtatatgtctgagactgggggatgggtaattcataataaaaaacgagatgaagtctcgctctcttgtccaggctggagtgcagcctcaaactcctgggctcaagcaatcctcctgcctcagcctctcaagtagctgagattatagatgtgagccactgtgcctggccataagaggcttcttgtatttgaacttggctgaaaaattgaacagtagagacaaaaaagcaaggccgtgtgatgcggactgggctcctggcgtccagcagtttttaaggaggtgacagttgagctgagactgaaatgaggagagggaaccagcgctgtggggttcagaaggaagagccttccaggaagggggcagcaggtacaaaggtcctgcagttgtgtggctgatgcctggcgagcaaagcaaggagaggcagaagaggcaggggcaacctgcagggccttggaggccatgggcaaagtttggatgctattcgaagtataaactggatcattggtagagttcacatcagccggtacctgtcagatcaaaggtgtccagtcatttaccggaagacctgcttttcagactcctgacatttgttcatcattcattcatacaatcttcattcattcatccttcattcatttattcattgcctattttgagtaaagtgctatcctatccagttacaaagaccaaagaccaacaaggaagaggagtcagtatcaaataggctttgctagatgtttctacagggcacagagggcagacaaagtggggaggccagctgtccctggagctgaggaaaggtctgaaaagaggatgtggatctgaactgcatcttgagaatagtgttctgcaggcagcagatgggggagaggggtgtggccatgttttcaggactgggcggcccatgttttcatgtccccgtgaatgtgatgactatacactatataagtggaatcatagagtatttgtgtttccgtgactggattatttcacttagcacaatgtcttcaaggcttatccatgctgtagcatgcatcagaatttccttcctttttaaggctaaagaatattccattgcatggatatgccacattgtgtttccccattcatccatggatgaacacttgggtggtttccaccttacagctattgtgaaccatgctaagcagagatctcaaagggactcttaggtagagggagaacctggacagaggctcaaaaggcaaaggaggaaataacttcaagaactgagcaccatgaagagtgagatccaatggcaaccagaaagattagacttgcccaagtcccatgtgaaaaaggattgggtccccacagaaaggcagaaggcttgactcatgaacgcctgtctcctggaaaactgttgaaattataccaatgatatagaagtccattcctaaagctgcaacagcacttaattatacttttttaaaaatgcaaactgtttatcttttagaaactgtgccatgtttccaaggatacatttctgtccaaaaggtgatctgtggggaaaggccttagaagcagtttccaaaaaaattaccagcccacaaaaatgtatgcgggctccacccaggccagtggaaacccaaagaaaataacacgaaggcctttttcccacctctcctgtccttctcagaatacatacagacagatgtagcctgccttgagaaaaaatatatttggaattccagacccactgaaaacagactaaaagatgtgcttctgattttaaaaggaattattcgttttcttgaagaattcaccctactagggacttcagtgaggagctctctggggtctccatccatttctttagaaaatatttgtgggcctgaaatatcaaacatctgaggagcttataattagttaagcatttacgtgtattaatatatcgtcatgtggacagttgagaggggagaaggcactagacaaatttaaaattgttagaaaccattggcaactgatattcagagcctaagttaaaagcaggatatgtctcaggagcaaatcttttgtgtaaatcctggtatttttactgcagacctttaaaatgacagacgcgggtgagtaaaaattacttctggaaatggatatgattaattaattcaattaattaattcaattaaatcaatataattcaattaattaattcaattaaatcaatataattcaattaattgccagccttggttcacactgatgagtgtgctcattggagagactcagcatgcaaaagaaaagactcatcaatttgcagttatttaatttcacgaactgccggatggtggagtcagtagcagcggctgggccgcaacatggcgcctcccacctagacttccggtcaggaaacttccaccttcctccgatttacgtgggcctgcatgagcctacttctcttcttattctagtgccagtggcctctggagtcttggtccttcttactggaagtagccctcctctcctgttacagaggcaataattctccagccttccggtcgccgccaaagcctcctgcctaatcacttcctgtattgtctccctgcggctctttgcacagaccttgggctctgtcgtctctggattcttactgatctcttcctcttctcccaaccgccttgtcatgtctctttgagctatgtcaggaggaacggaagggcactttcttactacttttgttagccaaacggacaaactgtcccctcccctttgttgtaaccacacattcaaggcttccttcagtccagccccatctcccttttcgttgcctccctttcactactccaaatgagcttgccatactttaaacgggtcttgtactttcttatcccttctctggaatgtcatttctactgaagaaaatcctactcttccctcaagacccttctttaatcccctcttgccatggaaacttgagattttcattgaggagctaagttggaaaatataaactagagctgagtctctaccctggcactattgacatttggggccagattattcttggttggggagactgttctgtgcactgtaggatgtggagcagcctcccaggcctctacctgccaaaagcacactcccctttccccaagtggtgacaaccaactgtttccagacattgccagatgtcctgaggtgggagtgagggtgaacagaattgcctcccagctgggggctgctggactaatcaacaagaagtggcaaggactgcaggcaaattgcctcagcacttagatttagcactgcaaggccacttcgacaggtggtagtgatttgtgcgtctcatttcctattcttgattgtgacaaggttctggaggatggagacagctacccctgccacagttcccacaggctatgttgtacatagggcttcatatttaacatgtgagtgaatgaaacacatgagcccgagtgctcttcaggacggcaaggcctacatcaagatggtaaaccttcagttcttaaaaaaaaaaaaatcacgcagcccgtgcctgagatccaataaccttcaaactccatgttttcgatttgatctcaattaacattccagctctttcaatatgtacttttcctttaccaaatttcaaaagaaattttaatcaaagacccctactgttaattaatttccctttttacccagccaaaattgcaaatgaagttctttttccagaaagttcggggagcggggaggggttttataacagagctgctgctgagtctcattgctaggagctgagtacacagtggagaatatgaaatcccgaattctatgtcccagcccattgcagtggcttgatttgtctcttgttttgctttggaacttttcaaagatttcactctgttaaaaagtcaatttggaacaaatatagagctgttatgtctattagaattgtttcagcaacgaaatgtggcactcagcatttgttgaaccaatgaattctcctttttgctctgagggaaagcaaggttatagggcaagttgtattttaacccttagcttttttttttttttttttttttttttttgggggttcaagcagtttgtgaaagatttgaaagctgcatacatttggggtcaccccaaaaagtcagccctgggccacgagcagtggcagaggaagcagttacagagaattaacagagttacataaaatttactcactttgtaggcaaatatttctaaccttggctccctttcttaaagatctatttccccagctttgttccccagctcaaaagcatttcccaacacgtggatctgctaccactggatctgccaaagcagaatcctcttttttttttccagttcttttttaggccttcccagtaggctgaggagaaagtctctcgtgggtgttaaggtatctttaacccctctataacactcctgacctctcacgtttaacgaagaacagacttcaaaacttgagagctgagtgttaaagaaaaatagtaaatggtagtattggtggtcctggaatgtgctaaaaccaccaaagagacactgactcaagatcattgcccaggtggctctgacgaacttggacgaaaacgcatctcactgaagtctctatcttgcggcctctttacaggtgttattatcagccaagcacccactgcgctgtctcggtgcagggagagcccccatttctcaagttcccgcaatgtagccccacatttctagttagaccagtaacagttctcatcaggaggagaggtcgtttttaatgcaagtcaaaatataaaccactgaggctgggataaacttcaggggtagcaaagttcttttattgtttccaaatagacactctggaataaattatacatttagttgtctggttacaaagctcatagataaaatcatgtatgacgtcatttatcgagtcattcaccttctctgatctatataagaatgttcaatgctgtgtgataacatttttgattcttgtataagaaaagaagaaagagggtttttcaagaacagcagagagtgttacgttggccacagaatcaagcaaatgggcaaaaaaagcagccctcagtaaggagtagccagactttaaaagtagtgcctgttagatcaccaaggttatgttttaaaaataaagggaacctggcacagtggctcatgcctgtaatcccaacactttgggaggctgaggtaggaggatagcttgaggccaggaattcaagaccagcctgggcaacataacaagactctgtctccacacacaaaaaattaattagctgggcctggtggtgcacacttgtagtcccagctactcaggaggctgaggtggaaggattacttgagcccacgagttacttgagccgtgtttgcaccactgcactccagcctgggtgagagggtgagacctgtctctaaaataataataataattaataataataaagggttgccatgatgttacccatgggtacatactatgtgcctggtgtattacatgtattacttctaatccttgtaaaagcccggtggaattggaatgatgatcacgccctcagaagggtaaagatatcttaatgcatgtctcagtcctttgggcaggtagctgaggaatctttcctgccgctaaactccatgcaatttgcctttctccttagttgcttcccctctttgttgcttcagaaagggttgggcccagggtctaggaagaaaggcaaggcccaagtgaaagagagatgtgtgggtcccagcctgggcaccctgctcttgccagaaacccgagtagcctggaccgctcgttcttcctccccagggtctagtccaaggctgtagatggagctgtctcctctgttgcccagtgttgaaggctaggggtcatctcatcctctccccactctgcttcacccccactaacccactgccctcttttctactcactacttcctataggtcccaccacccaaactggtcttgtattgattcttccctttctgtttctgattatactgttccagttcagaccctctcatgcaggactgttaaagtaaacttccgatttcttcccttagatgaagggtatggtgctggtcctcttgttctgtgttcttccaaatctggtgcttccagctgccctcaacaatggccttaagatggtgggggaccctgggagggggagaccacatgatatggtggaacatcatggaataccaggagtgcgttgaattaaatcatgtgaactcatattttattaatgcaacatgattaaattataagaaacgaggccaggtgcagtgccttacgcctgtaatcccagcactttgggaggccaaggtgggcggatcacgaggtcaggagatcgagaccatcctggctaacacggtgaaaccccgtctctactaaaaatataaaaaattagtcgggcatggtggtgggcgcctgtagtcccagctactcgggaggctgaggcaggagaatggcatgaacccggggggcggagcttgcagtgagccgagatcgcgccactgcactccagcctgggagacagagcaagactccatctcaaaacaaaacaaaacaaaacaaaacaaaacaaaaaacaaaaacgagagtgtgcgcagtgtcaactatgagcatacgttctttaaaactgctgttgattgggtgagacagactggtacagggcttcccaataatgtgaaacctgcagggtatcacattagtttttgttttgttgttggctactcttcattagcaaataagaggaaatatctaccaagggtttaagaaatattggtagggaaaatgttttaaattcgaggaacctattcaataaatatttctgcagattggcgcaagtgccattattttatttgagcagtgcctttattttatttgagcaaaggaagcccacaggatgttttagtattccaaggaagtggggatcagcaaacattctctataaagggctagatagtaaatgttttagcttttgaggcccagatggtcactatctcaactactcagctctcccgatggagcttgaaagcagatgtagacaacatgtgagagcttgggcatggccgtgtgccaatcaaactttatttatggatgctgaaatgtgaatttcatgtaattttcatgcatcacagaatattttgattttgatttttttctaaccacttcaaaatgtaaaagccattcttagctcatgggccatacacaaacaggctagcggctgggccagatttgggtggtgggcggtagtttcctgacctctgcccctgtggtgcagtccaggggctctgactcgcattcgtagactttctccaagtggtccatcctatttccccctttattccccgagctccacccagcttggtctcttgaccccttccctgccccacacaccctccccttgtttacacctctgcctgattttccctaccccacctccagcagggtccaggacgggatgctgcccagactcccctgccccattgtttatggtaccctgttccatctggagtctgcacctgttaccttttgccacgtaaggaattatctgtgtatgtctccttttctttctcaccccatccatgcaaaacccttgaggatagaggccatgtctaactgtatttgtgggacaccaaatagagtaattatttgtcaaaattacatgagttcttactagatagagatcacatctacatctaaaaatcattttgcttactttctagtaaaatagaatctcttaaaatatttgtgaattcttaaacttatcctgagatgatttattctaagtgtcttctagatcattaccggccaataaagaaacataacacaagccacgtgtgaaatttgcaattttctagtagccgcattttatttatttgtttttatttatttatttatttgagatggagtcttgctctgtcgcccaggctggagtgcggtggcgcgatctcggctcactgcaagctctgcctcctgggttcacaccattctcctgcctcagcctcccgagtaactgggaccatgcctggctaattttttgtatttttagtagagacggggtttcaccatgttagccaggatggtctcaatctcctgacctcgtgatccacccgcctcagcctcccaaagggctaggattacaggcatgagccactgcacctggcctagtagctgcattttaaaaagtaaaaagagacaagtgaaagtaatttaataatacatttcatccaatgaactgtattgaaaatattcatttcaatatataacctatatgaaaaattattgtcgagatatttcacattcttttttgtgtgctaagtcttagaaatgttagttcggaccagccccatttcaggtgctcagcagccacgtgtggccctggcttctataccgactgcacaggtaaaggtgttaaagtcaaagcaggcacaagttttaagtcaactcttccttttaaaaggtgaccactatattggctacttactggcgtgcagatacttcatagccgtgaaaacataaggtcactgacaaagtctgagtagcgtgggtccacctgacctcagcgttgtccattttctaaagtgatcatcactggactttgaaacacaggtggtgccctccaagccacctgagtgatctgtccccagaattccctagtgaccatttcaggactttgggatcctgtgtgtagtccccataattctgactgcttctcttttacattataaaagtcttacgttttcatcattaaaaaaaaatccaaattgtaaaaaagaaaaaaagagcctctggctgcttcttcctctctcctctgcccctcccaccactaagaaaagtttggtgtggatggtttcagatatttcacaggcctgtaaaacatacatacgaattctttagtgttttttgcattgggatgtaattcacatgccgcagaattcaggctcttaatgtgtacaatttagtggctttcagtatattcacaaggttatgcaaccatcaccaccatctaattccagagtcatcaccccaaaaagacaccctgtccccattaagcagtcactccccacctcccttccccagcccctggcagccactaagccactttctgtctttgtggatttgcctgttctggaaacttcatgaaaatggaatcatatagtaagtagccttttgtgactggctgtttttagcatgatgttctcaaggttcatccaccttgtaccacgtgttggtgcttcattccttttcatggctggactaatagggtttttttgtgtgttttttttttcttcttcaaaaaagagatcttatttttctcacttttctgccacctgctcttttacctaatatttagcctgtatctttccttatcactttctactgtgtttgtgcttcattctttctactaatggtctgatattccactcctgtcctaagtacttacttagccttttattctattttattttatttttttgagacagagtcttgctctgtcgcccaggctggagtgcagtggcacaatcccggctcactgcaacctctgcctcccgggttcaagcaattctcgtgcctcagcctccagagtagctgggattacaggcatgtgccaccacgcccggcaaattttttgtattttagtagagacggggtttcaccatgttggccaggctggcctcgaactcctgagctcaggcaatctgccccactcaacctctcaaagtgctaggactgcaggcatgaaccaccgcacccggccttagttatttatttataggcattttggttataccttccactttaccgccaatgctgcagtaagcacccgtgtccaaatatatttgtgtacacgtgtgagatgtttgcccactcgcggcagggaaattgctgagcctgatggacttcctccccttggcgttagcttgccgccacttacatctgcgctccattcctactataaaggtgactttccacttttgtcctctcctgaaactacgccgcctccagcaggaccggggccacctcctcgcctccccgacaccacagggccttttttttaccacatgcgtgtccgttgccctaagtccccgtcccactccttgcctctcaggccaacacaaactctttagcttcttaacatttcagagtagcaggtcccggaccctttgacagcctcgtgaaaacttgtgtccccaccctccaggagaatgcacactgaactcacccacagtgttctgtgggccacttaggaggtgctcaaaccccctggcagcctctccctcccccggcccctcctctggaacgtgttccctgtcagcttagctctgcctatcctacagtccacgtgtgactgactcagcctcattctgtcaccgtgagctgcgcccatgctcgcgtgtgcctcttggggaggcctggctgctgggctggtttgcgcagccacaagctcatgcttgtcgcccttgactcctgcgcggactcgagcctagcaacggcctgccccgcccctctgaattccctctggacgcgtggctgtaaactctgctacctttattctccagcagagcactcgttcttctgccttctcagcggaagaccttccttccagcagcccagcatgcagcctgcggggccaccctccgtcccaagctgctttcttgggtcattgaccccctgctgccatggcccgggtttagggacttgagcccctgctctctccagcccgaggagggagctcagttgtgcagccactagatcctgttcttgaatgtcttccttgctgttatagttggcttcttcttatggtacaaattctttctctttaactctacgtaaacaatttaaaaccagaattcctgtgacctaatcctcgataaagttattcattcttaatctgagcttttctcctattttaaattcagtgaatcatggttttcttttttaacatcctttaagatttctgagacaccaacctccacagttttcctccccccactcccggatgtagaatcttctagaaactccctgctcctttattctccagggttaatgttcactgagggcttggcccagaaagtctacaattctctgactcccaaactgggacatagtctcatttcagattcctgattgtaaaatgcctacctcccgcagttcattcctcattcagtccctcggcttattctgttgatgggtctcatgtaaacacgttttgcggcttagactcagagttcctgaaacagatttccccacacctacttctctcccatcactcgagattttcacaaacagtctgttagggatcgtgtccaacagatattgttgtttgttactgaagtttatttctgaaaatgttcgaattgtactttgtacgttctcgtgcctaattttctcataattatgagaatattgcattttacttctcctgaggtgaggaatgcaggaatgcttttagtctctatatcattgtttctcttcgtggctggcatttgccagcactcagcgtcatcttcttttttcaattgtgataaaattcacatacaattcaccttttttttttttttgaagatagggtcttgctctgtcgcccaggctgcagtggggtggtgcgatcatggcttattgcagcctccaccttctgggctgggactataggtgcacgccaccatgcctggctaattttttgtagagacaaggtctcactatgttgcccaggctggtctcaaactccgggattcaagcaatccccagcctcagcctcccaaagtgctgggtttacaggcatgcgccaccacacccagcccaaaatttaccattttaaccactttaaaatggttttcatttggtggattttaggattttcacagtgttgtgaagccatcatcactctctaattccagaacatttccatcaccgtgaaaagaaactccatacctattagaagtcgatcacagtcccctactcccagcccctggcaaacaccaagtctgcttcttgtctatgtgggttttcctattctgaatatttcctgtaaatagaatcatacaatatgtgacctttttcgtgactgacttctttcacttgtgtgtatataaatatatatttaagccctggaaggttgggtaatattgttttgcagttcatccacattgtagcctgtgtcagagcttcattcttttttatggctgaatagtattccactccatgggtggaccacatctgtttatgcattcatcccttgatgggcatttgggttgtttctaccttttgactattacgaatagtgctgctatgaatatttgtggacaagcttttgcctggacatatagcttcatttcttcagggaatatacctaggagtggagttgctgagtcgtatggtaactgcaagttaactgccaaattgtcctttcacagtcccaccggcagggagtgagggctccagtttctccacatcctcaccaacacttttatttttccctgtttttagtataaccagcctcgtaggtgtgaagtggtgtttcatggtggttcttatttgtgtttctgtaatgactgatgatgctgagcctcttttcatgtgctttcatctgtctatagctcttctttggagaaatgtgtattcttttttttttttttttttgagacagagtctcactatgtcacccaggctgtagtgcaatggcgtgatcttggctcactgcaacctcacccggctgagaaatttgtattcaaaggtgttatctgggctggcatggtggctcatgcttgtaatctcagcactttgggaggctgatgcaggaagatcacttgagctcagtagttcaagaccagcctgggcaacatggtgaaaccctgtctctatgaaaaattcaaaatgcaaaaatagccaggtgtggtggtgtgggcctctggtctcaactactccagagggtgaggtgggaggacctcttgagcctgggacgttgaggctgcagtgagcgatgtacatgccactgtactccagcctgagtgacaaaagcgagaacctgtctcaaaacaaacaaacaaacaatccaaagatgttatcttatacaaacaatccaaagatgttatctcatataataattttctctaatccacaagtttctgttcctctgtgaaatgcccaaagaccctgaatcatgaaggtccccagcacatgtaagagctacacagggtggtggagggaagggagggtgacagttcattcagatgctacaacaaaaatattagagactggctggcttctaaacaacaggaatgtgttgcagtcagctctggaggctgggaagtccaagatcaaggcactggcagattcagtgtctggggagggcctgctttctggttcggcttctgccttctagctgtgtcctcacgtgatggaaggggcaggggaggtctctggggcctcttttgcaaggaccctaatcccattcctgtgggtgccatgctcatgacctaatcatctcccaaaggccccacctccagatgccgtcatattgggggttaggtttcaacatgtgagttttggggggacacaacattccaaccatagcacagggtcagaatccagaggacatgagggctggcctcccccttccctgtgacattgctccagctcctgcccgtgcacactcccttttcagagactgcccaaaaccccacatcctccgccactgagatggagacaggacaggagtgttggtcttcacccccagagtgtccctgacctgctggacgcagatttctagcgtggttatttgtcattacatgggctatttgatacctgcccttttatttatttggagttattttaggctctgttttaaagacatgagtccaaacatctgagtctaatacagagtgggcaaactagcccatgggctaaatccaactcactgcctgtttttgtacagcccatgaactaagaatgcttttttcctacatttttaagtagttggaaaaatcaaaagaagaatattttaggacatacaaaattatctgaaattcacatttcagtgtccataaattgtgcttgcttcagcagcaaatatactaaaactggaaccataaataaagttttattggcacacagccacagtcatttcaccctacaatggatggggttgagtcatcttgacagcgagcgcttgacctgcaaaacctaaaatatttactattccacattttacaaaaaaagcttgccaccccctggtctaacgcacattacttggctatatgtgactagtactcatgtgtatatgaatgtgatgctgattttgaggtttataaaaccccttaggctcttcaatggtgtttaacatatttttgctttctctaagagagagaggaataatatttactttgttatcttctccagtttgttgtaattaaagaagagtctttggctacatccatcttgcaggatgaatttcgttgccttcttatacctatgagaactgtgcctttaaaaaaaaatgctgggctggcatggtgactcaagcctggaatcccagcactttgggaggctgaggcgggtggatcacctgaggtcgagagttcgagaccagtctgaccaacagggagaaaccccatctctactaaaaatacagaattagcggggcatggtggcacatgcctgtaatactagccactcaggaggctgaggcaggagaatcgcgggaggcggaggttgcagtgagccgagatcacgccactgctgtccagcctgggcaacaaaagtgaaactccgtctcaaaaaaaaaaaaaaaaaaaaaaaaagctgtagtgccctggcccttctctgtggcattcttctttgtctttcaggccctggccagcctgggttaggcttagagcagcactctgggctgggaagggctctgtgttcaggggtcattgcttcctctttgttctcgtctctgactcaccaacatgcagctctgggtgactgtcccttgaggactgtggcttcctggcgggttaagccagttctggaagtgggtgtgcagcttatggcagccaggagtggtttctgaaattaattactgctctagatgatgatgtaaggagtgagactcctggggagaaactgcccatgtggagaaacccagcacctgtaacccatcaccttcgtatcaaaacacgctgtccacctaagaagggcgaatgtgccatggctaatcaaggaaaataatttctgtttagctgtcaaaaaagctatttccatgatatcagccctttgatttggagctgaaacctccaaatcaaaataaattctgcagcatctgaatcttttgttgtagctggattttttagagtgaaggcattgctaggaattactgacagagtccagggaggggctagaattggaatcgggcttctctgaggtgagaaagttagtggggactcgccttaatgcctggctgtggaactgatcaaggtcactggctagatgtggtaaatcagatgggcttccttgggttggatgggtggatgctagaaaaaactgcacttctctctaagtccctttactcgcctctggcaggcatctccctcctgggcttcctctgatcctcgatcctcaattcctgggcttggtggactgtgggttaattatctcctaagtgttctttgaaagcagagccaattatcagcacagtcccttcccaggctgtttgaattcctaaatacagggcagtgggagggaggagtagccacctgtggactgtggctccctgctggagacgggtgtgcgtctcgcttcgcccctgtgaaggttatgcctgtcgccctgtctatcatgagtctgtctctgcagcttgtggcttctgacccgctgcgaccatctgcctgtgctcagtccccacccaggaagtgaactgattctgtcactttcttctaaagaccacagatctgcctggtttatacaacgaagctcgtctgaattggagtcctcaaatttgtgaatttaagttttaaaagattaaaaaaaaaaagacatactgctgtagcccagtggtttttaatctttcatcagtctggatctctttcaaaatctgctcaacactgggaatttctcctcagaagaacaggcatggaagggcaaaaattacatgacaatctacgttagtagtaaacagaaaaggcagaggtgcccatgtgatgtttgtatctctgtagagttgtgtggtcagaacagacaaattccctttgcaaataatagtaaggaagcgcatcactgaaaacaggaatgagccgtgtgcgtggatgcatccattactgtcaaaggggagacacagaagtcatctaattcctgtgagcttctcttgcaattcacttttacagtgccctttccggcaagattagattcttgtgtgttattacttaactttaattatttgcttataatgcagtcatgccatgcataacatttccgtcaacagcagaccacatatacaagtgatcccataagattataatgctgtatttttcctgtaccttttctatgcttagccatgtttggagatacaaatacttaccactgtgttacaattgcctgcactgttcactgcagtcacatgctagacaggtttgtagcctgggagcaataggttataccatacagcccaggtgtgctacgtaggttgtagcgtctaggtttctgtaagtatcactctgtgatattcgcacaatgatgaaattgcctgaggttgcattgctgagaacgtatccctgtcaggaagcgactcatggccgtattttactcctgcaagggtgccaagatcattcgatggggtaaatacagtctttccaataaatgatgctgggaaaactgggtttccacattcaaaagaatgaaattggatctcccctgccttttttttttttttttttttttgagacaggatcttgttctatcacccaggctggagtgcagtggtacaatcatggctcactgcagcctcggcctcctgggctcaagagatcctcctgcttctgcctcccaactagctgggaccacaggcatatgccaccatgccaggctaatttttaaattttttatagagacgaggtctcactatgttgcccaggctggtcttgaactcctggcctcaggcaatcctcccacctcaccctcccaaagtgctgggattacaggcgtgagccactgtgcccagccaggacttttattttataacatacacaaaaattaactcaaaatggatcaaagacctaaacataagagctaaaactgtaaaattcttagcagaaaacatagggagacatctttatgacactggatctggcaatgatttcttggataggacatcaaaagcactcacgacaaaaggaaaaacagaaggattaggccatcagcgttcaaaacttttgtgcatcaaagaacagtagcaacagagtaaaaagacaacccaaggaatggaagaaaatgtttccaaatcatttctaataagaggttaatattcaaaatagataaagaatttctgtaactcagcaaaaaaattttttaatgggcagaggacttgagtagatatttctctttcttcaaagaagatattcagatggccaataagcagttggaaaggtgcttcataccagttatcattgcagaaatgcaaatcaaaaccctaataagataccacttcacacccattacgatgactgttacccaaaagaagaaagacagaaaaatgttgataagaatatggaaaaattggaactgaacccatgtgaactgttggtaggtgtgcaaaatagtgtagctgctttggaaaacagtatttgtacactcagacagggatttgtacactcatgttcatagcagcatgatttacaatagctaaaatgtggcagcaactcaggtgtccaccaacaaatgaatggataaataaaatgtgatccatctatacaatggaatactattcagccttgaaaaaggaaggaaattctgacacaggctgcaacatggacattatgcattatgcttaagaacatcatgctcagtgaaagaaatcagacacaaaaggacaaatccagccgggcgcagtggctcacacctctaatcccagcattctgggaggccaaggtgggtggtggatcacctgaggtcaggagtttgagaccagcctggccaacatggtgaaacccagcctctactaaaaatataaaattagccgggcgtggtggcaggcacctgtaatcccagctacttgggaggctgcagcaggagaatcacttgaacccaggaggcagaggttgcagagagccaagatcgcaccactgcactcctgcctgggcaacaagagcgagattctgtctcaaaaaaaagaaagaaagaaagaaaaaaaaggacaaatccagtgtgattccacccctaggaggtccctagagtcatcagatccatagcgacagaaagtagaatggtgggtgccaggggctggggagggggtagggagtgagtgtttcatggggacaaagtttcaatttgggaagatgagaatgttctggagatggatggaggtgatggttgcacaacagtgtgagtgtgcttaatgctactgaactgtatattaaacatggttaaaatggtaaattgtacattatgcacattttaccacaattaatgataaagagtaattgactcgtcatatttcccagcattactttactaggaggcatatgctttttatggtttgcctctagtaagtccctacgctgtcctgctaaagcagaggatcacagctttaataaagaccctaaatatttatcttgcctgtggtcatgtatagctgaacaatgcacagcgaactcatttagtttccatgcgcttaactgggctaactctgcttttgagcctaatggaaagcttggggcaggtggaggaccggttctttagcactcacagacgattcccacaccacactcccatatccggtcttctctgccgagaattctccctgcccaagaggtctggggtgccctggacacgtgtgctcatctcctgtatttggagatctggggctgggaagagaatgtaaagcaacctaaacagtaatttaagaatggagaaaatgggactaaattattcagacacgtttgagtgcctactcgctagcaggcattttccgctgcctataattatgagtaagacatgttcccccaaaggccatccaagataggggtcacagcctgggcaagatggtgagaccccatctgtacaaaaaattaaaaaattacccgggcatggtggcacatacctgtggtctcagcttctggggaagctgagcaggaggatcacttgagctctggaagtggaggctgcagtgagccatgtttgcaccactgcactccagcctggatgacagagcaagacccggcctcagaataaataaataaatgaataaaaattaaaaaaaaaaaaacgggtcagcagactacatctagcacactactgtgggtttttatttttgtttttagtttccacgagttgagaatattttttgcgtttttaaatgattggaaacaagacaaaatattttgtgacacatgaaaatgatatgaaattaaatttcagtgtccataaataaagatttattggaacagcaccagcaccagggtcagaactagcatgaggcagtgaggccctcgcctgggatgcaaaatttaaggcagtgcctacaaaaatccacagtcatcaagatacacaatgttttaatgcagtattttaaaaaatcaaaataaatgccaaaaaatttcatgatgaaggccgggcacagtggctcatgcctgtaattctagcactctaggaagccaaggcgggtggatcacttgaggccaggagttcaagaccagcctggacaacagggtgaaaccccgtctctacaaacaatacaaaaattagctgggggtagtggcacgtgcccgtactccctgagcccagggaggttgaggctgcagcgagccgtgtttgtgccactgcagcctgggcaacagaatgagaccctgtctcaaaaaaataatgggaaaaaaattccatgatgagcaaaatgttgaaattttacataaagacaggatcagcactgctgcttctttttcctctttgccccaggctctagcatggctctgaaaagcgctgagtgcagcggccacactcactcctcctactgtccagaggcagagttgagtagtctcaacagagacctgcaaagccaaaaatgtgtattttctggcccttatagaaagttttccagtggctaacacctgtaatcccaacactttgggaggccaaagtgggcggatcccatgagccctggagttcaagaccagtctgggcaacatggcaaaacctcatctctacaaaaaatacaaaaactagctgagagtggtggtgcacgcctgtggtcctagctacacgggaggctgtggtgggaggatggcttgagcccaggagttagaggatgaagtgagctgtgatcgcgccactgcactccagcctgtgtgacagagaaaggctctgtctcaaagaaaaaaagaaaactttccaacccctgatagacatcaattcaggagagaaggaccctcctcttactatattaatccccagcaatgactataaccaaactagattcaacatctggtccatttcccctgtctaccattttttttttttttttttttgagacagggtcttactctgttgcccaggctggaatgcaatggaacgatctcagctcactgcaacctctgcctccttggttcaaatgattctcctgcctcagcctccctagtagcctccctagtagctgggattacaggtgtgcaccaccacacccagataatttttgtttttgtttttgttttattttgttttgtttttgagacggagtctcactctgtcgcctaggctagagtgctggagtgcagtggcatgatctcagctcactgcaagctccgcctccaggttcacgccattctcctgcctcagcctccagagtagctgggactacaggtgcccaccagtacacccagctaattttttgtattttttagtagagatggggtttcactgtgttaaccaggatggtcttgatctcctgacctcatgatctgcccgcctcggcctcccagagtgctgggattacaagcgtgagccaacgcgcccggccaatttttgtatttttagtagagacggtgtttcaccatgttgaccaggctggtcttcaactcccgacctcaggtgatccaccctcctcgacctctgaaagtgctggcattccaggcatgagccgccgcgcccagccctccatctacctttatatgtacctgtttaaaaaagtgagtgtacactcaaattatttaatttttggataatggtacatgtaagccaatagcaattaacactgaattaataagcatgctaatgtttgtgtgctgtgatgatttactgagagtataattacctgcattaaaaatgtatagaagccatcatttactttcatgttaactaaatgcttaattatttaatccttcatgcaatgggcttagtgttacttggtttgtttataaaatgatatgattccttccccggttccacagacaggtcttagaagcataattaattattctttttatttgtttaaaatagagacagggtcttccttttcggcctggttggcctcaatcaatcctctcaccttggcctcccaaagtgctaggattacaggggtgagccaccatacccggccgggaagcagacttattatgaacttttttaaagtagtgaatgtctttgtcttggttttcctgcattcactctttctgtctataatctaagaagagtgctcttttaaaagatgtaagtcagattatattgtgcctgtgggttgagcctcctggggcttcccttagcaattggattttttttttttttttttttgagatggagtcttgttctgttgcccaggctggtatgcaatggcatgattttgactcactgcaaccttcacctcccaggttcaagtgattctcctgcctcagcctcccaagtaactgggactacaggcgtgcatcaccacacccagctaatttttgtatttttagtagagatggggtttcaccaggttggccaggctggtctcaaactcctgacttcatgatccacccacctcagcctcccaaaatgctgggattacaagcataagccactgagccccgacagcaattggaattttaaaactccagacatctgaccttgtccagggcctctgctgctgcaagacctttgcacagctattcctcttgcccaggctgctctctcccacatcctcccaaggttggccccttctttgcagctgtcaggtcccagctcagtgccatccttagtgccacccataactggctatcaagaggggagccctctccaccaccacccctggctctatccctctgcaatcaccttgcaccacagcccggatctctactgaacaaccttgtgtatctggaaccttgtgtattcttgcctgacaaggatactggcaccctgagagcagcactttcatctgacctgctcaccttagaatcctcaggctgggtgtcgtggctcacgttttaatcccagcattttgggaggccaaagtgggaggattgcttgaagctgaaagttcgaaaccagcctgggcaacaaagcaagacctcaccttctctctctctctctctctgtctctctctcacatacacacacacacacacacacacacacacacacacacattaaccaggcatgtgcctgtggtcccagctactcacaggaggctgaggcaggaggaatgctttagccctggagttagaggctacagtgagttgtgatcttgccactgcactctccagcctaggcaacagagcaagacccatccctaaaaaaacagaatcctcagagcctagaatggggctgggcactcagtagatgcacctggtttttctttttttttttttaatttatattttaaatctacatacagtcgtgtttgcctttttaggtttgctgttctatggtttttcacacttgcatacttttttttttttttttttgagacagagtcttgctttgttgccaggctggagtgcaatggtgcaatctcagctcactgcaacctccggctccctggttcaagtgattttcctgcatcggcctcccaagtagctgggactacaggcacgagccaccatgcccagctaatttttgtatttttagtagagacggagtttcaccatgttggccaggatggtctcgatctcctgacctcgtgatccacccacctcagccttccaaagtgctaggattacaggcgtgagccaccacacccagcccacttgcacagattcttataacctccatctcaaacaggatggagagcaagtccaacctctctctgtagtcagaccctggccccattcttagcctctggccaccatctgctgtccctttctatagctctgccttttccagaatgtcgtataaatggaaacatacattgtgcagcttttgagactggctacattcacttggcataaatgcctctgggattcattctgtcattgcgtgtgtcagtcgtttgttccttttattgctggagcacagtccttgtgtgatcctaccacagtttgtttgtctggtatattttctcttcatgatggatgttgaattaacatgaaaacctctggttgtaagagcgacagcatactctagaccaagtacactaaatcgcagtgatactccctgcacaaacagccattctgtttggtaatttacaggattacagtttggtaatttacaggaacctgcatgtcttagaatgtttaccaatgaattacaacttttaaaatgatatgcaagtaatggccgggcgccgtggctcacgcctataattccagcactttgggaggccgaggcaggtggctctcttgaggtcaggagttcgagaccagcctggccaacatggtgaaaccccgtctctactaaaaatacaaaaattagctgggcatggtggcatgtgcctgtaatcccagctacttgggaggctgaggcactagaatagtttgaacccgggaggtggaggttgcagtgagctgagattgtgcactgcaccccagcctgggagacagagcaagattccatctcaaaaaataaaatgatatgcaagtaatacaagtaacattctcctgggaaggaccaccatctacagcaggagattcagaaatgaaaatttctcttttcgtctttctgtctatcccacctcatatgaggtaagcactgttagtcatataacttgtgtccttctagatctttttaaggcccctttacctattttatagtatgtatagctggggttttttcaacataaatttattctgcaaatatttgagagcctactgtgtgccaggcactgcagatgttggctttctttcttggagacggtacctcttctttttaatggcagcatagttttagagctaggatgcaccataaggtacttaatgattttcctgttgatgaacatttgtttctaaatttttatgacttaaactaatgccactggggacaggtcgtcaatataccttttttttttttttttttacagctgtgctgagatctgttttacataccgtaaagctcacccatttgaagtgtatggttcagtgggtcttagtatactatcttcacagaacattttcatcactccgaaaagaagaagaaaccctgaacctgccatgaacagccacttgcccttcctcctcccagccccgggcaactgtgaatccactttctgtctctgtggatttgcctgttttgaacctttcatataaacagaatcacacactatgtggccttttgtgactggcttcttccacgtaacataatgttttcagggtccactgtccatccgtttacagcatgtgccagtgcctcgttcctttttttttttttttttttttgagatggaattttgctcttgttgcccaggctggagtgcaatggcgcgatcttggctcactgcaacctccgcctcccgggttcaagcgattctcctgcctcagcctcccaagtagctgggattacaggcatgtgccaccacgcccggctaattttgtattttaatagagacagggtttctccatgttggtcaggctggtctcaaactcctgacctcaggtgatccacccgcctcagcctcccaaagtgctgggattacaggtgtgagccaccgcgcccggccgccttcgtttatccatccatcagttgacaaacatttgggctgttgctactttggggccattaggacaacgctgctgtgaacattggtatccaagcatttgtgtggccatgcactgtttagcacatgtctacttctgcaggatgaattttgaggaggggaaaaagaccccacttatagctagctctttgtctctgactgtgtaggtttgaacatctcgtaagtcttgagaaatgcttggaggccatttcctgcagaggcacacgcccctcttgggtgggctgggggaggcagtggcagagcccagcccacctgccccagccaccagtgctcccgggttttgcattcagcccctggcacacactcatggctaaccctggtgcccttgcctgtctttgacccagcactggcgaaggaattggcaaagccaccaggttaatgatgcaagccccagaaacttgcggcatagatgagaaggcaaatggcctctccttttggagaactaaagagatttaaggaagcttgctggctcactccctctcaccggcaaggatggcactaaacacagtccgcatcaatcactgtttttgttatgcgatttatgagttgctcagccgagaataaggttgcacgtggtaggaggagttctgtgtgtaccgaggtctcatggaaggactggatttctagggaagaaaagggaaaagggagttgatgttaaaatatcatttctataacagtaatgcagtagtgttcatctagaaggagagctgccacatttggcaagatgctgggagagaaacaagtattaagtacttggttaaaatgacaaaccccacaaatatgccctggaatgaatatagctcatagcaggaggcactccctaaagggcttagcaacatcacaaatagcgaagagtttttgaaatcacaaatagcaaacagcataactgcttttagtttcagatatttaaatctgcaaaaaatcagtaaattatgtgggttacgttataatggtgtgaattacaacgatgacgctaatgaacatttatgggcattttccgtgtgctgggctggccattaaactccacactttgtaggactcctctcatttaacacaaccacccaacacagatagaagtattttctccgtttatggacaaagaaatggaagtgcagaaagatttaagtccctggctgaggtcacccagctagaaactggaggacccaggaactggacccaggcaccggacccaggcaccctcgcctagcctcctgttttagagctaggatgcaccgtaaggtagttaatggtattccagttgatgaacgtttgtttcttatttatgtatttatttattttgagacagagtctctctctgtcacccaggctggagtacagtggcaccatctcggctcactgcaacctcagcctcccgggttcaggcgattctcctgcctcagcctcccaagtagctgggattacaggcatgcaccaccacgcatggctaatttttgtattattttttagtagagatggggtttcgccatgttggccaggctgctctcgaactcatgacctcaagtgatctgcccaccttggcctcccaaaatgtgctgggattacaggcatgagccaccgcccccaacctcgtttctaattttttgtgaacaccaagctccgaaagccaagtaaaggggtgacgctgtgtatttcagagctcgatattccctctgctttcttcctctcctctgtcccctatgccagatcctccaactgttcatgacctttgaacttgagaagggacctcttttctgctttatctacacctgctttcctggtgatctcaccgaggtacaagagttgaaatgcatcttagaacctccagtgtcctagtgtctgcagcctggctcactccccgaatcctggacttgtgtacctagctgcctaggtggcagctgcatgtgggtgtcatctgatgggcatctgaggcttctgtcacccaaaactgggtgcctgattcgacctcacacttgtctctccccagaccacgggcttccccagctcagcaccgggcagctccattctctaggtgctcaggccagccccaagccttaagtcagcctcgactcctctctttctttcaccctttatgtcaaacccgtcagcaaacctggctggctctgtcttcaggtgtctcccaaatgagagcactgctatcacgtaagtctttgtcacctctgacctggttgtccagccctgacgtttgcttccattgaccgttgatacttccaaaatatctgtcagattgtgtccctgtgccctaaaccttccagtagcttcccagcacactcagagcgaaagccaaacactccactgtggcctccttgtgtctctaagtccatcttctcctcctcctcctcctcctcctccaccttctcctcctcttctttctcctcttcctccttctcctcctgtcttaatctgtttgggctgtttcagcaaaaggccatagactgggtggctgtaaacaacagacacacatctctcagccctggaggtgggaagtctgagaagagggtgccagcagggtcaggttctggtgagggcttccctctgggatgcagatggctgtcttcttgctgtgtcctcacatcacatggtgggaagccagagagagctctctggggtcccttccataagggagggcatgatcccaccctcatgacctaatcacctcccaaaggccccacctcctaaagctactgccttggggtgaggagttcagcataggaatttaaggggacacaacattcaacccccagcattcccccagctccctctggtggcctcctcacgtgacccgtgtgaccccacatgtcccgtgtgcctcagccttgccgagcaccatccctggcagagccttctcagcggcgacactttcctcacctcactctgcctctgtcctgtcactgccccaggtcaccttgttgcccctggcccatgtcgcactccacttgtgcatttgagtgtatttttcttcagagcatttgtcacctcctgctgttctgtgtccatggtgtcgtctgtctctccctgaggggtcagccccacatggtcagggactcaatctgtttcattccctgctgtgtcctcagcacttgaagccggcacatggcagatgctcagactgtgtttgttgaatgaatgaacgatggctgagtgtccaggctctgagggagtgtgttatgggcacccttcaagccccagcccctgtacccagggcactgtgtggggtgaggagatgcaccagcacaggccgggtgctaagaggaaggtggaaaggttctagcccaccttctcttctcgctgacttgaggttaggaaggggctagcttgggatgagaggaggagcttcctccacactgtggcatctgtaccccgcctgatgttccacctgaactcctgccacaagctccagatctgttcctgtaccgcacccccacccctgctacaaaaccccggctctctgtttgcccacctggtccgccgctttgggcagagctgcccttcattcattttccatcttcccgagggctgaccttggctgctgtgggtcattagtgatgaggcccagaacctcagctggggcagaacgagttcctgctacccagggccggcctgtctgggggctgcctagaagtcgccctgtggtcctctacagtcattcctgtgtgaggacgagacacacactttccacttgctggagaggagggtctgggtggctttttattggtgcattcaccctctcagatacttcctgatcagtatgagctgggtaaacagccaattcagatggctcagactcccggaagaggagcgcttagcccaaattactggtattagccgtccgcattcaacctcatcttaaccatgaaatttgcacggtaaaaaagagaatttgacttacacagaaatgcaactgtgtcttcatcgttccactctacagtaagcttcagagggctttcatccattcagccttccttctttccatctttaattgttttgaaattccatttggatggaaatatttcaaatatttattttttgtttttatatatctttttgcagtttttatggttttatttaaacacaaaacatgcacatgagccgtctactcattttcttcactgcgcagcctggcattggggttggtgactctgacggcagctgggcggccctttccacgatggttttgtttcttggaggaaacactgtgagcgatctcagcacagggagatttgttgcacatcagcacttccagctccttgacgctggggaccaggaacttccggaagccactgggcagcatgtgctttgttttttgttgctcccatgaccagtgttgggcatcaagatctggcccttgcaggcgcggtggctcatgtctgtaatcccagcactttgggaggctgaggagggtggatcacctgaggtcaggagtttgagaccagcctggccaacatggtgaaaccccgtctctaataaaaatacaaaaactagccaggcatggtggtgggagcctgtaatcccagctactctggaggctgaggcatgagaattgcttcaacccggaaggcggaggttgcagtgagctgagatcgcaccactgcactgcagcctgcacaacagagtgagactctgtctcaaaaaagaaaaaaaaatatctggtccttgaaccttctgcaaaccctattgtcaatacctctgggtttcctccagttacacttaattttgacatgttggtctgactggtgccagatgaactccttggttctctttttgacgatcttgggcttcacgaggggtctgagggcggccatgatgctgaggaggagacagctgccacctccgtaggcagcactgaagagagaggggccttttttttctcttttttctttgttatgtccttggaaggaagacttcatgtttcttttttgagagacaggatctctctctgtcgcccaggctggagtgcagtggtataatcattgctcactgcatcctccacctcctggcctcaagcagtcctcctgcctcagcctcctgagtagctgggaccgcaggcacacccaccttacccgaataatttttaattttttttctctagagacgaggtctcgctttgttacccaggctgttctcaaactcctggcctcaggcaattctcccacctcagcctctcagagcgctgggattacagacatgagccactgctcctggcccaaatatttatcttttaaaatgtatgcagaagtgaaacatgctttccaagagcagcaacaggcagggtcacccagcacccaggtggatacttgggccgccaaggcttctggaagccaggacaaatggaaagaatattggaacatggaaaggtctgaaaggtggcaatttgtccaaatctacagttgaatcagaagagaagcggtgggtcaggaagagggtgatttgagttctgtttcatcagactcatctctgtttctctttccatctctcaggcggagttagaacattccatttttttatccaaaattatcttttgctcggatttgggaactgacttaatacggagctgggaatggagacaccaaaaacagaaccagacaaagctgagggtttgttctcgcccctcctggacagcgtgagttgctcgctgctttcaggccctgtctgaagtcatccccaaccccacaccgggagaaaatgtttcctgagaaaaatgaaaacccctctcaaaacttgatggaataggaaagccatttaaaatattttacaggttttaaggtgcctttttacattttaaaaataacatttcccctcaagcttttgtattaaattgcctttctaaaacagaattgattttagtgtatcttcttagaattaattgggactaattagtttaaaaacctaaaatacctccaacatttccctctttgggtttaattctaataatgagtttaacaaaaagacccttttgctgcatcttctcagcgcacactgaggttttgctttggggttgaaactttcatggggacagaaatagaatgtccttttgtcgttctcattgggttggatggtggcatttgagacaagcaaagagatgacggatggaataaatatttctaattttgtctttcttcgcttcattttcatttcttcagagatccctgggtcttgctgaggggatctctgacttggcttgattttctgtcccgggccaattgagatatgtctgtgcctcaaagatagacgatcacttaaaagtaccgacaggatctttccctcccaaagacaggcgagacctcctcccgtcaggctgagtccattccttgtctggagccagggagctctgcttcccaaactctcacagcaagattcctggcctcactcatttgtcttgcattaaatttccttgcaatcttgcataattcgagcatgacttagcaagaaatgcatttttaatatgtgactctaacactttcttatttaaggatgcatgtttgtacgttgacatagcaagaaaaataggtatattaaaactcatttctaataatactcgagtgtggaaagattagccatttggcaaatttgaaaagaggtatggagtaaccataaggaaagcagtgagggccaggcacgggggctcacgcctgcagtcccacactttgggaggctgaggtgggaagactgcttgaggccaagagttcaggaccagcctggacaacatagtaggaccttgctactacaatttgtttgtttgtttgttttaagtagccaggcgtggtggtgtgcacctgtagtcctagctacatgggaggctaaggcaggacaatcactgggctgagggcccaggagtttgaggctgcagtgagctatgatccaaccactgtactccagcctgggtgacagagcaagaccctgtgtctagaaaagaaaaagaaagcagtgaaaaaggcaaatcatgtgcataaacctgaggagtggggcttctgtcaggcattgaggtgggaccatggggtgggggcaagtattggtcacatggagcccatatgtgactatgaacccagggtctgctggaggctctgatgtgaggtctgtggacctaggtcatcatactttatacccaggccctatcgtgtggcttcaagcccgtccaccctgctgagagtggaggcccccagcagccagctattgaggctggcgaggagtaaacacagggattccatggatgaagaatgggactggggaccaggacccccctccagaaggactatgacttggtgtcaccttccagggtggacactctgtcttctctcctgtactggtggatgcatatccatgcacctagccctggccaagcccacctgtgttctgcaggacatcccattccatcccatccacatcccatcccatcccatcccatcccatcccatcccatcccatccacatcccatcccatcccatcccatcccattcacatcccatcccatccacatcccatcccatcccatccacatcccatcccatcccatcccatcccatcccatccacatcccatcccatcccatccacatcccatcccatcccatcccatcccatcccatcccatcctatccacatcccatcccatcccatccacatcccatcccatcccatccatgaaagaacatccacttgcaagtctcccttctttctcctatcccagttccctcctggtaggtcctacctgctattatttctttcattttcagaaacccgctctcagtttcctcttccagctgcctccccattcctcttcctatctttctagcaaaaattcctcaaaagagccatctggtcctcctgtctccagttctgctccacttggggctctcttgaacctgctccaacctctgtggcttttgcacacacttttcccctggagctcctctgtcacaatcactggtgacctccactttgctgattccagtgatcaccactcagccccagagtcacttggttctcaggacaccacttgcttatacttctttggcctcttttcaggctcctgcttctttgggatctctaaatggtagacagccccagaactcagccctaggcctcttctctctgctcttccttggtgagcccagatagtcttatggttttaactaggtcatttatacactgatgactccagcctacatcctgtatacactggtggctctagctcatgttctctatacactgatggctccagccatgtcatctatacactgatggccccatcccatgttctctatacactgatggcttcagcccacatcctctagacactggtggctctaggtcatgtcccctacacactgatggttccagctatgttatctatacattgatggctctagttcatatattctatacactgatggctccagcctgcattctctatacactgatggctccagctcacccctcagcctgagacttatgtaatctgcctgctttctcagcatctcaacctgggtgtctaggagcctctcacactttacaccttcagaactcaactcccaagtgctctccaggcctttttcttgggtaattttcctgacctcatccttttagttgccaaaaaccttggaggtacccttgacccgtcagcagatctggctgactctacctcctatgtttatccagagtctgacggctttgcccctccatggctcacagccaggcccccctcccttgcccagattatcacattagcctccagattgctctctctgctcccacccttttccttcttcccctattctcaacccagcagccagaggggcctggttaaaatgcaagtcaaaccaggccattcctgggctcaaaccttgtgatggcttccatttaccccaagcaaaagccagagcccctacaatggcctgtgtgggcctttctccttgccttctggttcactcagctccagtttcaagccaggcattgtcccacctcggggcctttgtactggcttttccctccattaggaacgctcttccccaggatatctggacagctccgtcccacaccttcctcatctctttaatgagcccacccagggaagcatttgacaaccctttaaaaattgcaaccccttcctatcccagcactccttctgtctgcttccttttccccctggtacttgtcaccatatgatatagggtgtcatctgacgtacgacatatttttctcacttaccttgtttactgtccatatgctcctatcctcccgcatggtctagaatagaaactccatgagggcagggaattgtgttttgatgactggtcaatgccaggcccatgctatggatccaataaatattttattgaaatcaatgaatgacacaggatctctgttactcatccttctggacatggggtttggagtcctcacagccgcacctcaatgcctcccttgggatgcagcatccaggcagaacccagccgtgtcccctaagcaaagcctcccatggcaccagctgctggtgatttgacctccaggactagcattcaaggttgtcaccacatcaccacttagccatacattaacagcccaagagtctggcttcaaattcctcatctccctgcaacacagattcaaattctaacagtatagaatctgtcttcctttcttctcagggaggcatgtctattccattcctattctaggaatgactcctggatgatatcttaaaaaaacagtttctgtgcactgactgtgtctgtctcaaagggcaaacctccgctgagagctccttgaaaggtatgcttggtcatgcacaaatctatcagcattgtgtgcttttatcatccaaaatgttgacccatcgaggctgcagctacatgttgctcattctatcaaaatgttttaagatccttggctgggcccaccaaaaacaagagcactgcttagagctctgtgttccccttgaaaggtggtggtgccacttcaccctctcctggtcccaaagcctcagagaagccatgctcagcctgaactgctccaggcagaacaaaagctgcactagcttcagtttagcccttttcttttcccccttcatgggtcgagattgcccaaccatgtgcctcctctttccggagatatgtgtcccttgtgtgtcctgccatctgggggcatctgatgtggcctggcttcctcttagaaaagtcttcctctctccgggtagggagggaagagccggcgcagtgatgtcaaagatatactgtaagtccctcccggcaaagccccacaaggcatttctgacgctgagtcagtggttccctttgcacttgttccatacgtacatgatatttccaaaagtcgttttaatttggtatcaactcctctgttttcacacttttttccaaatagcttaatccatgattcattttacttcgcccagaaaacacttgtgcagctatgaactctcccacattgtttgtttgatgataaatagattctttcctcttggagaaaagggcactttctcctcccagtactaggaaggattgaaatccctcctgtgatgccctcttacctcagagagagttgttcctccttgggttttgttatttcagaacaaatatggtaaactgttttcccctcagttactatagagaagagattatttgcctttctcttagggcttctgaaaataatagattacatatttgagagggttttttttagatctggttaatgtgagatagagggggttgctccgggatgacattgtttggtttgggaagtattctcccggttgcccagcaacaggctcttggaaacgggagtggactgcgttgcccctggcaaccgttgttacttagcaaacaatgagggccgggcaaacagtgccaagactgcggactccaggttttaattgaacatctgcatatatttttctctgattaaatttgagtttgatttgccacaacaggcagacatggatccactcgggatctgcttgaaagaaccaatattgtaatgttgactcccaggctgcacaaacgcagaggccccattgaaacaaacttctggccattcgaatatgtcctagactgctctcaactggagacttattttagtcttaagtggaatttcttttttgatctaattcctggtgttcagaaaatcattacttgtccaacctactaccgtacatcactgataaatccgcaatttctggagcgcttttcagcacgatgccttcatttctgctgcctaagaatttcagaagagcaaagagttgagccctggctggctcacatgtagagacattcacagatagggttggctgagggtggaaattggacccagcaccttctggtttcatgtgctcaatgttcctgttaagaagttgggtccacccgtggccctcagtgggatgtgtatgttatgtttattaagagaggtcgcacgttcccactaacaaagtgccctgttgatgggcactttgcagccacaggttggattttgatcaaaacagcctcactcccccacctcctccgctggcaagccagagatagcgattgttgacaagggtttgttgcttaggtaaacaccacccctgaacttcattcagagcgggtgacacatttcttcccctcctcccagccccgcccccagcccccgcccccactgccagggctataaattcagaactgttagccaagacaggtttttggtgaagactttattcttcctcattcatctcgagtgcaatctgactaatgcagcaacagccgcaaaagtgccgcctgtaacagacactccagcccctcactaaaacagctcctgtggttcccgtggtgagactcgctttagttgtatggattttttttaaggacgattcactttgttgctgaatgcccccaagaaaatgttcattgcacgtttgttaccggcatttcagctaatcttaggactatttaaagtatctaaacaaatttcccaactttcttttgcagcagaaacttataatggaatgtcatttgtgttttttttggagacagagtctcgttctgtcgcccaggaagctccgcctcccgggttcacgccattcttccgcctcagcctcccgagtagctgggactacaggcgcccgccaccgcacccggctaatttttttgtatttgtagtagagacggggtttcaccgtgttagccaggatggtctcgatcttctgacctcatgatccacctgcctcggcctcccaaagtgctgggattacaggcataagccaccgtgcccggcctttttttcttaaaaaggcaagctgattagccatcagccttattagatgtgataattaggatccaatggctgcgagtgttgttggaatgaaaatgaataaggtctgacttacacaaagactcccccaaagattaaaatacattatttgtcctgcaacctgttgtaggatagtggtagaagaccactatatacttaaaaagataaatcctcccaaagaaatgctgttctaccttctacaatattattttctgcccagtccccagtttaagtaagtcatttttcaggaattagagcctcatttaaaattttttttaaatttatcattttcttatttcccatggaagtattttcccatatatcaggctttgcaatttgggcaaaccacttaacatctttaggtaagtttcttcatctgtttgatgaaagagctgggttaggtggtttttaaaggggcctctccatgctgtggttttagatggaaattcttgaatttgaactaggctctttctccgcttcttaaattccagaatcaaatcacgactggaggggaggtaggaggtagattgaaaaggtcccctatgtgatgttggtgggatccagaaagccagcctcctcctggccagaatcagtcatggagatgtggaaagaacatgcactgcctgttgccctgccctcactggctgtctctagagatggctgtcaggaggaagggtcacacaggcaggacgagaccccatccccaggtgggcacaggtgcccagtgggcgtgctgccgggtcaggtcaccaggctgagaaagcaggagatgctactgctgaggaactgtcacttgtcatttcaaggtccactcctccaccctctggcagcatgagtcgctctgaaagattttgaagctgggacaggagagggtgagtgaggtgaggcctccgcatgccaggttttcactggcacattccccatcttcatcttgaccatcagcagctgcactgcagccctgctcatggtcagaaagggagagaaacgtgagagggaaagaaaggctggtaagagaaggagaacacaaaagcatgatgccttaggaagccgcttccaagaatcctgggacaggcccctgtgctcagctgaagacgggagctggaggccaacatggtgaaggtggctagaacaggtgagcagcccggagcaggcgggctgctcattctcttgttcattgcaaaacacgtcttgagcatctttgcaggcaatgtgctacgtagggtctggggttggggtgagggatctgtgagggggctgctgagatgacatagatccagactttgttttctcaagaagggctggctggccaagaagccagatgtgaacagctgcatgacatgaagtaatctgaggggacaagcacggagagtggtttggtgaatctggaaatgctgtgtggagtaaaggtgtggccttagacgtgtggttctccatgggggtggtcctgcccccaggggacactgggcgatgtctggagacatttgtggctgtcagacaggggtcggggggtttcctggcatggagtgggtggaggccagggatgctgcccagcaccctgcggtgcccaggacggccccaccccagagtgtattcctgcccctcatatccgcattgctgaggtcaggaaagcctgtatgacatgacaagctgactggagagagggtttccccactgctcatcacttgcctgggatcccctttggagctgctggctgctgtctctctgcctccctccttcttcaacgcagcagtcactttaatcttagctgtcatgggcgggtggactttgagggacagagggctgcccagcctgcctggccctgctggaggggtcttgtccatccccaccctggcaggtgcatggaccccatcctcaccctccctgcgttgtgtgcaggagacaccagtgccagcctccggtggccctccatgcactgcagccaccttgtcactgcgagtctggaccgctgtgtgccatgctggcctccctcgattctgcagaccttagacttgcaggcagaggctagctgatcagtgaagggctggcgctcaggcctgggggtctggcaggcgtaggctccaattccgttggaatcagagggtccttgggggttgtgtggacatctcatttaaacactccatccggaatcagaggaagcccggctttccccacagagcaggcgccaggggagagtttcaaaccaagtagctggatgcatgagggagaaggcggcctaggagcaagagcgagagcggcaggacaggagggatacgagacacagcagctcacgggaggggatgtgggtgaccccagcaagggccaggcaccagaaaaggacagacaggtgacattggtctctggaaggggagggaaaggacgagcagatattgaatatgcgcgactggccagggagcgacccccagatctttacattctgaaaaacccactgctttaaacgcacagggaactgcttgtggggatagacagagggaacgatcattctaagtcacgctgatttaccttttcctcctggttactgagaatgaatgaagagcacttacttctcaactggaaccacagagggctggagaaatgtccaagtccagttcgagctcatacagtcactccccacggggactgtatcagttcatgatagctccaatagcatcaactaaattctagaaacttctaaagcaaaagctaagcttgtgttgttatttggagttctctttggcatggggttggggaagcgatttatatacagaaaagagacggaagctccacgtaggtcgggaagctgtggctccggaggctctagtcataaaaacatgtgcttcctcctcctaaaggagtgacttagccaaacccaagccaaagccagttccagtctagcctgcctcttcctgctttgtgaccttcagctcatggctcgccctttctgagcctcagttgcgtgtgtgttgtgtctagagcagaggtgatgtggtcacggcttcctcagagtcagtcagcccccacgtataccagctttgcccgcagtctggggctcggtctggccaccagctactgccgctgctgttgtccttggggttgtgtccctctttctttcggctagtttggttttttggttgtttttcattgttttgttttgttacttgtttattctttttagagacagggtcttcctctgtctcccaggctggagtgcagtagtgcagtcagcttacttcaacctcaaattcctgacctcaataatcctctggcctcaacctcccaaagtgctggaattacagacatcagccaccttccccggcccccagtttgttgttgttgttgtttgtttgtttgtttgtagagatggggcctcgctatgttgcccaggctggtctcgaactcctgggttcaatggatcctcccgcccctgcctaggacatatttcattgatcaggcacctgctgggatccacactcggggtgggcacatcagctatatcattcccttccccctcccagcccctttctcagatgaagaaaccaaggccactgccacagtcagtaagcgagtgacaagcctgggacttgaacctgaagcctggcctcctccctctgctccgggtggtcatacctccttcccagccactcggcattccccttggcatttgttcttatttatataaataatggaggttgcaaagtctttttcccccggctgcagccgactccccagtaagatccagaggcggggccgggagtaggaagggaaccaaatgttccgtttctttggatgcattctgtggggcagggctctctgcctgcctacggacagtcttcaggtgacaaggtcttgatcagccagacttgtaagtgtgaagggtaggctccaaccctctaaagaagggatcctacagacagcagaccttttcgacatcgaaatgtctggaacccccaccttggtagttaatcccttgatttagcacacacactgtctatgcggtgaaaattcttgggaggattttttgagccagggaatgagaagacattgttatcttttgaatcaccccaatgtgaaagaaaattggctgggagagggcagaggctggaagcagggagaccaattaggaggcggatgtggtggttccaggtaggagatagggaggcaggggctcactgaaatagtagcagcaggagcggaaggaagggggaggcagagatggtatcaggtggagacagcaggctgagtcaccagcgacacgtgtcccggggcgcagggagatgcccagtgccttgaacagccccctggcttaggaaacgcaagaggagcaattttggcggggggagagtttcccttggacttgttgaggcacctgaggggcgcccaggcagagaggtctgggaggcagctggagaagggagccggagtcaggtgatttgggtggtgctgggagtcctggtgccgggaggtcgtccacattgagtgtgacaggggaggggcacaagggtggaggccgagggtgggagacaagcagggaccagtgcaggggactgagaaggtatcattagggggaaaaatgaaaccagatgacaacagcacccagacacgagggaggacagagcttcgaggagcgacacgaaacactgcagagagtacaagttcagaggaggcccgaaaactgccccgtgaggacctcaagaagaacagcgggcagacatgagaatgcagagagaagacgacagaggctccctcctgagagtctggacttacaaataaaaaagaatccatatctcaagagaagataaaggataaagagcagggtttcagtggcagtggatgttctcctcaaatgggtgtgatgtgagcttgtctataagctgaaagaatggagcctgtgcagaagccagattgcaggcttgatcggtgggtccttggagggagacggaaggctctagaaccttcaggaagggggccagcagccttttcctgtaaaggaccagagagtacatattttaggcttctgctggggtctgtctcagctcctcgcctctgctgttggagcacaaaagccatcatagataatgggaaaatgggagttgaagatgcaaggaactggatgtagacagtctggatgtgagatagtggggggaggtcagcacagggaaggagttgtggggtagaaggaagtggaagagacagcatggcaggggcatggctgagagccaggaggtgcagaggcggtgtcagaaaagggggacaaaagagttgcaattttagaatggaatcttgcaaggagaaaagtacagagaaaaaaatgtactttgaggctttctcccaaaggcatgtgtgtggatgtgtgaacacaggctcccccccatcactttttactacaagaatcgttgtttttgtctagtgggaggagtcaacattcaatttaatagaaaaatgtatggagtaagaaaatgacgtgtcttctgagtggttttggccattcttctcatattatcctgcgtcaggtggtgtatgtgtgtgcatgtatgtgtgtctgcatgtgtacttttgtgtatacatgtatgtacatgtgtttgtgtgtgtgtgtttgtgtatatgtgtatgtccatgtatatttgtgtatatgcatacgtggggagtgtatacatgcgtctgtgtgtgtgtgacactctcatgtccactcctgggggacagatatccactcctgggggacagagcaccagctgctgctcggcctctagcttggtatccagttacctttcactccaatgtgttggactttagggcaccccataacctaaggagaatttccatttcctagaaaccaagttttgtggtgttgaagttattgctagaagcagtggaatcaggttgcctgccaaaagagtatttgctgggtgaaagtgtcatgaagacttggtggttttttaattcaaaattcaccctgaatttggtatattattgatggcagttaaaatcagaccacatcagagatgaggtaaccatactttagtttggacaatttttatattaatagtcaaatcaaggccaggcgtgatggctcacacctgtaatcccagcactttgggaggccgaggtgggaggattgcttcagtccaggagttcgagatcattctgggcaacatagcaagacccctgtctctacaaaaaattaaaaattagccgggcgtgctggtgctcacctatagttccagctactcggttggctaaggcgggagggtcacttgagccagggaggtcgaggctgtagtgaactatgatcgcatcactgcactctagtctgggtgacagagcaagactctgtctgaaaaaaaaaaaagtcaggtttctaaaagggaaggaacgggtgtttccactgttaagacgggggtccctggcttaggggaggccttgtcagcgcagcctgctctcagcctctgaagattagaacctgcgacttaagggcctactgggtgtctgcactcccccatcccccttccagtctgcaaacagccctttctcaggccagttgtcaagggcttggttctgatccttttctagagaaaggagggaaagtttggctcctgagaagaaaacaggaacagaagcccaattcttacgaaaagaaaaaggaatttgaattctgaagatacttgatttcagagaagctcggagccagctccagtccttgaaagcccattgctacaagaggagaaaaaaaaaaaacccaaaagtgaggaatgacgggcacccccgtggcttaggcacggagggaacgatggttgcccttggtgtgcattgaagcctgctgctctggaatgtgtgggtagccttcagagggtcctgttcatttatttcacactccttgcctggctgaattgtcatgattttgcatcctgcctactctcctttttcatcttcctgttctcaccctgtctacaggcctgttttactcgggggctgtttgtccagaccccttcttagacatcacaaatccattttgaacagaggtccttctgcgccccaggggacactgggcaatgtctgggaacatctgtggttgtcacaactgggggtgctcttggcatggagtgagcggaggccagggatgctgctcagcaccctgcagtgctcaggacggccccagcccagagatggatccgtccccaatgtccacagtgccaagtggggacacacactgtcatctttggtgattatcagggcagagtaataactcttggcactgagaaccaactgggtccacagggagtaatcctggtgccagaaaggacatggttccaccatcaaggagggttcgagaatccacttttcggcaaggagatggcttggaggtgtcctccctgtgcgtggggccaggccacacaagcctgaacagtgaggacagaatcttaaaacacgcatcacttactccgaggacctggccctcagaggggagccgggagaaggaaacggacaagacttttctgggcagcctaatgacactgggagtgttaagacaagctaccaggacagaatctgggctttgaagcaactggtactcctgagagcactccgggcttgttccttcttgttcagagggaggaaattaattgctttcttagggcagatgaactctggtaccatctggaggccagcgagtaccaggagaggaggagctgatggccggaggaggccacgtgcctcccaaacaccgaggctcatcagccaatcagaatgaaggtaactaaaaccactcagctaactctgccccaattatcaccaaagatgacaaaacattgtctaaatactgatctgaactatgtgaggcaggtgacagctccatttggcatatggaggaacaggaatagaagagagattgcttaaggtcgcagtgagtcagcggctcagccaggaacgggcccagaaattgctctcagcgttttctgcatttcctttcctgacattgctggttactaggtgatgggagtatttttctgtaaacagaagcctcttccctttgtgcccaggcagattcattcatcacggccgtagtccagggctgcttctagctgcgtctctcctgtgccccctcacatgaagtcaggaagccacgggagatgttcccactggcgcgtttgactcagcagtggctccaaaaggtcaagtgcgcatctggttcacttgaatgttcgttcaaggtcaaatgagcgtttcgtggattccaaaggctggtgccggccaaggaggggaaattgcgccgctggttctgtgcttttcccctttatttcatgcccgccctgatcttggaccagatggtaaatgaaacgtgctcagcttataaacagcactccgggcatatttctgaggcacgagggagggagctttgggccagccaagcccgttggccaggcagggccaggctgggtgacaggtcgtgttgcggcccctcccctttatattggctgttccgaggctcctgtaacccagtctaagaggacacaggggaaggcagtcaaagtaagactgcccaggtcctcgccacaggaagaaaaacagaagagaggacaaaggaacgcgagaaagcaaggacggcagggcagtcactgaatgggtccaagttcccacagcagattcaggttcagagaagaagcatggcctccactcactcacatctactgtcttgcactggattgaggggttcccaaactgggtgctgcaaaggtgctccacagtgtgcgtccctgtgccctgtggactttaccttgagtacacccacgccctcggggccctgccctctgcccactctctgctgcgctctcctctgccaggtggaggagttactcaggatccagcatcaccccttctgggaggaccatgtgagctactgcgcttacctggaagcaccgccaggatcatgagccactcctgctcatcgctggtgtcttgtgtgtgtgtttgtttaactccttatcatggaaatttcaaacatccacaaagtaaatacacaatgcaatgaaacttatgaagccaccaccctctacagggtgtcagggtcctgccattcttataacacctggatacctgtacccactctccgtcctcctctccacccttgtatttttacaggcttcgttgtcattgttaaaattcacatacagtaagtgcacaaaccttagctggctaattttgacaaatcacgactccatgtaaccgcacactgtattatcatacagaatgcgtccatctcactggagtgtcccctcctgtccctttccagtcactctcgcccaccgccacctgcccccccacccactattatgatttttttttaactttagttttaatccactctactcatctactcttttggactcaacttctttcactcagcgtaatgattttgagattcatccatgcattgtgaatttcagtaattaattcctttctattcatgaagagtattccagtagtattcctctattagctttttagctatgctcttcttttccatttttagtggttgttttagggttttcaatatgaatctttaaatcatcataatctgcaatttctcgtccactctcctgatgaggaacatttgggttatttttactttttggtgactgaatcaaactgctatgaataaggctgaggtgggcagatcatttgagcccaggagtttgagaccagcctgggcaacatggtgaaaccctgtctctacccaaaatacaaaaattagccgggtatggtgctgcgtgcctgtagtcccagctacttaggaggctgaagtgggagaatcgcttgagcctgggaggttgaggatgcagtgagctgtgattgtgccactgtactttatcctgagggagaccctgtctcaaaaacaaaaaacaaaaaccaacaaacaaaaagctgctatgaacatgcttatacaagttgttattatttttttgaagagatatgtcttcatgtctcttggataaaaactacaagaggaattctgggttaaagggcaggtttaactttctagaaaactgccaaacctctttccagtgtggtcatatcattcatatctacacatgggggtgtgtgagagttttagttgctccatgtacttacaacattggatgttgtcagacttgtcaggtttagccattctagtgagtatttagtgatatcttgatatagtttgaatttgcatttccctagtgactaatgaggctgaccactattcatgtacttttgggcatctgtatatcttgctttgtgaagtaccatttttttaagttatttgtcatcttatattgaattgtaggagtttatatatatagatatagatgtagatatattaggatcaaagccctttatgagatacatgttttgcaaatatttctcccaggctgtggcttacctattcatattcttagcaaaatcttttaatgagcagaggttttaaattttggtgaaatctaatttctcaagtttttcttttatgcttatttgtgcattctaagaaacctttgtctaacctcctatgttctctctgagaagtcttatagttttagcttttgtgtgtaagtaagttcatgttctaacttgaaatcatttttatgtatggtgtgaggtaggggtcaaggttcatttattttccccaatatggatattctgttgatccatcaccatttgtttaaaagacttctttctctgttgaattgccttgacacctttgtgaaaatccagttgaggaagaaaagagctgaggctccattagaaaaaaaaatcaattgataatctaagtgtgggttatattatttatatattgttgaatttgatttattaatattttaaattatttttgcatatatgtgcataagagatattagtctaaacactttccttgtaatatatttgttaagttttggtgtcagggtttactgacctcataaaatgagttgtgaagtattctttttttattttctgatggcatttgtgtaataattcctttttcagtatttgatagcattcaccagtaaaactatatgtgcctgaagttttctgtgtagggaagtttccaataacatattcaatttttttgttatatgtattacattcacatttttttatttcatctgtgtcagttttgttatgttgtgtttttaaaaaagtgttcattttatatgttattgaatttatgggctaaagttgtttgtaatagttctctattatcattttgatttctgtagaatctctagtgatatatttcatttcattcctgatattggcaatttgggttttcttttcttatcagtctttccaggagaagttgttaattaactttttttaaatacttgctttttttttttttttttttttgagatagagtcttgctctgtcacccaggctggagtgcagtagtgcaatctcagctcactgcaacctctgcctccttggttcaagcaattctcccacctcagcctcctgagtagctggaattacaggtgcccgccattacacatggctcatttttgtgtttttagtagagacagagtttcaccatgttggccaggctggtctcaaactcctgacctcaggtgatccacccgccctcggcctcccaaagtgctgggattacaggcatgagccaccatgcctggccaagacttgcttttttaaagagcagttttaggttcacagcaaaattgacaggaaaatacagagatttcccatataccccatacctccacacatgcacagcttccctcattatcaccatcacccaccagagttgtacatttgttacagttgatgaaatctgcattaacacagcattttcacccaaagtccatagtttcctcgagagttcactgttggtgttgtacattctatggtttggacaaatgtataatgacatgtgtccaccattatagtgccatacagaacagttccagtgtcctaaaaatcctctgtgctttgcctactcatccctctctctgatacctggcaaccactgatcttttcattgtcttcatagttttgccttttccaaaatgttgtttaattagaatcatacagtatgtagccttttcagactggcttctttcacttcatagtatgtgtttaaatttcttccatgtcttttcatggcttgatagctcctttcttcttctgaaaaaatttcagttttgaagaaatattgcttttgttcattttctccattgtttgtggagtttctaatttcattaattttgttctttattgtttttccttctttctattaagtttagtttgtttgtctttctatatagctttttaaggttgaaaacgttcttaaatctttctaacataagcatataaagctaaacatctctttctaagcactgctttaggtgtgcccacttttttttcttaataattttacttctttttttcacccacaatatttgtaccagtgcccacaaattttgatacaaagtgtttacattataattcagttcaaaatattttctatttttctttggggtttattatttgacccatggattattttgaaggtgtattttaagttttctaaatatttggcatttttctaaccttcttactgatttctaatttactccactgtggtcaaagtgcatacatgctctgtataattatggtattttgaaatgtattgaggcttattttatggcccagaacatgacccatcacagtgaatattccatgtgcatttgaaaagaatgtgcaggttttgattgtagtgttctctaaatgtcaattacatcaatgtggttgataatataattcagatattctgtatccttagtaatatttctgcttagttcttctaattttgattcagtaatcaaaattactgaatgaaggatgtttaaaatctccgattatgattgtttatttcctcctttagttttgttaatttttactttacgtatcttgaagctgtattactaggtacatacatatctgtaatcaatatgtcatactgataaattgatcatcttatgatgaaattttatctgcagtaatattccttgtcttgtcaatgtctctagtattgctagtaatatttctcatctcagagtctattttgtctgattattacagccgctccagctttcttaagatcagagtttgcaggctgagtgtggcgctcacacctgtaatcccagcactttgggaggccgaggtgggtggatcaagaggtcaggagatggagaccatcctggctaacaaggtgaaaccccgtctctactaaaaatacaaatattagcctggtgtgatggcgggcgcctgtagtcccagctactcgggaggctgaggcaggagaatggcgtgaacctgggaggtggagcttgcagtgagctgagactgtggcactgcactccagcctgggcaacagagcgagactccatctcaaaaaaataaataaataaaaataaaagatcagagtttgcacagtggatctctttttattctattactttcaacctatgtgtgcctttatttttaaggagggtttcttttagggaccatataatgggatcttgattgttatccaggctgatcatttctgccttttcattcaagaatttagtctatttacacttaatatattattaatatgtctagatttagcaaagcaattctgccatttgctttctatttgtgccatctgtttgtttgtttgtttctctgttctttatttcttgcctttatttagataatcaaatatgttaagtaggatttcatttgatttctctattagctttttagctatacctttttgtatatatatttttttggttagtggatgcttcagaggttacaatgtgcattgttaatttatcacaatttatagagttaacatgttactactttaggtaaaataaaagaaccttgaatgtataacttaatttgtccccatcctctgtgttacaactgtcatggagaacatctacatatgatataaaccccacaatggagtgttataaagtttttgttaaatagttttatgtatttaaaataaattaagagaagaaaaggaaaaatataaaatatataaaaatacggttttttataattacctgcgtatttatcattttaagtgatatttactcctaatagatccaaatttaccatctggtattaattcctttcattctgaagaacttccattagcatttctcatggtaggcagaaaattttatcaggttttgtttatgcaaaaaatgtctttattccaccttcagtttttaagaatagttttgctggagatagaattctgggctgatagggttttcccccccagcatattaaaaatgtcactccattgtcttctggttgccattgttattgatgagaagccagtcatcatctgtgcccttgttctccgaatataatatgtagtttttctctgactgcttcttttaacagtttaaccatgacatacctatcttggctttctttgtattctttttagggtttgttgagatttttggacctctaagttgatatccatcacccaatgtagaggtgtttggccatttttcaatatttttttctcttacattctctttttctcttctgggactctcgttacatatatattagacagtttgttctattcatgtttcttcatatattttctcttcattcttcagattgggtaaatgctttttatctattgttaagttcactaactctttccattatctttaaccagctgttgagtgcatccagttaagtttttgtttcagttattgctctagaatttctatttggttctccttttatactttgtttcttgattgagattcccatatgttcattcattatgtatataacttcctttaagttcttgaagttatttttagtagctgctttagtccttgaatgctatctgtatcatctgggttatcttgcgtttggttataattaactgcttttcttttttctttttatttgttactctttcttttgagtgtatgttacactttcctgtttcttttcatagctcatggtttttactgggtcctggacatcattaatgatgtattgtagaatctgtaggttcatctgagttcccctgaaggcaagtgacttggctagattcaaactctccctcctgcaacaggcagcagctgaaatcttcacttaatttttttatctttgcactgctggtttttccccaagacccctggtatctcccccacacctttgtggtgtagttgcttagccaaagattcaggtgtattttgtaggaagatttgagggctcaccccttctgtggctctctctcttccagaatctccacaccccagcattcagaactctgtcctctgacccttcaggataacgaggctgatgctttctggcacccaagcatttgtggactggggcatgcccacaggcaaaaagccacagactcattggtctgacctataagacaacacatggtaaatagtgtgttaaattaggggaacaggctgggcacggtggcttatgcctgtaatcccagcactttgggaggctgaggcaggcagatcacatgaggccaggagtttgagaccagcctgaccaacatggtgaagccccgtttctataaaaatacaaaaattagccaggcatgatggtgggtgcctgtaatctcgtctattcaggggactgaggtgggagaatcacttgaacccaggaggcagagccaagatcatgccattgcactccagcctgggtgacagagcaagacttcgtctcaaaaaacaataataataattaataaaaataaattaggggaacacattcatgtgtaaatgcctgtgatgtggaacaacttgctttctggaaggtgcattctggccatggtggacagaccacggtctcgccatttatccccaacactctcatggcctcttcttacttaaataaggtctggagtttggagcaaaattatttccacctgcggaacaaggaactggtcttagtcaagtcagcattctgactttatcactggtggactcctttcacaaagagttctagtcaaattatctcctagtatcactgatgctacccgcttggcttcagacgggaacagcatggtggatggtgtgcaaatgactgatttaaacatttaaaggaaactgtaaatacaagcagcttgtaacagaaaaattccaaaggtcagttctgtcaaagacagagagtgagttgaggactcaggaaatacactatgggaaatttacaatcttttgaaagagtagaaggtaggaggtgcgggctgtgtaaggtttagttaacgccccagccaatcaccgtgtggctctggggccatctagtggtgagaagtgagtcaggctcacacagaacagaaaaatccccaggcactggccgtggggctctgggtggcatcgaaggcgtttgggaggggacgggggcgggggccggggagcggtggtggtcggggaatagtccccaacaatacagatgggattaatccagcacactcgaattcaaacacacatatccctttctgctttccttaggtaaattaatttattgtaagtttgacttttcatttttaaaaagcttaaaatttttttcactcattataagagataaaacctctgggggtgatagagaaacgtaaaagttctagcaaatgtctattgtgttctgacgatgtcgtgggcaccgcgatgtatgtctgaggttcagtcctcaccacccccagcaggcaggagccatggagaccccacactgggagggtgacatgctcaaagctggtgccaggacgggggactggtgtgcctgatcacaaagccacctccctacctaagtgtgtgtacttaactatgtctcaaatgctcaacatagccgattgtttatttaaaagtgaagactgttcgacttttagcattttcatggaacaaatttgtatcatctgccacgatattaaatgagtggttttatatagaattgtaaaactacctatttgaaagatgtatgcctctgacagcaaagaaatatatgtttatactttcttgtgggcaaagatggctttgaacagaaggcagtttttacttactgccaaaattcgtgaggacttttatccagcccaggataaaatgtactgtttctttgctccctctgcaggtcaccttttctctccctagccagtggttctcacactgccctccaggggtcacttggcaatatctgaacacatttgtgattgccacagcttggggagggggcgctcctggcatggaatgggtggaggccaggggtgctgctcagcaccctgccgtgcccagaatgggcctccaacagcaaagaagtatccagctcaaatgtcaacggtgccacagtggggaaacccagccttagagtttctcccgttgtcgtttggggtgcagtagcttcccaaatggcagtcacccacccagagcttttgatttctgggtaaatgaggaaacaattgagcccttcaaaatagttcaacctgctcagacttgggcacagagccagtgtcccggccttctgttgaggaattcctgccattgtgcgctgacagagccctttttgggttttatatttggaaaactttctctggcccctctctccttctgtgggacagttgtgcagcctgtttccgcagctcctcacttaggcagtaccaccagggtctctgcctttcgactttgaagaatgtagctggttactccttccctcccttgaacttgttagttgcctcttcggatttcagtgcttgcagcccttgcccacccaatctctctccgcctttctttagacctgagcatgcagaattccgagggtggagcggattcgccagcgtccgtggctctgcgtccctcggcggcagccccgcctgtgccagcctccccgcaggtaacgcgcgcctctcagcaacaacagggtggccacagtgtggacgcgatctctatgggtttgaaagctgctcagatctgcaaagagaggaatctgtatttttctgaatggacttctcagtcccagtgctgctgctgttgaaataggcacaatttccttaactgtatttggctttttcaatatttgttaaaaagatcccatcaaggaaacaatgacatgaatggaaaagaaaccactctcccaaatctgacttgatctcttcttagctttcagtggaggttttcttgtacttggaaatgacccttttacacagaaatgctttattaagaattaagaagtaaggccgggtgcagtggctcacacaggtaatcccagcactttgggagactgagactggcagattacttgaggccaggagtttgagaccaacctaggcaacatagccagaccctttctctaaaaaaaaaaaaaaaaaattagccaagcgtggtgggctgcacctgtagtcccagttccttaggaggctgagatgggaggatcacctgagcctgggaggttgaggctgcagtaagccatgattgtgacactacactccagcctgggtgacagagaccttgtctttaagaaataaaaaataaaaaatttagccaggcatagtggtgcacgtcctgtggtcccagctactcaggaggctatggtggaaggattgcttgagcccagtggtttgaggctgcagtgagctgtaatcataccactgctctccaacctaagtgacaaaaaaaaaaaaaaaaaaaaaaaaaaaggcaaaaaggcaaaagatgagttagaatttttttttttttttggggggggacggagtctcgctctgtcgcccaggctggagtgcagtggcacgatctcccaggttcaagtgattctcctgtcttagcctcccgagtagctgggattacaggcgtgtactaccacgcccggctaatttttgtatttttagtagagacgaggtttcaccatgttggccaggctggtctcgaactcctgacctcaggtgatctgcccgcctcagcctcccaaagtgctgggattacaggcgtgagccaccacgcccagcctagatgagttagaattcttaagattttgttcaaaatagaatctagcacctgaatgaacatattctttaaaattcgcagagagagaattttcacattcaggctttctctgctcctggatttctaccgtggaatgaaataagccataaagaagacagaaatacaaagcgaatggcaccggccacatgaaacaggctggaggctcatcacagtgtgcagaggtccactgtggccgtgtgaccacctcgatctggaatctaaaagttaggagcacagcaaaaagaaatgattatggttttaaaacacacaattcagggccaggcatggtggcacatgcctgtaatcccagcactttgggaggccaaggtgggtggatcacctgaggtcaggagtttgagaccagtctgagtaacatggtgaaaccctgtgtctactaaatacaaaaaataataataataataaattagccgagcattgtggcacatgcttgtaatcccagctactcgggaagctgaggcaggagaatcgcttgaacccaggaggcagaggttatagtgagccgagatcgtgccatcgcacttcagcctgggcgacaagagcaaaaatccgtcccaaaaaacacaaaaaaacaaaaacaaaaaaacacaattccgcaaaaacaaaaaggcagacagtgaagcggtttatttgatgtagtgtgtatggtcagacatctttagcttttatttcttgcacatatggcagtggggagggcgtcttggaagcccatctgaggtgaggatcagacgccgtcgccctgccagcagttgtggcctaattgatatgtttccgtgcccacttgaaattgtccaagaggagtcagccctcaggtcttcctgccaagcccctctctcaggctctcccaggcctaggtggactctgccttcctctgcagcagccaccatggacaggtctcagtgccactcacggccaccatgtgtgtcccaggtttcatcactgtggtccctctctgaggacttgccaggaccctgtgaattctccaagcacacggcgcccagctcacctggaatcagaatgcccttgcgctggcatccttattagcaccatcttcatccttagctccactcctgcaacacaggggatggcgtgtcctcacccatcacccctcgtgatgtatatatggcagtcactgctacctgtgacattcagggttcatgccgggaaatcacagcactgcagccaatgactccgaaagccccagctctcaataaacacacaaaacactcctgttcctccctcgactcgagttcactttgacccttcccattttgatagctttgtgtggccaatcggtactcccagaaaaatagcaaagccacactgtgcagatttgacttaggaggctggagagcagtggggtcagagagcgagggacccagacacagggcacctggactcgagtattctgtagccagaggcagcacttgagccctctggcttcattaacctcatcagaaaatggaaacaagtccgggttatactgcagaagcgaggggcgccacagagtgctctcccacgcagtggtgcagatggctatccagagggccccagcagtcccctctgtactagggacgatcagtgtcaccttgctgcagactacagacccacagaggcaaagctgcctgggcgggtgaaggtgcatgtgcttccgtgtatgtgtgtgtgcatacgtgtgtgtgtgcccacaattcgtgcatatgtgtggtgcatgggctgagtgtatgtgcacacttgtgtatgtatgtgcattgtttgtgtgcctgcacgtacctgccgtgtgtctgcccaggtcggtgtgagtgtgcaagtctgaccatcaccccgccgtcgcctctgatcagtcctgcctatgttttaataaaaagcacatgaacagacaaacagcatcttacattctgtgtgtatcctcagcactgacctctgacaagtctaactggccttctctcccttcccttttagagggtgttggtccaggcagccagctccaatcccaaaggggcccagatgcagccgatctccctccccagagttcagcaggtaccccagcaggtaatgacaagcaccgcagcaccgtgcaaaccggggcgcagttagcactcagcaatccagaacaatctctgaaggatgcatccttttctgtggctgctgttccttgttgtaagcttcagtttcttagccaaaagacttttccagaagctgtgcaattttaaaaaaatcatttactgcagatagttttgcagaaagccaagaaagctggtgatctttcgttcattcagaaattcagcaagcatttggggaaccagtgagcaccccgcacctgctgggtggagctcaggtagaaatgcagacagaaacaaagggctctggactggaggaaccatctgctagtgagtgccataccctcagatgcgggcacaacagaggaaatgcttcttatgatttcaattatctaagaacaaagtttgaaagcacggctgaccagccaagtagcaacacagatcatcagcttggggacactctagaagcatggttagcaaactgtttccagaaaaggccaaattatacatttttgggggtttgtggtccaggcagtctctggaacaaccactcaattctgccattgtatcgcaaaagcagccataaatgatatgcaaccaaatgggtgtggctgtgtgccaataaaactttatttacaaaaacaggcagtgggccagatttggccctcagggccggagtttgccaactgtgccctgcagaatcctgaattaaagttaactcaggctcctccctaaaaggagccctgaggccctagagaatgcaccgctcttcaggagggtcctgcctagattggcagtctgttcacaggcatttgtcaggtgactgtgtccatgagaactaggaaggtttgcaggatcacaggaaggaaaaggctccagacaggcccagcggggacgcagggcctcaggccagtggctctgtcttagctgctgtctgtcaaggcactccccagagacaccaaggagaggagattccagaagcttccaccacttttctggtgctgggcctgccccagctctttctgtaacttctgcatttcacttggaccccagaattcgacatttgacttccacccctggggcatcacccaacagatgttaacccctggaacttgtgattctgggggtggtgcgttggacaagtgcataccatgctcagtggtccaaggaggggcaggtcagccccatcctgcagcttcaagcacaagaggaaggtcaccatgacaccatgacacccgaacaagcccacttctgtggccctccatcttctcaccccaaaattcagtggatgtagacagccactaagatgccctctggggtgagagtttgaagtcccatgtgcaaagcgtttggcttccactgctcggactagagtccctcggggcctgtcagccgaggctctgaactgatgtttcagagaggggagggcagggcagcgggggtgtgctggggtccccccattgccccatctctccaggcatgccgctccttcccactctgttcagaccatcacattctctcccctcctctctgccagggaaggggcaccagggccacccacggggggtgttggggccatgtagagtctaatctgctcagccccctgtgcactgcagcctgcacgccagcttgagctacagagggagaccctgtcgcaaaaaaacaaacaaacaaacaaaaaaaaaaaacagaaaccagggacagtcctgtgagccaaggctgggcctctgtccacaactctagtttccactgcactggaggagcgttgtcattctcctggtcccgcccccacgtatacagaggagccagggcgcacagacacgctagcagagctctggggatcagtcgcagctccctgaactgtgtgggcccgtttggaatatgtcgtctgtacattactgtctcctcagtgtctttctaggcgtgccgactgtgggcgggaacattgtcatttggtactaaatgttcataaaggcaatagaagacacgtctagcttgaataatctgcaggcaactcacgagggcgtgactggcggtaacgcagcgtatccgatgtttcaggtgcagccggtgcagcacgtgtatcctgcccaggtgcagtacgtggaagggggagacgccgtctacaccaatggagccatgtgcgtgcttctcccgcgggccacacccggaaccctctccctgactccagcctttgccacctggggaggcatcaagcaaattcctctcccttatgcttttggcgatgtgttcactaaatactgttaaaatgctattaggaaactgggcaatatctctacaaaaaattttaaaattagccagacatggtgacaagtgcctagagtccctcccaggtaatcaggaggccaaggtgggaggatcgcatgagcccaggagttggaggctgcagtgagctatgatcacgcctgactgatggagcaacaccctgtccaaaaaaaaaaggagcggggtgggagctgagggattaggacatcataaccctgtggagatttcagaaatcacagacttttgtactttttacttttagaaaagatagtcttggaaaaaaaaaaaaaaaggctaatcctaactcttcattctgaagtctcagtctttgagatccagaaaccatccacccctgtgtgttttcccctcgcctctgttaaactccagctttgtataatgttgatagaacttgattttccatgttgcaaggatgtctagagttttctgctctgtaactgtgtgatgcttggggtaggaaagtatgcatctcccgtgcagctcactttactttagacgtgagtcctttcgcctgcttgtctgtttccatttggcctggatggctcccctcacaagtgcaggggctgtacatgagaacctggctgtgacttcagggttgtgattggtggagttgtatgattctaaccccagccactgtggcggtgcacacccatcaccccagctactgtggcggtgcacacccatattctgaggctgaagcaggaggatcacttgagctcaggaggctgaggctgcagtgagctatgattttgccactgcactcaagtctgggctacagaaggagaccctgtctcaaaaaaacaaaacaaaaaaacccctggaaattgacattggggtaaaactgttaactagcccacaggccttattcagttctaccagtctgtatgcacgtgcttttgcgtgtgtgcttgcatgtggagtacatgtggctttgcatgttcatgtgtgtacccttgcatgtgcgtgcgtgtctatttctttgcatttttagcccatgtgtagatttgtgtaacaataccaccgtcaagatacagaactgctccatctccacacaggagctccctcatgtgacccatttatccacttacaattttaagttttatttgtatttattttttttaagagatagggtcttgctctgttgcccaggctaaagtgcaatggtgcagtcacagctcactgtaacctcaaagtcctgggctcaagcagtcctcccacctcagcctcctgagtagctgggactaccggcacgcaccaccacacctggctaaatcttttattttttgtagagatggttctctctatgttgcccaggctggtctcaaacttctgacctcaagcaattttcccaccttagcctcccaaagtgctgggattacaggcgtgagccaccacgcctggcctagaatttttaagtggtcactttttgataagtcagcctgtggtcctaaagattttgcaacatggtggctgtgaacttgcgctgcatttgagtgtcatatgccacgtccgaattgctccatatgtctggcctctctgggttgcagcttttacgtgatgtttggctggatatctgtgaactcagacaaggcatttaaatgggacagcgtcccatgcgtgacttctctctttctaacagacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacggtatgtaggaggctcttgggaccagcagggtaggccatgagtattctcgaagcagcggcagcagggatggtgagtaagaggcagccggaggcccggaggggctgtcgtctgctctgggcccaggcggccccacgatggagtcgggccagcctcagacgggccacgcaaccataggcaggcctgcagagttctttgaacttcagttggccattggtataaagaggaggacaagccatgcgtcatgggctgttgtgaaaagggaatgagtcaagcatctctccactggtggatgctgcagcctcctttgctcttattattgttatcgttgttactatcaagcttttagaggcgtggatcaatccatccatgagacacctggactgaatcaagcaggggaagtttccctgcagcctctgccgagttctcgctgccatgccccgatgcaaaataacgacttatctgcttttccagagtctctacatttaaaactcgattacccgtgtttacttttcatttattttccttcttaaattaacacaaagtaaaatcaactttttggtgtacagccttgtgagttttgacatgggtagatttgtgtataatcaggtcacagaacagtgcattgccctgaaaaccccctcgtggtatttcttggcagtcacaacctcccccatccccagcccttggcaactgctgatctgttccctattgctgtagtttcatctttactagcgtggtgtataaatggaatcgtacagattgtgaccttttcagacaggcttcttttactcattctggtgcctttgagattcagtcaagttgctgcatgaatccgagttgcttttttttgttactgagtaatattctattacactacagtttgtttattcattcactagttgagggccatttggatggtttccagtttggggtgattatgaataaagaagctctaagtttcacatgcaggcttttgtaaggacatatgttttctttcttttggatatatacctacaagtggaattgctgctggctcatacagaaagtgtatgtttaactttatcagaaaccaccagtttcccaagtggttgcaccattttgcattcccaccagcaacatacaagagttcctcttgctcctctccgtcagcagcatttgatgctgctggtgctcttggttttggccattctaatagatgtgtggtggtacctcattgtggttgcaacttgcattttctttatagctaatgatggtagcagcttttcatgtgagtgtagatgctctggtcaggtgtcacttcaagtcatttgcttcttttttaactaggttggttgttttcttatggttgagttttgagaattctttatgtattctggatacaagtctcctgtcagatatgtgacttgcaaatattttccccagtctttagtgtgtcttttcattctctaaaaagtgtcctttgcagagaaaaaaaaaattttaattttgatgaaatccaacttatcaatttttcttctgtggctcatgctttcaatgtcatgtctaagaactctttgcctatttgcacattatgaagattttctcctgttttctttgaaaagttttatagttttacttttgttttgggtttttttttttttttttttttttttctgagacggagtcttgctctgtgactcaggctggagtgcagtggcaccatcttggctcactgcaacctccacctcccgggttcaagcgattctcctgcctcagcctcccgagtagctggaattacaggtgtgtaccaccacacccggctagtttttgtgttttcagtacagacagggttttaccatgttggccaggctggtctcgaatgcctgacctcaagtgatctgctcacctcggcctcccaaagtgctgggattacaggcgtgagccaccgcgcctgaccatagttttacattttacatttagatctgcttcctatcaagttaacatttgtataatgtaaggtttaagttgaggttcatttttttttgcttatgaaacaatgtgttgttctagcctcatttgttaaaaagactaccctttctccattggattgctttaacacctttgtcaaaaatcagttggccatatgtgtgtgggtttatttcagagtgtcctattccatcccattggtctgtctgcctatccctttacaagtagcatagtcttaattactatagctttatagtaagtctaaaattgaagaggatggttcctcccactttattcttcagtattgcgttgactatttatataaactcaaagtttctgtataagtttagatcaatttatctatatctacaaagaaatgctactgagattttgactaatttgcactgaaccaacttggggagaattcccatctttactatgttaaggcttccaatccatgaacatggtacgttttctccatttgtttagatcttctttcatcagcattttgtaacttatacaaaattctgtacatgttttgttagatttatatcaaagtatttcatgtttggagagctattgtaaatggcattgtgggttttcttggcattgatctttaaatttctgtttccaactgttcatttctaggatttaaaaaatggttgatttttggctctttatcttgtatcctgtaatcttgctgaactcactttttttttttttttttctttttgagacagagtctctctctgtcgcccaggctggagtgcagtggcgcaatctgggctcactgcaagctccgcctcccaggttcacatcattctcctgcctcagcctcccgagtagctgggactacaggtgtctgccaccactcccggctaattttttgtatttttagtagagacggagtttcaccatgttaaccaggatggtctccatctcctgacctcgtgatctgcctgcctcggcctcccaaagtgctgggattacaggtgtgagccacccttcccagcctgaactcattttttggttctaggagcttcttgttgcctgcaaatataactgctttatttctttctttccaatatggacaaaaagaaatttcatttctttttcttgcctttttgcactggctagcacttgcagtgaaatgttgaacaggggtggcaagaatggacatccttgcctttttcccagtcttaagggaaaagccgtcagtctgtcactgctaagtatgtgatgttagctgtgggtttttcacagatgccctttttcaggttgaggaagttcccttctttttctagttttctggaagtctctatgataaatagatgttgaattctgtcaaacgtttttttacatatgtaagcatcagcatatttttgtcttcattggggtgttaatataatgaattgcattgattgactttcaattacacaataacttcttattttggtgtaaggctcatctcctgagatagaaggtggtggtttagccttgtctctgtgtttttgtttgtttgtttttggttctggtgtgttctggggtcaccctggcatcagagaggccccatgaatcttgctgtcctctctcttcctttgtccagagtgacccccaggccctggctttgaggacaggcgtagtgccccatgcctcctccctctcttctcgggaggagtcacttgctttctagaggctgtgaaattgtagggtagtgtctgctgcttctacccctagccacttagtgcctcggtgccattagcaccccaggccaggcagccccagcagaccagacatacttctcccgcctgggattggctgggtggaactaggtttagttgttatggaacagaaagctttcctcgcagactacagtaattgtcacgaatgtggcacatttgacttagcaaacggcatcaacttataacagtaaaatagactaggattgcaagtcacaaatttactgagaaacaatcatgttctctgtggattcagaattacctcattgcagcaaacatactgctcagaccctgggccaccaccctggagctgtggtttgttatgtgggttgctctggaagaactaaattattaaatcaattagaaatccgtgaataggctatgttttcacacacacacacacacacacacacacacacacacacaccccccaccaagctctgggggagtcatcatcttggatacgaatctgattcctggcttctgactgctctgctgttgtttattggcttgttgttggcataagaacatccaacaaggatgccacagaaattcgagactttccaagagccaagaacaaccatggccctgaaattgcaacagaaatacagctgctggacccaacattggatgtctaccagttcgttcatgtcagagttttgtttctcgggactttcgcttagtcctaaagacagagcacaaacactgaagcaagtcctcactggtagcctcgacgagtgattccagactcttggtgaccaattttctcgagtatttatttctggttaaaatgtcatccatattataaatcttaaaaattagttgcccaaatggtgagtttttgatacacacgttttctattgtgctttttttcactgcgtggagcagggaaactaaagtgggagttttattcttgtcctttctgcccaagtggaacctccttttttactgtttgggttgtgtccaggggaggctgaaggtcactcaagggggaacaagaaagagacccctccaccctgggagcagccctcagtgggcccttcctcctgcaagacccagaggccacatgaggccatgctgtgaaaacacacagcctctgagggtcacacggtgggccctgacgaagacaaaaagtctttatcttttttatcttttttaaaatttttctcatactttaatgcatcttttctcattttattagtttaaatctgactaatacagcagaagatcaaaaaagtctaatggattttaattgcagctgaagttaaaatgtcctactgtactttattagtttaacaagctaaatattctgcctttgacagctttctttttgcccaagaagggtgtcttatgatacccgatacataataccattaaaagagaaattttcggtaaattaaacaagagtctatctgagcaaagaacaactctccagtcaggcagccctcagaactagaaaaggttcagagagcaccccttcctggtggtccatggaggtggctcgcagaggcccatggcacctccacgcagtggcacagctcatgacagaatcaggagtcacacacatctcttcttctgtagcctggctcttcagtgaagatgtagaatgaaaagtcacctgggcacagtggctcatgcctgtaatactagcactttgggaagctaaggtgggaggatcacctgagcccgggagttcaagaccagcttaggcaacatagtgagaccccatctctacaaaaaacttaaaaattgggctggtatggtggctcatgcctgtaatcccagcactttgggaggctgaggcgggtggatcacaaggtcaagagatggagacaatcctggccaacatggtgaaaccccgtctctactaaaaatgcaaaaattagctaggtgtggtggtgcgcacctgtagtcccagctcatcgggaggctgaggcagcagaatcacttgaacccgggaggcggaggttgcagtgagccaagattgtgccactgcactccagcctggtaacagaatgagactccgtctcaaaaaaaaaaaaaaaaaaaattagcagtgtgtgtctgtagtcccagctactaaggaggctgaggtgggaggatcacctgagctgggggaggttgaggctgcagtgagccgtgatggtgccactgcactccagcctgggtgacagagcaagactctgtctctaaataaataaataaaaataaatcacttgggtactcctaccatctgccagaagcctgctcagcccctgcatagcagagcttttgtccaatgatcagagcgaattatttgccagccaacacacgtgatgataatcgctcttcccactgcctgcctttgacattcccacactcaagatactgtttgataaaggaatgtcaccaatggcacatctgctttttctctcactatgatatttatcaccacttttttttaaaacttcatagagttccctttgtggtgcagtttgaagttgtttgtttgttacatttgttgcagctgatgatccaatattgatacattattgttgactacagtcccgttcacattagggttcactcttggtggtatgcgttccatgggttctggcaagtgtgtgatcctatcttcactttcaaagctggttttatagggtttttttttttttttttttttttgcaaaggtgggaaaagtacccaggttcacacttacaagtaaccctttgaaagatatgtttgaagatttagtctcagatttgcctgtagtgacaagattaaagactgtcatacaaaaagcactatttttcacttattctgaagcatttcaattgatttaccagacaagtcatccttctttgtctgaagtgacataacctcacttgacaagctgttaagacaaccagggacaaattgatcattgatctaataatcgattagctactgatggatctcttgagtgttgacccatttcttattttcctgttttctttcatggcaccgtatgcaaaatgatcacagtatgtgatcccagattgggtcctggtccagaggaaggacattagtgagaaaatggatcatattctataacgtccgtggattagttaagagtgttgaagttaagagtgcgcagtggctctgtaagaatcggtcctgctgagtgtggtggctgatgcctgtcatcccagtggctctaagaatcggtcctgctgggcgcggtggctcacactggtcatcccagcactttgggaggtggaagcaagtgggactgcttcagcccaggagttcaagacaagcctgggcaacattgcgaaaccccatctctacaaaaaatacaaaaattccctggttgtggtggcacatgcctgtatgttcagctacttgggagactgaggtgggaggatggcctgagcccaggaggtcaaggctgtagtgagctgtgatcgtgccactgcactccagcctgggtgacagaaggagaccctgtctcaaaacaaagaaacaaacaacagaattggttcagaaagatagccacaaaatattaagtaacaaacacaagttgcagaactaaatagagactgagggaaaataattaaagcaagtgtgaatgtgatctcatgccccacaaaggacgtgcacagagatattggtgggggctccccctgccaagtgggagttgggaggaacagacaaagggattaaaatgccccatctccctcccccagcctctcagccctgctggcctcctctgcctggaccacagcgttgggcttttcccttctccaggcctaattctatgatttaccactctgccttcaaaattccagtcattctgcttttcccttttaaaaacaatctgcattcttgggccaggcgcagtagctcacgcctgtaatcccagcactttgggaggcaaaggcaggtggatcacaaggtcaggagatcgagaccatcctggccaacatggtgaaaccctgtctctactaaaatacaacaacaacaaaaaaattagctggacggggtggcacgcacctgtagtctcagctacccaggaggctgaggcaggggaatcgcttgaacctgggaggcagaggttgcagtgagccgagatcgcgccactgcactgcagtatggcgacaaagcaagactccatctcaaaaaataataataataataaaataaaaacaatctgcattctctataaagaccccaaagggttgttagcattttaacttgaattggctccttctatggtaacatgtctaagttctgttttagaacagagggtgaattaactacagcaggtttgggagtggccctctctgtctcgtgtctccatatttgggtttttggggaatgacctcctctccctccctacaccatggccacttctagctccagaatgagctatgatcatgccactgcactccagcctgggcagcagagagagaccccacctcttttttaaaaaagaatgcagaggcatcaaactgtcctagaagtcactgtatttttcatcaccacatgctcacattctaaaagatgtttttaagagaggagagaaagaggctgggtgcagtggctcacacctgcaaccccagcgctttgggaggccaaggcgggtggatcacttgaggtcaggagttcaagaccagcctggccaacatggtgaaaccccacctcgactaaaaatacaaaaatgagctgagcatggtggcgggcacctgtaatcccagctgctcgggaggctgaggcaggagaattgcttgaacctgggtggtgaaggttgcagtgagccaagatcgcaacactgcactccagcctgggcaacagagtgagactcgatctcaaaaaaaaaaaaaaaaaaaaaaaagggaaggagaagaaagaaaggaaatactagtttcatttaagaatgtccttgatgaagcagtaaaaattattaattttattaaatttcaactcttgagcacacatctctttactattgtgtgtgatgagatgggaagtccaccagagtacaatgaccacctccaagaaaagcctgtgtgtgcttgattgacgtgtgggcagaactagccatggttttcctaaaactccatttctgcttgaaagaatgacaaactatgattattcggactcaggtatttggcagacatgtttccaaaaatgaacaaagcctgacatattaagaaaaacagctggcaggtttttgtggccaatgataaaattcaagtttttaaacaaagaaatgaaaattttggagttgtgtctgccaaccaggaacctgacaacttctcaaagttagtgacttttctgatgaggttggtggtgatattaatgaatgtgatttcttgacactatgtaatgaaatgtggcaatgtctggaagatctgcaaactcagtaaactcatgtttttcaagtgaccagtatatgatgttacaaaaccatacccattagtaaaatactcattcaagttgcaagggagactaaaattactttttgaaattagttatatgtatattttttattgagatagaatgtatgtaacataaaattcaccattttgcagtggacagttcagtggcatttaatacattcacagtgtggtacaatcaccattatctagttccagaatatcgtcatcaccctgaaaggaaaccccatccccactagcagccactctccattgtcccttcttccatctcctgacagccactaatctgctttctgtctctagggatttgccaattctacatattttatgtaaaaggaattatataatatatagtcttttgcatgaggctcatccatgttgtagcctgtgtcagaaccttatttttttgtgtgtggctaaattattccattgtatggatggaccacattttgtttatccattcatctgctcattgacatgtgggtttttccgctttctggcactttgattaagtcgtttcactgccctctggcctccatggtttctgttgagaaatcagccattactcatattctggattctttgtttgtgacgccacttctctcctactgcttctaggattctctctttgtctttgcctttcaacagtttgattataatgtgtctttggtgtggatttctttgagtttatgccacttaaagtttgttgagtgtatagatttagtttagagtgtatagattcatgcctttcatcaaatttgggaagttttcagccattacttattcaaatagactttaccactttctccctctcctctctttctgggactcctattgtgtgtttgttggtaagcttggtggtgtcccacaagtttcttaggctcagctcatttttcttcattcttttttctttccgctcctcagactgggtaatctcaattgacccatcttcaagttccctgattctttcttctgcctgctcaaatctgctgttgaacctcccctagtgaagttttcattccagctattatactttcaactccagaaattttatttggttcctttttacaatttctgtctccttattgatattctactggtgaaacatcactctcatgtgtttttttgttgttttgttttgtttttgttttgatatggaatctcactctgtcacccaggttggagtgcagtggcgtgatctcagttcactacaaaccccgcctcccaggctcaacagttctcaggcctcagcctttcaagtagctggaattacagacgcccaccaccacgcctagctaatttttgtatttttagtagagacagggtttcaccatgttggccaggctggtccctgaactcctgactttaagtgatccacccaactcaccctcccaaagtgctgggattacaggtgtgagccaccacacccagcctgtcatggttttttatagtgctttgtacatgatttcctttagctctttaagtatattttatatagttgatttaaactctttgtttcataagtccagtggctcgattttctcagagatagtcctatttatttatttctacatatgggccatactttctttttttttttttgcgtgcctcataatttttgtggaaaactggatattttgaatagtttaacatggtgacgctgaatattggattcttctgttctccccagggtttgctgttgctgcttataggtgttgttgatcgtttgtttcatgacctttctgaactaattttgtaaaatctgcattttttttttttttttgagacagtctcactctgttggccaggctggagtgcaatggtgtgatcttggctcactgcaatctctgcttcccggattcaagcgatccttctgcctcagcctccccagaagctgggattacaggcatgtgccaccacacccacctaattttttttggtatttttagtagagacagggtttcaccatgttagccaggctggtcttgaactcctggcctcaagcaatccacatgcctcagcctcccgaagtgctgggattataggcgtgagccaccgtgcccggccaaaatctctattcagttaccttagtggtcagctagtgatctgacgaaaatttccttaaatgccaagtttcatcttttttttttttaattaagggttcacctgtttgccataatcttttaattcatttccagagttctgataaagtcgattctgacaatttttgcccattttttgactgcttttgtgaagggatgggttctagagttccttactctgccattgtcatggatgtcagctcaagattaatggattttaatgtaactgaggatgaaaagctcgttgatatggtttcagattccacattgcagctaacctttaagaaattaccagctgtcaagtgttgctatagtatcaagtaaaaatatccccagttatctgaaaaggctattaaaacagtgctccttttccaactatatatctgtgtgaggccaagttttttcaatgtacttcaactaaaacagtatacaataacagatggagatacagaagtagatgtgtagagttgtcttctgtaagtcacgcactctacagatttgtgaagatgcggaatcattccactcttcttttggttttgttgtttttttttttaatttggaaagtgtacctattcttcaagtgttaacctataatgggtttattattttttaatgaattaatacatctttttaaaaattatctattttgatttctaataagggaaataatacatttaacttttaaaaacaaaagcaggcagggtgtggtagcttatgcctgtaatcccagaactttgggaggccgaggtgggcggatcacttgaggccaggagttcaagaccagcttggccaacgtagagaaatcccgtctctgctaaaaaatacaaaaattagctgggtgtggtggcacatgcctataatcccagctactcaggaggctgaggcatgagaatcacttgagcctaggaggcagaggtggccctgagccgagatcacatcactgcactccagcctgggaaacagagtaagactctggctcaagaaaaagataagtaaataaagctctttttcaggggtgggtggtgaaatctcaaaattttgtaatagtgtattttttaatagaccaaatgattgagacccactatgttggagagacagtgttttcttctccttcccagtctgctgggcactggacaaggccccctgagattagggcagacttccagaggtcatgcactctgctctcccggcacccataggtgagcgatgtcccacagggaaggtgccacagggcagtactcacgtggctgcccaagctgcagatcagaatggccccaagacatgggggtggcatgtgtgttttttctatcatagaggtggcgattgccttctcatcgcctgcaccctgaggctgatgggtgggagaggtctcaccatcctactttcccctggtcctccagtgtaccttctgcacttcttaaaggtgaccctgacgtcctccttggcttgaagcaagggtagctaatgagagaaggcagaaccaccgtggtcggaggccgtgggagaagcagttaccctctcattcttgaactcagctccgctcgcctgctctctgaaatacacactcaacctgctctttgcagaagtgtcaagtctttggcctccttaagaaaggaagcatatacttcaagttcatctcctcccgcttcagtcctctggtcgtcagggtgggctgcagcagattttacgtcgctgttttccgtgtgcgagtctaggacaaaccaaatgcgtgcgaatgccttagtggccacgcacagctgtgtgcctcctccatcgcgtggacctgccgcccacctccctccccacctccatcaggtccttcaggatccaactcaaaagccccttcctccaggaagttctgctgttagctgcccaactctttcttccaaaactcttttctcttttccaaaaatcttcttcgcacagctcccactgggtaaacattcgccagacagtgtccagtggccctggatcctacggcctcctggtggcagggtctgagtctttggcctcgctgctattttcccaaagcctccagcagcggggagaccctgggatttgcgacaggacagcctggctggggagtcaaggctgccatctctccttgctttcattctggttccccatcgatgtggcgtggggaaaggagcaggtgactatgatgctggcttggctgacactggaatggatgcagtggctgcatattaatgctacggcgtgcacacacatatgccaggttaaagttcagtagcaagtttttacaacatgatttctgctgcttctgttggacgggctctcgggcttacctacgtgtgcgaagcaacactccctaccgcagctttcatgcacaatttaactcacccccgccctgcctgcgtggagcctcatttttattttgtaggagctcgaatcattatttggatattaataaaaacaaatcttggctgatgctaaccatctgatttcctttttttttttttccattttgttttgttttgtttctgcacacattttctttagcttgaaatggcgattgaaaacctccaaaaaagcgaaggaatcacatcacacaaaagcggtttactcaacagccatgtaagtgtgcgtctgacctggcaacctgtccctgctctgcttgtaacctgcatagacatttttaagacaaatgaaggcaaccaggtgcggtggctcacacctgtaatcccagcactttgggaggccaaggcgggtggatcacttgaagtcaggagtttgagaccagcctggccaacatggtgaaaccccgtctctattaaaatagaaaaattagctgggcatggtggtgggcgcctgtaatcccagctacttgggaggctgaggcaggagaatcgcttgaacccgggaggcagaggttgcagtgagccgagatcacgccactgcagtccagcctgggcaacagagtgagactccatctcaaaaaaaaaaaaaaaaaaagaagaagacaataaaatgacacctttaaagtgtcatttgtgaaaggtggttgaggggaagccaatctagaatcctacatccagcaaaaaatacccttcagcaatgaaggagaaatcaagacagattctttatttgtaaaaggtagataataacaacacctacctcctcgggttgtcatagggagtaaattatttaatgtacgtaaaatactttcaacaatacctggcaggtgataagcagtatagttatatatgaaaaataaaaacaatacaaaaatcagcaacagcaacaaaaaagagagaaaatgacataggatcgggaatgccttagactcttagctaattttcttgggatcctctcttggaaagaaacagtaatttgagaaaagcataaagcagctaattcatacagattttagcgtctaggatttttctcctccccttgtctcttgggagaagaccgtgatcacagtccccatgacaggaggttgggggcatctcagctctgcacagccctgtagcaggatgggactgggggacgtggcaggctccgtctttatttccagggacaacagagaaggaaagctctggccccctcagactcatcgctttcacttctccccaaacgctcttgattcggttttgcacatagctggaaatgtgttcggcatcttaacactgggacgggccatcgaagtcagaatgtccttctagtagttgctctctagcacttaaactgggctctgacattctcttgagaattcagacatcagagaagaagtccccttcagtggaccccagtcatcaccgtgatcccgtcctgactcccgtcctcaccgtgatcccgtcctgactcccgtcctcaccgtgatcccgtcctgactcccgtcctcaccgtgatcccgtcctcactcccgtcctcaccgtgatcccgtcctcactcccgtcctcaccgtgatcccgtcctcactcccgtcctcaccgtgatcccgtcctcactcccgtcctcaccgtgatcccgtcctcactcccgtcctcaccgtgatcccgtcctcactcccgtcctcactgtgattccatcctgacttctgtgctggccgatgtgtaaaatgaggcgttatcaaaaggcagtgagtgattctgggggcagaaagtgatgtaggacaggtccagaaacctgggttatgggttaggtacaggtgtggtcacctgctcaccgcagcccctgacgaggcctctgccctttgcctcagggggctggtcactagaagaaatggcagaaatatttccttctgccgattgtcttgaagcaaaaaagacaaaacaaaacaaacaccatgccagacccctgctcagtgccccgcccctctccaggctgggtaggacatggtcatcctgtcatctgtcactgctggatgacatcctccctgtagatgaactcagggagaagggagtcttccacacgtgcttggagagaggatctccccagcccccagtcttaaactcagagcacatacatgggaaaatgtgcagaataccattccccattcagcaaggatcaggccatcttcagcctgaacgcaaacccatgcgggtccagggtatcagccctgggcgagagggctgcgtgacccaggcaggatgggggtgcagagcctggacaggcagcaagtccacgggagagttaaaatgtctatgggaaaatgggctgggcacggtggctcacgcctgtaatcccagcagtttgggagaccaaggcgggtgtaccacttgaggtcaggagttccagaccagcctgaccaacatgacgaaaccccatctctaccaaaaatacaaatattagccgggcgtggtggcacatgcctgtagtcccagctactctggaggctgagacaggagaatcgcttgaacctgggagacggaggttgcagtgagctgagattgcgccactgcactccagcctgggagacagagcgagactccatctcaaaaaaaaaaaagaaaaaatgtctatgggaaaatgcatgagccgcttgtctctggctgctgggatccttcctgctttctaacacttcatccgaaaggcagactttctcaggtcgcttccccgatgaagattcgtattcccgagctgaaggtaaaatctctcgtttcttttactcactgatgattcgctgttgagttgtttccttctgtcatgagctgtgatcagtaagattccgggcttggtgactcgaagcaaaggaagtaaaataagatctttctaaaaagttcaccacacacacgggcagaataaacttagatcttgttttggcaaatgtgagagccagagaggaagagaggagttaaagcacgtgatctgctgatggacggggtgacgtgcccttgcaacgattgtccccagggctgcctgtggctgagactgaggtcgtggtgggcagcggccttctgcaggtcaggcgggggcacagccacagtgccacctcccctgccagcctgaccctgtggcagataagccaagtgtgtgggagcagctgggccctggagacccattttcccagtggcctcccagacctcccttctcagacagccccaggcaggtcgccccagcagcagggcctgtgcgcctcttccctgctgccagctggtgacgtcagaccaccgtctaccgtgtgcagggttctggccaggtcagtgccgaacatagggagtaaaaaaggaggaaaagtcactccagggagcttagcatttgagggcagaaggtggaagacgtgggaaacccacctagggaacccctcacagacatctctgagcggagctggccacgtgttccgcggagctggttccctcctctgcgctgtctcaggagggaaggtgtattcaggtgctgggagcctggtaaaacgagacagcattgtccagacccagccggtcaacaggagcttcccaggcctcccctctaggggcttggacccagggggtctgcagggcctggaggtctgcacattggaagaaccttccagccagctgatggtcagcctggcgtggaaactcccagggaggaggaggccccctagcagtgtccaaactggaaaagggcatgatatggcgccgtgaaaatggggattagctcttccagagggaaggggacggagccggggctggggatgaaacatgtcttcacccgaccgggtgtggcaggccaccgacttgagcagaagaggcggcctcagcccctgggggccaccgggctgccctcaggctaccagccgaccgggaccccgtagcaggttcaccgagtctctgtcaccatgaggtggcgctgtctgctaaagtaaacacatcacttgcacaccctgcgggagagagctgcgtgtggaagagtcgtatttgggttatgtgactttttgctttgaaatcaagaaacacacattgtcaaaggtcatttagccttcagctggtgacctgtgtagcctggcacgatggccgtgctgtcctgcaggccacagtggggttgctagagccggcagctcctcagaaggggcctctgtccagaagtgccgctgttttcccttggaattcctgcctgcctcggattagtgtcttagctcagtgcgtggcctccaccctcaacaacccctgcgcctcccacaacccctgcgcctcccgcccacggtcccatctgaggcaggggcagccaatcttccaggcgctcggcccccaaccccactgcgtcctcgcctccttgctcctctcatgcccacccccagatgctcttcaacctcaccttcaagaaagatccagaaccaggtggcaccccccacctcctccacttcgactacttcccgagccgccactgtccctgtggattctttcggccacctcctagccagccgtcagcacccacccctacccagcctccagccccttctcacagcagccaccagagtgatcctgctaaaacccaggtcagatcgccacactgctctgcttggaagcctccagggctccccttggccctccaagtagaaccgagtgttgtcaaaatggcccacaaggccctgcaggacccgctctctcccactcctcactgtgctccagccacacgggcctcctcgctattcctccaatgcaccaggctcggacctgccccagggcctttgcactgtggggccctctgcctgaagctctcttccccaggctccccctcacctcctctgagtcttcactcagtgggcactttctcagtgagccctgcctgacacccccaccccacctcaacttactataccgttgcagtcctccctccagtccctccgtggcggcgaccccatcccctttcccaggtgaatttctctgacggcactcggcatcagccctcattcggttcattttacttatttattgtgggtctctgccagacaagaacggacgcttccagggggcaggggtttttgtcttttattcgccgttgcatccccagcacctaaacaaggcctggcatagagccagctctcgtaaatatttgtggaatgggtgaaaaggtggatgttccaagtcggattatgtcaacacagggcacacctggacggttggaatagctgcccgagctgctagtgtatggcccggtgagactctaactcaccaccaggagccagtgtcaggcaaatttgcccccaggaatagaaacaagtatcttaggagacaaagggggccaggtaggtgggcatgatccctgccttcccaccggcaggtgaggatatctgtccacaggggctgtgcctgcaaagagcccagaaccacaggcctttgttggggggccggggagagggaggcgctggcatttcgggattttttttccttaaaaggaatgatttgatccatttcatcaagaagtgtgctgtcctgacagattgtggcaaatgtgggtacacatgtacatttccttggaaagcgttctgcttatttgtgtttgatattgacacagaaagaatgcaaatatcagcagacaaagcagactgcagaacatgcccaaaccagaaaggtgactccgtccagctgctgcctttcctggcatgaaggtacccgagccctcaagagcaggggaggtgggcgagtgtggttggagcggctggaccctcgtggtcggtttcacggaactgacctgtgatgcttgccgcagtctgacgtgccgccaggtgtgggctccagcaccgagggatgggaaggcccggtgcataagtggctcccagcctgctggtgaggcgtagaccctgaacagagtctgcaagccatacttcggttctaaccccattctcctcccagaagttcatcaacacagaagagggaggaaatagacgcgactgttccagccgcttcagtcttctctgtggtttcttgatgttgagcaagaaggacttgctgtcaagacaactatgcatccttttagtgtcaatgtcaacgtaattacccaagcaaaggattctactcttaaatagcctgggggttcgggggtaaacagcagaaggatcatctgttccaaaactttctttttatgtgtgagccagtatgtcctcctggtggatggagtcttatactctaacctctcaggactcctagtccagtgctccttccagctcaccgcccgcaaaatctggcctcacagttttagcctgaaaatccgcatcgtcatttggctccttgagatgtggtgtcactggccttggctcctgctgcctgtggaggacagtctaagaagtggcacctgtgcccccagcctcagaatgaccaagggaagcctctggcttcttcacccagacaccctctgttgctccccatctacctccttggacagtctttctctgctgccaggcttgagacatctccaggatcctgcagatgctcacatgggcaaacctggctccgtctccaccctcagggagagcatagtctgcggggaacaggcgataaatcaatcagcacacatgacaaatccggacggtgaagccactgggaagaaaagcttcagggcccacactgcagctcccgactgtcatcccaacacttctggaagctgaggcaggaggatcacttgagcccgggagttggaggctgcatgagccatgattgcaccactgcgctccagcctggggtggtgacaggatgagaccctatctctaaatatatatatatatatatatccctgtctctaaaaaaaaaaaaaagtatataaaagtatatacacacacacacacacacacacacacacacacatactcacacactaacttcaacatcaaggttgtggttcatagtattcatagcattaaatacagggaagactccggagctcttaagctcttaagggtccaagcactctgccagagccggactttggaggagaaaaaagcaacactgcctccattgtattggaaaaagtccagtccagaaagtcggaagatgaagggtgtgaatgacttgatggaaagtgaaaactctgatgtcccttttcccaaagaggcaagtgaggaagagatgaagtctccactccgggcccttctcagggtcctttgttttaactgccccttattcaaaggacaagagggcgggggtccctccctgtggttatgggcacagccaagcacatggcacccaatgctggacggatgaaattggcacctgctaacgatggcaactgctaacgatcacctgcactcatggcgggggggtgggggacactgcacttcacacagggccctgcaggcggcaggaggcagactttgtggtagcaagagggcgaggggtccctggtgctgaggaggaggtgataggctacttgagtgattcaggggcggccagggaaccggaatccaagctcagggattgtggcaggaaccactcctgtccctttggtaaggagggatgtttggccacgggacttacctgcaggagcagagctggaggggagcttgtggtcaggaggtctgaagccctcctggcttgccccagaggcaggacgtgaggttggacccacacttcgaggcttacgctttgctcctcttcatcctcaacacccacgtgggcagtgcccctgctgggtgactgactcttcccaccccttggaggttttgtcctcagctctttggttccaaagtaacacatctggtcccaatctctaccctgaactccagcccaagacttaacttcccccttcctaaaatggaactcagccccgcagctcacctgcaattcggcttaagagacctccgcgttcaggccccacacaccccttcacctgaacctttgacctgtttgtcctcctgtgaaacgttccagaacccagggcaggtcctcactccactgtggccctgggtcaacccctgttagggctggaggggccaggacaggctggatcgagtgggtcttagatgagataaaaggggttctgaggtgctggtcgctggtgcagggctcgtcagaaccaccccatagcactatttcataaaaaggagatgaaggccgggcgcggtggctcacgcctgtaatcccagcactttgggaggccaaggcgggtggatcacctgaggtcaggaattcgaggccaacatggcaaaatcccatctctactaaaaatacaaaaaacataagccagatgtggtggtgcatgcctataatgccagctactcaggaggctgaggcagaagaatcacttgaagcctggaagtggaggttgcagtgtgccaagattgcgccactgcacctccagcctgggtgacagagtgagactccatttcaataaataaataattaaagggagatgaatgctttcttcctccccagcttctaatgctgagttgggggggtggggatggggcaaacagacaggcaaacgtgacagtggggcgggggggtgccatgggtacgctgtggtgagtggacagatatttcccaggggacacgcctactttgtgtcttgtggggtgtgcggggcacagggacaagggcttcccaggccaagggctgtgcaggagcccaacatgcccggtgggggagggctgaggacccagcactgcccactctgaagggcccaggcagcaggagcccttcggagctctggaagcggggctcagcctagacaaagcagctgacagcctcgcacaaaggggaccaggtagagacagctggtttcccccgacgctcttgacatgggatctggactcgggcctcgcttctgtgcgtggaattcctgtctttctgcaaatcgcaggcatcagtgcaagccttttgtattcacatagcagacctctctggatcaggggacagacgatagcagagggagaggtggaaaccagaattaagccgcagtctttaaggcacctgggtgagggcatcagttggtgggcaggccacctttgcgtccatgcccagtgtggggactgagctcttcgtgtggacagttctcgcagcccttctaactggatgttcacctctcgaggcatagtccttggctcgggactcatttagcccatctttttgttttgtttcgttttttgaaagagacgaagtcttgccctgtcgcccaggctggagtacagtgtggcgcgaccctagctcactgcagcctcaacctcctgggctcaagcaatcctcccacctcagcctcccaagtagctatgtcctgccttttgacttagacacaaaaccgtgcatataagcatttgtgtattttactgaatttccatttgtacctccctcaataagggatctcagtacatgttagctcactgctcactacagaacacagggctgtggggcccccgagtcttcttcaatcttcctgttcagcaacagaatttctctccattcctgtatgttggggagcgatttggtgttaaagcctgtgtggtgtgtgggtatttcatttaagggactgaagacagaagctaatagttcctgatcacacccagatgtttacaaattaagtccaggaacctgaaaaccaggctaaacatgaaagaatcaataagcaaaagaaaatgagggattcattaatctgcttagagaactcaaatcagtgaccataaagatggatttctggccaggcacggtggctcacgcctgtaatcccagcactttgggaggctgaggcaggcggatcacctgaggtcagtagtttgagaccagcctgggcaacatggtgaaaccccgtctctactaaaaatacaaaaactagccagatgtggtgtcggacacctgtaatcccagctacctgggaggctgagggaggaaaattgcttgaacccaggagacagaggctgcagtgagccgagattgcgccactgtactccagactgggtgacagagcaagactccgcctcaaaaagaaagaaaagatggatttcctcatcccatttggtaacacagggaacgcaagtaattctcttaatgagtccacgttggcatgttagcgttcctcaggcttctgacaaacgcagacgtgtctttctttttacagctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggtgggtagacgatccccagcccacctgttcttcctcttcctttcccaagaaatggagcttttgggaaaatgcgaggcttcctcctcctttccaggtggcctgattcgcagccacctctggagtgcttgcagttactttcaattggcggcagccttggctgtggccaggtgtagcccacggtgtcggctttagaagccggtgataggacgtggggatcactctggttttctctctccttttgaaatttcccaaacaatacttttctttttttgttttagagcagcctctgggccaggtgtggtggtgcacacctgaaatcccaacagtttgggaggccgaggcaagaggatcacttgagactaggagttcaagaccagcctgggcaacatagcaagacctcatctctacaaaaaaattaaaaattagccaggcatagtggtgcacacgtatttgcacacctgtaatttcacctatttgggagactgagaggggaggagcacttgagcccaggaggttgaggctgcggtgagccacgattgcaccactgcactccagcctgggtgacagagcaagaccctgtgtcaaacaaacaaacaaacaaaatgtagcctctggtttatccagcagagctggatttaccatttctcagtgttttgtttttgagacacagccttgctctgtcacccaggctggagtgcagtggcgtcatctcggctcactgcagcctccacctcctgggttcaaccaattctcctgcctcagcctcccaagtagctgggatttacgggcccccaccagcacgcctggctaatttttatatttttagtagagacagggtttcgacatggtggccaggctggtctcaaactcttggcctcaagtgatctgcctgcctcagcctcccaaagttctgggattacaggtgtgagtcactgtgcccggcctcttggtgtcttttgctgtacctggaccaatccaccccgccttctcttggcctatggcagccccgggacatcacaggccacagacttatcacaggcaattatgccaactctcctctaacagaaagaaacagcagcacctccaacccaaagctggtggcccagagagtgcagtaggctgctgcctgctgaggctgtgatcctgtggccagcgaggcttggcatctgcttttgtggggttggggctgactcacgtgctctcaaagccggtgtcctggctgtctataaacggcgtggcggtggatccacgaggaccagagtcccttattctctgacactttttcatccttcacagggaatgtccttagggaatgtggatgcgtagaggagggacagaagcgggaggaagccacagggaagcctggtctctggggacacagcccctgctcctggaggggcctcccctgcagagtatcccagctgctggcttcaggattaaggctgatttccccccgttttccctcctctgagcacctggctaaacatgtacctcatctagaaagggcccaggctgtctgctattgcaatgaaatttaaaaaggaaaagaagggccgggcatggttgctcacgcctgtaatcctagcacattgggaggccaaggcaggaggatcacttgaggtcaggagttcaaaatcagcctggccaacatggtgaatccccgtccctactaaaaatacaaaaaaattagccaggcatggtgtcacatacctgtaatcccagctaatcggggaggctgaggctggagaatttcttgaacctgggagagagggaggttgcagtgagccgagatcgcactactgcactccagcctgggcaacagagtgagactgtctcaaaaatataataataagagaaaaagaaagaaagaaaaagaaaggacccaggtgcttcctgcatgtccctgttgccagctctggagaaatggcatcctgtgagctgggtgtctccacagccatgtctgtgggttaatgcttccctcctgtaaggactctgtgagctgttttctgaactaaattgtttaaagccctctgatcatcattctcccgtaataaactaatgtaatggttcccaaacagtgccttattccaaaacgtgttactagatgattgaagggggtggggaagagttgttaataataatggtaataataatggagataagccatgtggagctcaacaaagctgacctggtgttctcagcacaggacttgtccgagcctttattatactagcctgtgagagaggactctctatgacaacggcattatgtacagaattccttgatcacattcctcacacagttcaggaaatgctgaaccagagaggccaaagtgaaaggtcaagatccgagtgtggtggcacacgtcagctactcagaggctgcagcaggaggatcacttctaccatccgagtgtgttggcacacgccagctgtcccagctactcagaggctgaggcaggaggatcacttgatcccaggaggtcaagtgatagtgacctcctggtagtgacctcctgatagtgagctgtgattgcacaactgcactccagcctgggtgacagagtgagaccctgtttctgaaaaaaaaaaaaaagagagaagaggccaggcgcagtggctcacgcctgtaatcccagcactttgggaggccaaggcaggaggatcacttgagcccaggagtttgagaccagcctggccaacatggcaaaaccccgtctccactaaaaatacaaaaataagctaggcattatggctcacgcctgtcatcccagctacttgggaggctgaggcaggagaatctcttaaacccgggaggcggagattgcagtgagccgagatggcactgctgtactccagcctgggcgacagaatgagattctgtctcaaaaaaaaaaaagaagaaagaaagaaaaagaatcccaacctgtcttgttgttcaggacatctgcaaagggagctgaccctgggatgtttggtttccaggggcaactcgaagtaccattactatgggattcgtctgaagccggactcaccactgaaccggctgcaggaggacacgcagtacatggccatgcggcagcagcccatgcaccagaagcccaggtgggtgccgggccgagctgggaggagctggctctcccctggagcatggaggggtgggtgtttctccaacacgaaacaaactcatcataactccccagtctccagcatcctgggaaagccaaggtatccccctctgctgagactgaggtgagtctagcaggagacacaggaggctgggatgcaacctcctccagctaacttttcagactttttttaaaaccgtttaaaactgtttttaacagacttcattttttagagccattctaggttcacagcaaaattgagtagaaagtacagagagttgttctacacccccagccccgctccccaccgcctctcccaccattcacctcccccacacagcggtgcattgctcatgacccgtgaccctccgcggagccagcatcaccccccagagtccacagtcaacatcagggctcactcttggtgttgtacattcgacagtttggacaaacctataatgacatgtgtcccccatcacagtgtcacgcagagtcctttcacagtcctacacatcctccatgttctgcctacccagctttccctccccaccccagtctgcagcaacctctaatccttctgccatccccacagtttccccgttccccagtgtcatatagttggaatcacagacctttaatttttaaagcttaggaagtaaagagagagaggacactgcaaataacccaagaagccaggagaaagaagcagatgtgctcaagtcacgacttcttcttcacctttggatccagtggctggaaagccctggttattttctggaagatcctcttctccatccatcacaaactttctcatcttctaaggcaggagccagcaaacctttcctgtaaagagccagagagcaaatatcttagccttgcaggccagacagtctctgtcatgactgttcaatttggctacatcctgaaagcagccacagacagcatgaggatgatgggcatggctgtgtgccagtaaaactttatttataaaaacaaacagcagaattggccctcaggccatagtttgctggcccctggtttagggcccattcaaatatcactgcctcccagtgtgcctccacaagtgccccccctgagggcaggggccacattgcaatagccccacgtggcacctttacacctggtgctggaccctctgcacagagccacccgtgtatgtgtgtggctcaaaaacccattccagctgctctgcgtaacccattgactcctgaccacacagccactcccaggagttggaggttccaggagagagtttccagagcattccttctgtacctcgttgtctgcagacatggactctggagctcactgctgttgttcaatttgggcccctggcagacagctgtgaacctgtgctccaggcagtgtgtcattttaggagcagcgacacacatttcagggggacaggctgatgccatttgcatttggaagccacagcctgagcctgtgtctgtgtgatgcccacggcctgccctgagccaggtggtttacacacacctcgccagcatggtctcccgcctccctgtaggcctggccccgcttcgtatttgaggagggaggtccgctggagatgctccagctcaagccggctccctccctgcccccaccacaccacacaccgggccctgaggagtccagcgcctggaaagtgctgagtgtttctcagcactgcctgcacaggctggccaccaccatctggctcaaaatgaaagtctcagaacttctaagattgcaccaataataagatgtttgtgattcacgcaaagaatctcccttttattttattttattttattttattttaattaatttatttattttttttgagaccgagtttcgcttttgtcgcccaggctggagtgcaatggcgtgaactcggctcactgcaacctctgcctcccaggttcaagtgattctcctgcctcagcctcctgagtcgctgggattaaaggcatgcgccaccacgcccagctaattttgtatttttagtagagacggggttactccatgttggtcaggctggtctcgaactcccgacctcagatgatccacctgcctcggcctcccaaagcactgggattacaggcgtgagcccctgcgcccggccaagaatttcacttttttttctaagagagaaatgttagggggaaaatatatatctattttctcaagtgtccattaacaaactgtggttcatccatatgatggaatattattcagccttaaaaaggaggaaattccaacacaggctacaactcggtggaccttgaggacataacgctcagtgagagagaccagttgcaaaaggacaaatcctgtgtgaccccactcctaggaggtccctagagtcgtcagattcacagagacgggaagtcagatcaggggtgccaggggctggggacagggatggggagtgagcgttttatggagacagagcttcagtgtgggaagatgatcaagttctggagatgacgacggtgagggttgcacaaccagtgaatgtgcttaatgctgctgagctgtgcactcaagatggttccgatggtagcttttgtgttatgtgtatttgaccgcaacttgtaaacatcacacacacatgcctgactgaatcctgcccagccccccagtctttgggcccacccgcagcagggctgctgggcctcatgatggtatgcgtgttcctggcctaggtaccggccagcccagaagacggacagcctcggggacagcggctcccacagcggcctgcacagcactccggaacagaccatggccgtgcagagccagcaccaccagcagtacataggtgagaggcccggtcaggcccgggggcggggctcccatctgctcgccacactcctgggtttcaacaccagcagaaccagtggtgtctaagcgtctgcttccgacagttttcttacgagacaccttttcggacaaatagaaagttttcgataaaccttctttctgacatccctgagactttagaataatcagcacatgccaaaaaaattaatatataaaatgaccatcagaaaaatgagaaaataaaatcaaatgaccatcagaaagaacactagaggacaggcggctcatgcccgtgatcccaacaccttgggaggccaaggcgggaggatcacttgagctcaggagttcaagaccagcctaggcaacatactaaaaacttaaaaaattagccaggcatagtagcaagctcctgtggtcccacctactcaggaggctgaggcaggaggatcacttgagcccagaagttcgaggctgcagtgagccatgatcacgccactactctccaacctgggtgacagagcgagactctgcctttaaaattaaagaaaaaaaaaaagaaagaacgctagatattctctactcagggtgcaccaggatttgcctgctatctgggctttcttccttcttgcctggagcttttggggtgcttctggttccccaacatgaggcagtcttggcctcttccctgggggctgctcaggggacagcgttcttccccagctggcttagtggtggtgccatctctgccccgggaaggccctaactcagagcctgccatgagggagggcaggggggtggggggcggccaaggaaggctcactggcatgtcatgattcaggtgggctctgtacacactcagtggcttccatgtcgtttatgatcttttttgagcccaaacagaaccctcctgggttgagtcttcggcagagattgaggtggggtcaggcccatctccaggaggtcactgcagggacaccgtggctggccttctccccgagatgtgctgccctgagctggctctgtgggtacttgctgtgtgccagggcctgggctcagggctttctctgtgtctgcatatttaatgttcctgggaggtgacaatatcctctccattttctacctgagaaaactgatgcttagaaattccctgactgtactgggcacggtggctcacgcctgccatcccagcactttgagaagccaaggcaggcagatcacttgaggttgggagtttgagaccaacttggccaacatggcgaaaccccatctctaccaaaaaaaatacaaacttagccaggcgtggtggcacgtgcctgtaatcccaaatactcaagaggctgagacaggagaatcacttgaacccaggaggaggaggttgcagtaagccaagatcgtgccactgcactccagcctgggtgacagagcgagactccatctcaaaaaaaaaaaaaaaaaaaatggccgggcacggtggctcacgcctgtaatcccagcattctgggaggccgaggtgggcagatcacctgaggtcaggagttcgagaccagcctggccaaaacaaggcgaaatcctgtctctactaaaaaatgcaaaaattagctggcatcgtggcgcccacctgtaatcccagttactcgggcggttgaagcagaagaatcgcttgatcccaggagctggaggttgcagtgaaccgagatcgtgccactgcactccagcctgggcaacagagcaaggccctgtctccaaaaaaaaaaaaaagaaaaagaaaaagaaagaaaaaacaaattccctgactgcatggggtggggcagaacatctgtttctgggcccccatccaccgtggccttccagttgtccacggtgtcctaagagcctcgccatttctgatgttcccgtgttcctcccccagatgtctcccacgtcttccccgagttcccagcgcccgacctgggcagcttcctgctgcaggacggcgtcacactgcacgacgtcaaggccctgcagctggtgtacagacggcactgcgaggtgaccgccccagcccaggcaggcagctcctgcgtgtccctcccgggaaccgccagcgctcaggccaggcgtccccgggtgacgctgaggagctggagccccgagccccccaacaagcatcctctctgaagcagcagcccctccgcatccatgtccatcgcctgctcctctcctctctgtggcctcccttgggattccagggcaccccgctgtagcccggatcacggctgctcacttgacgtgtgctgagtgcacgtgatgggcgcacgcacccgtctgtctcaccggtcccttcattcctaggcaactgtagatgtggtgatgaacctccagttccactacatcgagaagctgtggctctccttctggaactctaaggcctcctccagcgacggccccacctctcttcctgccaggtgactgccacaccctggctgggttcacagccaccccagacttaaccccctgctgacgtccacaggtaacccacaaacgaaagcctcagctctccaagaatcagggttcagacccctctgcctccatccctgtaatttttagacttggtagagttgacttgaaattcacattgccatccgcccctttgcagggtcagactgtttgaatagggaggattttagaggtgaccatgatgcaatcccaagtagaagtgaccccaacccatagctgcagtgagacgcagtatgacagtatgaccactggcaggggagggacagcgtggacagtgagggacagggggaaacacggaggcgccgggagcaacatggagggaggggacccatcgaggctcagggatggggagcaaaaccccagccccactgttgggcaaaagtcccgcagcccggctctctgctcgctcccgtggctgagtgagcccacctgggccaggccacagctcacctgtcccccctccctccacagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaagtgacccacggccccgcccggcgctgctccatcctctcttcctgcctcctctgtcctttcttacatgtacgtcttcagccacctcagaccatcgctttcacagaaaacccaaaagtggccgggcgcggtggctcatgccagtgatccccacactatgggaggctgaggcagacaaatcgctgagcccaggagtttgagaccagcctgggcagcatagtgagaccctgtctctaaaaaaaaaaaaaaaaatttatctggggccaggcaaggttgctcacgtctgtaatcccagcactttgggaggctgaggcgggcagatcatttgaggtcaggagtttgagaccagtgtgaccaacatgctgaaaaccatctctactaaaaatacaaagatttagccgggcatggtggcacacgcctgtagtcccagctactagggaggccgagccaggagaatagctttaacccaggaggaagaggttgcagtgagccgagatcacaccactgcactcagcttgactctgtctcaaaaaaaaaaaaaaaaaaaaaatgagctgggcatggtggtgtgtgcctgtagccctagctactctggaggctgaagcagaaggatcacttgagcccaggagtttgagaccagcctgggcaacatagtgagaccccatttctaaaaaaaatacaaaaattagctggtgtggtgttgcatgcctgcagtccagcgacccaggaggctgaggcaggaggatcacctgagcccaagaggtcgaggctgcagtaagctatgatcgcaccactgcactccagcctgggcaacagagcaagaccctgtctcaaaaaaaatccctaagtgagagccgctgtgggccgtagaatgtgtcccctctggcatgcgttatttgtccttgtctctgactcgaggggaaggtcacagtggctctggtgagctctacctgctgtcaggacacagccaagagtagctgggctgggctcggtgctttctagaaggttcactgggggcatgcaggccggcctctgggagtagcctgtgtgcagccctggagccgtcactgtgcgggaggccttggcccagggccatgtggggttgctgcgcaccctggtcttgcagacgaccaccagccaccttcctccagcctcccttaagccccactgtgacacatcctgagtgccacccctgtaggaggggcagggacataaactcagaagaagaagctgggacatggccctggactcctgcagcctgttagggtagaggctgacctttaacccccagccagaccccacttcccagcaccgtgggattccaggagacatttacaccccagcgccccaccctgtgatttcccacaggacttggtggggtggggagagagtgacaggcacagtgaggaaggaagctaggcccacggcagagatcactcgtgcccttggagacctcccagggcctccagctcctgaggcaatgacagcacccaccacgagggagccctcgggccaggcccgtgccaagctccccaaaaccctgggggtcgtcaaggaagctgggcacagaggcctctcttcataaatcacagcatcaggaccacaggccatgccccgcagtccatccacaaacatccgggcccatggaccgtgcccctcaggccatccacaaatatgcatgcccgttagtaccaggcagctctccgtcctgttgagtaaactctatgctccctttgctggaagatgggaaacagcaaaagtattgcatttctcatttggcctggccttgcctgtctgcctgaaaactgttcagggcaatgcctcgtctgagtttctatgttatggtgggagtttggggtatctttccttttgcattttaaaatatttttctggttttttttaagacagagttttgctcttgtcactcaggctggattgcaggaggctcactgcagtctttgcctcctgggttcaagtgattctcctgcctcagcctcccaaatagctgggactacaggcacccaccgccacgtccagatcatttttgtatttttagtagagatagggtttcaccatgttggccaggctggtctcgaactccggacctcaggtgatccgcccacctcggcctcccaaagtgctgggactacaggcgtcagccaccacacctggcctttttctgtttttgttttttggttttttttttttttaacagtctgatcatttgcttcttattctaacccactttaaaataaattaggaagttggtagaatgtatttacgtgtgtgtgtgtgtttgtgtcaaggcctctttcccttggcactgttgatatctggggctggatcgttgtctggggtggggccctcctgggcactgtggggtgctgaggagcatccctagcctccacccactccatgcctgaggcaccctgcagtcatgaccaccattaacgtccccagacattgcccagtgtcccctggggcagaatcgcccctgtgagacccgcataggcagtgggtggtgaccagcagcgctgggccatgcctggttcttcccgtttctaagtgtcctcggttccccgtcgcctgtgtggctcgttcttcatggtggtcattttcatcgcacttgggccagctcttacactgaatgctgatttccagggtccagtcactgcctttctccctggtaatatcatggtctgtatcccccaggtaccttgacacaggccatccgtaactttgccaagagcttggaaggctggttgacaaatgccatgagtgacttcccacaacaggtcatccagaccaaggtgcgtccggggtggggcctgggctccccaacgatggctgggaggggctccagtccaggacagcatgaggaccactgtgtcccagagagcgctggcttcttccctgtgtcatgagagtaaccgatcccttcaggaagccctgagcacactgccggtgacgcgtcagtgctggcaggaaggggaacaacagaagatgtcatttgatgtcacatctttgggtcaattcagaacagattgcgtgtttctgtgctcatcttattcgggaaatttaatctccttgctgtgacccttattgctgcaatcttggccacaaatcagtcgaatttgaaatgtagaaccttggccgacttgtggaaaagagagtgattacccaccgttctcacaagcatttcttttttttttttttttttttttttttttttgagacagagtctcactctgtcgcccaggctggagtgcaatggtgttatctcagctcactgcaacgtctgcctcccgggttcaagcgattctcctgcctcagcctcccgaatagctgggattacaggtgcccgccaccacacctggctaatttttttgtatttttagtagagacagggtttcgccatgttggccaggctggtctcgaactcctgacctcaggcgatccacctgccttggcctcccaaagtaccgggattacaggcgtgagccacctcacccagccatcatgagcatttcctgaagggctcttgggtgagaggaggcagctgcagggcacccgcctgctcttcggaattgatctgttaggcagtgatgcaagcattgatcaggtcattgttaaaaagtcacattcagggccggtgcagtggctcacacctgtaatcccagcactttgggagacagagactggaggatcatttgatgccacgagtttgagaccagcctgggcaacaacaagcaagaccccatctcttaaaaaaaataagattcccaggccacacccactaaaagtctgatcctgtagcactcaggagtctgtggtctcaacagcccctccagagaaccacagggactctagaagtgggcatggcgacagttgtgaattctaactcagcagcacgcaggcctcagttagcgacgtgtgtgatgtgccggcgaggtctcctcttcactgattctcacacactgggtccttaagaatagcaggaggttccctcttccctgcccaggttgctgtttcctgctccctcctccctgtgttgtccctgagcccacacacccctgcaaggagcgcagcggaacaggctctccctgcgaacccctgctcaccacgagccctggcttacaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggtgacttcctccacaccgtccccagggcccgggcttcccgccctccagcaaaaccagcaaacccaccaagtggagcccgtggcacaacctggcccctgccccgagcctggccacggttctgttgcatgacacgggtcccaggccaaagcccacccacagcccccagctctctccactccatcatctctcagggccctctggcgtccaggcgctgtggccaacacttctgctcattttcctcacaaaggcccccagcttccaggatcgtggcaccacgttgacctccctgtggccattttcctggctctgtcccctgggcttggcaaagtgtcggcccacagcagcttccgagctatgcttatttcaggccctgcgtctatccattaaataaataaacgcacacacatacatttagaagtgacccctttgaaacaaagctaaacaaagacctcatatagcatgagctttgatccagaaagacctgggtatgagtccccggaagccgggtacgatccccctcagctctctattctgcccctgtgacgggagacacaggacttggcttgcagctgtcaaggtcaagggcgagaaggctcaagcacagcacgatgtcccgccctgagcatggctaggtccagggagggctgccgtggctgggggtccacattgctgacactggcctctgccctgcccacaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacaggttagtcccaccagacctccgagagaattctggcgggtggggggctctgagagaaacttctagagggtagggggctcggctggtgagctcagagcaaaacagggctcagcagagttgcagcagtgtctgaacccgcaaaaaacaactacctggctgggggcctcactcatgaccagcggctcccaggggcaggcccagaaggccaccgtggcctaaatactaagttgcaagttctgcagacagaaatcatcactgagggctgggcatggtggctcatacttataatcccaccactttgggaggccaaggcaggaggatggcttgagaccagaaatttgagacgaccctggggaaaatatcaggacctctacaaaaagtaaaaaaacttagctggacgtggtggcatgtgcctgtggtcccagatacttgtgaggctgaggtggaaggatccttgagcccaggcggtccaggctgcagtgagccaagattgcaccactgtaccctagcctgagtgacagagcaagaccccatctctaaggggggaacaaagctatctcagaactgaagggcacaaggaggctcctggtgaaatatcgaaacaccaagtttgagaaacaaccataaaagcttccagagagaaagaaacaggctggggatgggagcagcattagacttccgaacaatgtgcagaaacccagaaggcagtagagcgatgtcctgagagctctgaagggaaatcatttccaagctacagacctaacctgtgcagaccagggcaggggagccaaggcttccagagggattgtccccaggaaaggcaccaagatgcctcctgcagttctgtcaaggagttttagtctccctgagtacatggaaaatgtgcatttttaaaaaaagagccagttattaccccaggaaaaaacaaagctgttctgtggctgacaggccccacgtgacccagcgcatggatgagctatggccacagggccaaattgttatccccacctgtattattagtccattctcatgctgctgatacagacatacccaacactgggtaatttataaagaaaaataggttgaatggactcacagttccacctggctggggaggcctcacaagcatggcggaaggccaaggaagagcaaaggcacatcttccatggcggcaggcaagagagcatgtgcaggggaactcgcctttataaaaccatcacatctcatgagacttattcactctcaagagaacagcacaggaaacatctgtctccatgattcaattacctcccaccaggtccctcccacaacacatggggatcattacaattcaaggtgagatttgggtggggacacagagccaaaccatatcactgccccagcccattgtgcaaataaagttttattggaacctcagccacatgcattaattcacagatcagctacagctgtcaatgcaaacaaaacagtttgactgttggctacaaagctgaaaatatttactatctggcaagcgtgaaaacgagtttgcctggccgggcgcagtggctcatgcctgtaatccccacactttgggaggctgaggcaggtggatcacttggggtcagaagttcaagaccagactggccaacatggcgaaaccccatctctactaaaaatataaaaattagtcaggcgtggtggtgggcacctgaaatcccagctacttgggaggctgcagcaggagaatcacttgaatccgggaggcagaggttgcaatgagccaagaccgtgctatttcactccagcctgggcaacaggagccaaactccatctcaagaaaaaaaaaaaaaataagaacaagtttgctgacccctcagctggccagccagcacccctgttctcagctgtctccttacacactcccctggccacgctgcctcagggcctttgcacctgccccccttgcctggaacatctttcccccagacagccacacagagaaacccatcatccgcagagaaatccctcacccccagcctctgtaaataagacggcccattctttcccactttgcatgccccatgccctgcctttctcctggcattgaccgtcacctgtcatctgttcacttgtctgttgtctgtctcctgcatgatcaggcacgctacccgagtgccgggacctcacttctgtttaaatgctggctcagtgaatgaatgagaggaaccacacgcctaatagactatgcggctctgccatggacctagcacaccactgccacataacagaaacaccagtgtagccagaaattacaataaagccacactgggataatgagggaggaagagcaagggaagagacagtgtagggatgccgatgccagtctccatggacagagggaaggttgcaagcggaagaattgagaagagcagagtgagcgcaggactgaggtgcctgccagccagagaagagcacagctcagagctggaggggatcggggtcacgtctgcaaggtgggggtgctcttcacaagggagaccgagacactgttccacttcattctcttgtttgcttgttttttgagacagagtctcgctctgtcaccaggctggagtgcaatggtgcgatctcggctcactgcaacctccccttcccgggttcaagcacttctcgtgcctcagcctcctgaatagctgggattacaggtgcccaccaccaggcctggctgatttttgtatttttagtagagacggggttttgccatgttggccgggctgctctcaaactcctgacctcaggtgatccacctgcctcagcctcccaaagtgctgcgattccagtcatgagccaccacgcctggtctgacttcattcttatgcacgtgcagtgcagtcataaaaaataaaaattaggtttacgggatttatttctgtagcacccactagaaaatggtagcatgtggactgaggccttggctggtcatccccaagctctggctgggcctcccttggtggtggtcggccgatgctcctactctctgggagctgcgagcccatttgggaacccagagataccggggtgaccgcaggcgatgttctggaaatactttggactgaagcatcgcaccagacaccggggctgtggggaagctggttgcagagtgccagcacctcatctgcgtgggggaggcctttggggaaagggggcttggaagccaacctgggtgggcccggaggaacaggagggggctgggggctttgcagctatgcttgacacttaaggatagacagctttggtggtcttcatagtgcggctgtctttgcctttctcaagcctgtgtcttctttttatcgctcgataccgattagacgtaacagagtttatgaaagtatacttcgagccggggcagttgggcattgggggccgcctggcttgtaggccaaagtttttaatcaggtgccactgtatataagtcctttaggtcttataggaggactgagacattgttccacttcattctttttttttgagatggagtgttgctctgtcacccaggctagagtgcagcgacatgatctcggctcactgcagcctccgcctcccaggttcaagcaattttcctgccttagcctcccgagtagctgggattacaggcatgtgccaccatgcctcactaatttttgtattcttagtagagatggcgtttcaccatgttggccaggctggtctagaactcctgaccccaagtgatctgcccgccttggcctcccaaagtgctgggattacaggtgtgagcgaccgtgcctagccccctttggtcttatactgatcctttaggtcaggggccgcctctcccagaaagaaccaggtagtatttgcagccatcctaggaaagacaacataggaacgggcatgacgcgtgccagtgaaactgtctgtggacaccaaaatgtgaatttcatgtaatttccacgtgccaccgaatataattattcttttgactttttccaaccatttcaaaatgtaaagcattgtcagcacacaggctgagggctggacgcggactggatctgggctgaagtctctgaaacccctgctttcgctgacagagactaaagcaccctggctttttgtcttgtttttaggtgcctgaaaccacaggctgaggaatggcgggaggtggcaaggatacggggaaggtggggaaaggcgcctcctgctggggagacaggcaccagctgccagcctgtgctctgattcggagtccgaaatgtcactagaaagactcaccagctaagatcccatctagcgcctgcgctagcaccagccacagttgtttcccgcagcctgtcgctttggggctgactgcccatctccctctcctgttccccaggtggtctctggaactgagcgcgcaggccggccccacctgtccgtcacgtgggcccagggtctcggcagcccgtcagcccccgcgtaggcctgcacgtcttaggatcactcagcctctgggttccccagggaacgtagagcagggggtgtgttgctgccatgaagtctggcctggggcccgggttccatgctcccctgagggtccccagcctctgtccgcttgtccccagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagaggtgaggaccctcctgggtgggacggccggggcttggccgggcctgtggggagagggcggtgtgctctgagcagcccagagagaggacactcgcaggtcccactgctctgccgcccggacagagctgcagctcgataaagaacaagccacagaaacgggcccacccgtgccaggacacagcagtgtctcaaaacatcaaaaccacaagttttatcagcactgggaaggatttggggctctgtccaagttcacagtccccatcgcaccgctggctctggaaggaggttgtccttgggcgtcccgccacgcaggggaggcctcggacacaccacccagagttttctgtttattgtggtaacacacacatagggagagatttccacgtgaaagcgcacaatcaagtggcgcttagcacatccacaacgtgcagctggcacctctgtccagttccagaacattccgtcaccccaaaaggaaaccccgtccccaggagcagtcattcccaagctcctcctgcagcacagcacccacgcagccccctcctgcctctgtggatcggcctgtcctggacacttcatagaaatgggatcacacactgtgtggccttttgtgtccggcgtctgtcacggaacgtgacatccgcgctgcggcccgggtcaaagcctggttcctctcctggctgagttgtgttccggtgcgtggctggccgcgctgtgctgaccgctcgtccctccgtgctgcacggtcgctccctctctgtggccgtcgtgaacggggctgcgtgggcgtgtgtgggcgggtgtttgtgcacgcgctccctctctgtggccgtcgtgaacggggctgcgtgggcgtgtgtgggcgggtgtttgtgtgcactcctgtgttcagttcttcggggtccacaccttggagtggacttgctgggctgcgtgggatggcctccaggaagaaacgagatgatgcttgatgaatggcggggtccctgcactcttactacccagaagccacagcactctaagagtcggtggccagggccccgcaacgtgtacagaaactgtggaagccgcctgttctctgcacattggcgtgaacgccgggctttggggcagccaaggagtggttttcctgctgtgtacagacttcagggagcaaagataatttggcccacggctcttccatgccaccttaaaacccggagcagccgcacccaggggactttgggagccagctgctgtcccctcgctgccccgagtagtcagcaccctccacccccagcagctcccagaggcggcctggacagggcacagggacccacccagacacctggcagcatcagagccacatttcagggcaggccccagctgcttcactgtgaatggaggacgtggctcaaggcaaggttgggccggcatcccccgagcccccaaacagcaactgccgcccctctgcaggcgcccctgactccaggtttctctttcagttcaacgatctcgcctctctgtcgctgacgctgctcgacaaaggtaggtgcgtctgcggctttcccaccacgaccctcccaggagggtggtactcctggccgtggcctgtctgccccatctcatgatgaacaggtggaaatgcgggcagccccttggggggtgagggccctgggatctgtcatccggacagtgggtgatgcctgggcagcaggtgacactgcagactggctcggctggggctcagactgccgctggcctctgggtagccgctgcccagggacctcagcaccaggcccagactaggcagcccctggtctcctgcgcccacgcccagcaggagagtgggacaggcaggccagagggacccccgggccccgtctctgtcccatgcgggtgggaggaccccagaggccccagccctgtggggagcaggccccaggcccgtcggcgctgggaaagggaggcacagggcagaggctctttcgcctggcccgagctgggggcacctctgggtaacggcaggtggggaggacaggtcagcctggagcagaggccgaggtggggtccacaggctgccatgtatcctcggtgccctgcctggcgtgccggagcagttctcggaacgtgcacttccttctctccctctcgtgccctcctgatgatggacactgaccctacccctccctccgcagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaggctctggcctgtctttccgatccacgaggaggaacagaggtggcagcgaagccacaagcctctcaggcctggtctcatttttcatagcagtaaacacactgagcgtgcccatttttggactcactgtccacactctaggccctgtccccccgccgtgggacaccagcctgccgggcctgccccactcaagacccagaggggaaaccacagaggtgccccctgcacttgcctgcgggctccctggggatgttctagtgccttccggaaggagcctgggccccttacttccttagcaaggcctatcctgagccagtgatggcgcagaaaccgttctttgtccaggatggtcaatggctcctgtttacactttgggtttttttctgttgtttgtttgtttttttaagagacggtctcattctatcacctcggctggcgtgcagtggcactatcatagctcactacaccctcaacctcttgagctcaggtgatcctcccacctcagcctccccaagtaggtgggactataggcg

SEQ ID NO: 11845 - DNA, 6982 bp, Human
cgcggacaaggcctgctgcagctccggcagcgcgcgctccagggcgtcctgcacctcggtgcctgcccccggcgacactttcgcgggcccgggccacccgcagcccaccatgggcccgtgccaccgcccccatctggcccaggcaccgccagccgctcggcgcccggccgtgggcccgacatggcgaagaagcgacacagcttgtaggcggagagaagcagcgtcaggaccatgggcgcggggccgcgggggacatccccggcctggaggcggggccacgcggagagacccgggttttgggaaaagagggacccgagaggggtcggggaaagaagatggagggggaggaatggagagaagggtaccaggcaagggtgccggtcagaagtttgggggaggagtgtcggcaggatcgggggagcggttggcaaaggtgatgcaggcccagatgcagggagtgggcgaaaggagagagcgagcaggcgagggatggctccggacgccgtagggtagaggaggcggcggctggaacaaagcgtggcctgggcacgggctcggctgagctgggagatgctcggcagcagccacgccccggaggagcagcggtccccgggccgacgccccgcctctgggtcccgcggggctcctccagcctcctgcagccacgccccggaggagcagcggtccccgggccgacgccccgcctctgggtcccgcggggctcctccagcctcctgcgcagccccacccccaagccgtccccagccacgcccacgcccctggccagccttccctagcccctcagtcagtcgcagccacctccccctgcgctggacttggaggaagggggtggagaatgagaggacgctctccgttctccgccccgcctccccgccccacgtgacatcggtacgtgggagcaacaccgctggatgccccctccctactaaatggttaaaacaatcatcataactcttaaggcccttttatggctgtttcttagcgaaacctcacaacatgcctatggggtgggaattgatgttccattccacagctgactccactgaagcccatgaggaagaaattggcccaaatcacagtcccctctgattacagaacagaaaaagtcagctaaaatctcaggatcacttttttcaggtgatgggaggatttcagaagttctgtggacacctgaaattgggcacaaaatcaggtgtttcatgccagtgggcattttccaggtagagggatcatatttctctcgagagtctaaaagtgtgttgaacaagcccactctttacagatggggagactgagcctggggacagggagtggcctgctcagaaaagactcagaaattaaatccagtccagtgggttgatatttacccaaatttccagcctggggagattgatgcacccaagagaagaacccagaaatgaaactttgttcttttatgctaaaaaataaaattccccagagtgcttacaatctctcctcccactccctttttcctgccctaaataaataatggcgaatgagcacccagccagggatgtgtctgatcaaacaatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaaggtacaggggagtgttggtggccatctgggtcaatgtagggagggcgagggtggtctgggcttggtggcaccgactgacactccttcctcatagagtcatgcaagggccgctgcactgagggcttcaacgtggacaagaagtgccagtgtgacgagctctgctcttactaccagagctgctgcacagactatacggctgagtgcaagccccaaggtgtgttcagagcccaggtgggtgggctggggtgccccctgctgctggagactcactaccatccactctctgcagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgaggtgaatccagggcaggtactggggatgcgggtctgccccaggagcgtccctgctctcacaccatctcctccactctagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaaggtgccaggggctgtgggccagggtagaaagcatctagggagggtttgagagctattgctcccagggacagggtggacagggaagctggacccagggccctgcaggacctggtgggagctctgtgagcacagggcagccccaagactccaggtcctgggcagtgaacctggacctgggaacggctgccttagggcaagggactctgcctctgtgcccagccagcggcctccataccccttttcactttccccacctcttagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaagggtactcagggggtggtgggagactgagcaggcagtggagcagtcttggattcctttcacatttcactggggacaggcctcagcatgtgcccacccctgacccccacctcatgctgggagatcctaacttcaacagcctctgggatctccagtcttgccctggcccagccctcctaatgcccaccaccccgctcctcagggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctggtatggagagagggcaagtcttgcttctccctcaaaagggctgaaaccccttggtattggtagagccaggccggctggagggggctgtggttgtggagctatcgatcaaagtctgtttgctcaggccagactttgcttctgttgaccttttggggaaagctcagctctacctggaccccacaccttggactttgcctagcacagctgagagcacagccagcagagggaggggctgtggctgaggagtttagggggcctgggggggtggggtcgagacaccagtgatatggtggagggaaagcacagggggaagggaattggactgagagtcaaaggcctggctctgccattcgctgctgtgtgtctttgggcaaggtgcagcagatgaactctaatggccccgctggaaggggcaagattcggacccccaagacctctcattcaccccttccctgccacagctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggaggtaggagccgctgccacccctgaagctggtctagcttgggttttccttgctgtccctggtgcacaagggctgaacgcagcctgcaagtagtgaccacagaaagccaggccagaagtccttagctgcatcatggatgttcactttcccttctgggagagaccctagacttctcaagggaagagtgggcagggccaggctgggcctcacgcatcctctgctttcctctcttccagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaaattattgttctgactggggtagacacatccctgtctgggtaaaggagaggaagctggactgtcagaatgggttggtgagggggacagagaagggacagagaagggcctcgccgtgtccaacccatgttgggctcaggacctctctgtgctcaggacctctctgtgaaccggtttggggctggggaaggcctcctgagagctacccttcctcttgagctaagcagcccccagcaacccaccagcagctaagcagacacttgaactcctctgatgatgacaaagttaccaggccagcctccgtgggtgaggcttgctttgccccttggagttgactagggtcttggaggagagagaaggggcaagagttggtggggttctggctcagcttttttgtccatcctgatctgaaatcctagtagctctgactcctgagcacttggggaaccagtcactgtgcttccccaaacccacccctagggtgagcctttcttgaggtctctgtctagggtctaggatggggagcagcaagaccaggagagatagtgaagggcagaaactgaaaggaaattcaaaagcacacacttcttgtggaaaagtggcccaggagcccaggagtttgaagctgcagtgagctattattgtaccactgcactccaacctggggaatagagtgagactctatctctaaaaacagaacaaaataaaaaagggggggaatttttgtctgggcatggtggctcatgcctgtaattccagcactttgggaagccaaggtgggaggattgctggaatcccgaagtttgagaccagcctaggcaatatagcaagacaccatctctacaaaaataaataagttagctgggcaacttatgggtggtgtgtgcctgtagtcccagctatttaggaggctgaggtgggaggattgcttgagcttgggaggttgaggctgcagtgagcagaaatcacaccactgtactccagcctgggcaacagagtgagaaaaagaaaatttaggccaggcacggtggttcatgcctgtagtcccagcactttgggaaaccaaggcgcgtggatcatgaggttaggagttcgagaccagcctggccaacatggtgaaaccccgtctctactaaaaatacaaaaaattagccgggtgtggtggcaggcgcctgtaaccccagctactccggaggaagaggcaggaggtggagttgcttgaactcgggaggtggaggttgcagtgagccaagatcacgccactgcactccagcctgggtgacaaagcaagactccatcttgaaaaaaaaagaaaaaagaaaaaaattttcaaaatttaagaaaaagtggctcagaatatatccaaggaagagaatactgtacacataaacatctttatcatctttcttagaacccctcaactgcacctgtggaacctcctctggttccaggttccgaaccccaggaagtccatctggctcttgaggggccagagagagaaagggttagatgaggcaaagctctaaagcagacctgagggcaatctggtggtgacatctgttccccagtcctgctgacagcggctggctcccattcatcccgttgacaccctaccatccttctcatcctgtcccacttcaccagcccagtccccagttgtgggagaggactccactccctctcccctgaaggtagccaggttcagagcactaagggctccagaaggggcagccagtgcctgggagcactggagagatggttttctttggctgcctggaaggacccctgggaggattttcatgaagtataggatttcaggcacagactgccagtttgaggtttgagaagggatgctgggtccagcttcctttgcgaggccttggaggggcagggggtatacaatttgccccacccataccctcataagcccaacccggcctccagcctcccttcttccccaccgagacttctctgccttgcttgagctggactcta

SEQ ID NO: 11846 - DNA, 10029 bp, Human
  misc_feature (1)...(10029): n = A,T,C or G
tgcggtgacgtccagggctctggccccggtggttctggccactgtctccgtgtccccactgtcccgtcttcaccccatcttgctcctgccccatctctctcgaaggcgacatctttttctctgtgtccctgatgtgttcagaaaagttaacgaggggaataaggatggtcagcactgactttgtgcttcacgtgaatgagctcgctttatcctcatcgtggcatttaggcggatgagggtgcatcattaaccccccttcacagatgaggaaactgaggcacagagggggagagtcgcacatggaggtcttgcctctatggagtgtctcagcgcctcttggtcctcagtctccgtctctcctcctccttcctgtctccacctgcctctttgagaaaggcttttcaaaaggccaggcgtggtggttcacacctgtattcccaccactttgggaggctgaggcgggaggatgacctgagctcaggagtttgagaccagcctgggcaacatggcaaaaccctatctctactaaaaatacaaaaaatagccaggcatggtggcgggtgcctgtaatcccagctactcaggaggctgaggcatgagaatcacttgaacctgggaggcggaggttacagtgagctgagatcacaccactgcaccccagcctgggtgacacagcgagactctgtctcaaaaaaaccaaaaacgaggccaggcacggtagctcacacctgtcatcccagcactttgggaggccgaggcaggcggatcacgaagtcaggagttcgagaccagcctggccaacatggtaagaccccgtctctactaaaaatacaaaattagccgggtgtggtggcgcacacctgtaatcccagctacttgggaggctgaggcaggagaatcgcttgaacccgggaggtggaggttgcagtgagctgagattgtgccattgatcgcgccattgcactccagcctgggtgacagagtgagactcagtaccaaaaaacaaacaaacaaaaaacaaacaaaaaatgagaaaggcttttactctctgcccccattgctgagtccccaacatctcagcgtctctgtctttctaatatctctgtctccccttttctgtccctggggcctctccgtccctgtcactctgccccgtgtctctgtttgcctggtgcctttcttcagctgcggcatcctctgtctcagagtcttggtgtctctgttcctttcccctcggggtctccctgggtctccccaagtccctcctgctgtcttcctcccgctctctgatctctgactcccagaacctctccctctgtctccagggctgcccctctgatcctctttgcttctctggtgtgtctctctggctgcctccatctctgtggatctccgtctccctgtctctgtctcagtctgtccttcactctgtgtgtgtgtgtgtctctctctctctccttcccttccactccctcttcctcctgcctccacctctccaggcccctgtcttgtccctccgtccggcctttctctgcctttccgtcctcctgcctccccatctctctctgctagtcctggtccagccggacccccacccacagtcgggccccagcgcttgagcctgagtgtctgctccggcccgtggaggtggagggaggggacgccaatgacctcaccagcccctctccgaccacccccccctttcccttttcaacttttccaacttttccttccgtgccctcctccgagcgcggcggcgtgagccctgcaaggcagccgctccgtctgaatggaaaaggcaggcagggagggtgagtcaggatgtgttcaggccgctcctcccctgccgcctgccccccgcccgcccgccccagccccctatataaccccccaggcgtccacactccctcactgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactgtaagttggttcatggggagggtggaggggacagggaggcagggaggagagggacccacggcgggggtgggagcagaccccgctgagtcgcacagagagggacccggagacaggcagccggggaggagagcagcttcggagacaggaggcggcggaggagatgggcagagagagacacagacaggagcggatggaggcagccaatcagaggcgccgcaggagggacgggccagacagggccccgagagggagcgagacgcggagaccgagcaggggcagggacgcagggactggtgccgggagggaggtgacccccatcggcccaggccccagggagcccgcggggaccgggagactccctgggattccggcagagaggctccggagggaaactgaggcagggtccgcggagagcggagcaagccagggagtagcgaccccagccggggggaggagagagactgggcgcggggggaaagcggggagagccgggcagatgcggccgacggaggcgcggacagaccgacggctggcgggcccggggggcgggctgggggtgtgcgaggcgcgggcggccggggagcgctgattggctggcggggtggccgggtgggcggggcggccggggtgggctgcggggagcgagctccggaccnnnnnnnnnnnnnnnnnnnncggggagcgagctccggacccccgcgccccccgcgcccccccgcgccccccgccgccagctctcccgctcccgcggcccggccgggcccatggctctgcccctctccgcccaggtgcgctgcggcccgggcttctgccgcccacccggcggggctcctgggagggcgtctaaggggtctcccgtgggagaggtccgtgtctcccgggctccgtcctggcttctggctccttcccctgctcccagccagctcgggctcccgcggcccggggagggggcaggttctggcctgtgcctcccccaccatgccccgccccggggcccagattccggcgtccgggggcggacgggagacgcccggcccgtctacccgccccgggccgcgtctgctccgacgggcggggcagccagagccagggagggagagggaagcccgcctggccctgcgacctgcccgcgggcgttccaccctgggacttaagacctccagctccatcctccctaaggccgggagtccaggccccagaccctcctccccgagacccaggagtccagaccccaggccttcctccctcagacctaggagtccaggcccccagcctctcctccctcagacccaggaggagtccagaccccagttcctcctccctcagacccgggagtccaggcccaggccctcctctctcagacccggagtccagcctgagctctctgccttatcctgcccccaggtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctggtaggagagactgggctggggccagcacaggagtgagaggcagagaggaacggagaggagtctgcgggcagccacttggaggggttctgggctctcaggtggcagagtgagggaggggaagagttgggggcctggcgtgggggatggagggagccccgaggctgggcaggggccacctcacagcttttttccctgccagagggacaaattcccagctgacggggaccacaacctggattccctgcccaccctggccatgagtgcgggggcactgggagctctacaggtaagggcaagggagtgggctggggacaaggtgggaggcaggcagtgaagggggcggggaggatgaggggcactggtcgggtgttctctgatgtcccggctctatccccagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctggtatgtcctggccccaagacctgacaccccagacccccacccctggccccaaaatcctgtggcctgagtccttgaagcctgagaccccagacccgagtgcaacagccccgctctgagaccctgacaccctaacagcccgctctgagaccctgacaccgtaacagccccgctctgagaccctgaccctaacagtcctgctctgagaccctgaccctgcagtcccaagatcctgtggccctgagaccctgaggccctagacccccaaatcctgcccagaaacttcaaattctcacccaagaccctgagactccatcatccatgacctcaaagtccccagatcccagcccctaagacccaagaccccatcctgaagcccaaagccttgagaattcaaatcctcacctcaagacttggagaccctggccccatgacattgaaaaccatggacctggccaggcgtggtggctcacgcctgtaatcccagcactttgggaggccgaggcaagtggatcacctgaggtcgggagttcaagaccagccagaccaacatggtgaaaccctgtctctactaaaaatacaaaattagccaggcgtggtggtgcatgcctgtaatcccagctacttgggaggctgaggcaggagaatcgcttgaacctgggaggcggaggttgcagtgagccgagatcgcaccattacactccagcctgggcaacaagagcaaaactccctctctctcaaaaaaaaaaaaaaaaaaaaaaaaagaaggaaaagaaaaccatggacctccagaccctgagaccccaggccccagccctgagatcctgacatcttaaagatcccaggccctaagatacaagaccttgacccaaagccagccttgggaccctggctgtacaaacccaagacctccaggacctagaccccgagccctgaggccctatgtctcactcccaacatcgaaaaccctgacacctcagatcctgagcctgcgcctgtacgactccaagaccctcacttccaaagccaggcccaaagccctgagaccagaagacttcaaaccctggttcttgggcctaactccaaagaccctggatctcaaattccaacttctagctctgagactccagccctcacccatgagttcctgaacttgaacccagagaccccatctctaagacttcagccttgagatccagggcctgaccctagactcgagcccacagacctcagatactgtctgtaaaaccccagctctggtggggagcagtggctcactcctgtaatcccaaggcaggggaggccaaggcagaaggacctcttgaggccatgagtttgagacagcctgggcagcatagcaagactctgtttcttaattattattattattattattttttggagacagagtctcgcgctctgttgcccaggctagagtgcaatggtgccatttcggcttgctggaacctccgcctcctgggctcaagcgattctcctgcctcagcctcctgagtagctgggacttcaggtgcacactgccacacccggataatttttttgtattttagtagacacagggtttcaccgtgttgcccaggctggtcacaaactcctgagctcaggccatccgcccgcctcggcctcccaaagcgctgggataacaggcgtgagcccccgcgcctggcttcttaattgttctaacagcagcgacaacaacaaaaacccagctctgagattccagccccggcgactctaacagtcccaggcccgatccctcacctagaaccgagatgccagccctgactccacagacttcacccccaacccccacactcagctctggaagcccgtcctgactccagcctccattttcggaaccccacagcctgaagagctcccggcctaaacacttcaccccacgcgccacagtccccctgtgaatatgcagccccgattcagctgcagctccacagcacccctgccctgcacccccgctgcaccccctacctgtgactcacctctctcctctccccacagatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccgtttgtttgttttttgagatggagtctcgctctgttgcctaggctggagtgcagtgaggcaatctaaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagtttgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaataacagaatatcagcctcctcctctccaaaaataagccctcaggaggggacaaagttgaccgctgattgagcctgtcagggctgtgcactaagtgtgggctttttacttacacaatcctcctggactcttgaatacgccctgttttacaggcgagggaaactgagtctcagacaaggagtggggactctgttgcacaaagtcacacagctagggagaggtggaagtgggattctgcgccgtgtctggctctttcccaaagctctctttgcaagtcggtgttgaggaatcctcgccacatgcacacacatgagatatggagaaacaggttcagtaaggatttgggtcttacccagggcctagagaagggtcaatggcagagtagggatgataattcaaatgctttagttacttttccctttacaataacccagacagacttccaggggccccgtgtcgtcactagtttgagtctggggttggaggtgcccatcctgggcccggagttttgattcacccatcatagccctcaagactccaggctggctgggcgcggtggctcacgcctgtaatcccagcactttgggaggctgaggcgggtggatcacttgaggtcaggagttcaaggccagcctgaccaacatggagaaaccctgtctctactaaaaatacaatccagctactcggaaggctgaggcaggagaatcgctcgaacccaggagacgggggttgcggtgagccgagatcacatcacaaacagccctaggcagtgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccacagagctgtctgggtcatcgtgcctcctccgtggaggcagggtctgagcctcgcctggggccccgcactgcatagggctgtttgtttttgcgatggagtctcgctctgttgcctaggctggagtgcagtgtggcaatctaagctcactgcctgggcaacaagagtgaaattccatctcaaaaaacaaaaaacaaacaaacaaacaaaaaactccaggctgtatccctggaggagaagggagcccacagtccccggagagttcctggaagaggcccctgtgtgtccgatgaggtcacaaagcccctccaccagaggctcctcccccagacccctgctgtccaccctggcagggccatggcggaggcccgagtctcccagcctggggcatctccacgctctgtaacgctgagctccaggcacccgtgaagccccacgggtcaaggctggtgggccggggctgggaggcctgcacgcctgggttctgggtccctaaaccagtacccatccaccacagccaccatgatctggcttcgaaacaggaggtgccttgagccgctccagggcaccccgaagtgggtccctgttctgggggagctgcaaaagaccctccagaagggcgagtacctgcccctccgtccgctgcccatgttcgagagtaactttgttcaggtctccagttcccagtgccccggggctgagagggacagaggggaagcaaggccccccgtgctgggggatcttgagagggaacgggatttagcagtcactgtgtgggggacgatcaggagggaggctcaggctgtggctgctggaggaaggagtggtcccagccccctctccctggctgccccaggtgacccatcaagggggcccagtgttcgtgaatcacagaaccaaccggctggccatgggcgtggccgcctccctgccaggcctggtgttgcctgacatcttgctgatcggccagcccgccgaggacagggactgctccggcctcgtgctgaccaggtgccgcatcccccaacccctcggccgccccctccacccctcctgctctagacgctcccctctccctctcccaggatgatccc

SEQ ID NO: 11847 - DNA, 25227 bp, Human
agaaaggaaaagaccatctttaccttcaaagaagtttatcaaagtgcagcacagaaggaaagaccaagaaaagacagatatcaagcattcagaaaagagtgttaattccaattgtgtttccaaggtcattattcaatttgaccagcatttagtaatcacctagtattttttcggggctctgaagtatactcttcaggatatgaaatgtaaataaaatacaatctctacagttaaggaggctacaggtaggaaacaggttgtcaaaaaaggcacaagtaacagaacatgagacaaaatgaagcaaaacttactttgcttcatttgcctatttatgtataagcctgaagagtcatgcaaacacgagtgctacagagattcaaaaagggaaaagaccatatccaaatagaaagagtggggatgcaagataggaacctggagacacaccttaaggaaatataaggggttagttggccacagtagatgttccaatcagagcaaactaaaaaaaactcatgcattgcattggggaaaacagtttcaatagaacaaggagatggaaatcaaacaagttgagtgaaatgtggttagtgaaaaagtggaaacaaagagtataaattacgctttctaaaagtttaatagaacaactgaaatatttaagagatggtggaatactaggggactattaaaagaaataatgtagataatgaaaacacactgccagggaaagatagtaaaaatgtcattaaatttcttaaaacacatggaacacagaatacttgcatgcacgtaatatcaagcttcaagatatgtaaagtaaaaaaaagtactctcagaaattaacaaattcataataatgatgtatttttgtttctttttatttttagttattatttaaaataattttattgttatttattcatttttatttttaattttaatatgtacagaaagaattgtacatatttgtgaagtacctatgatacttcagtacacacatacaacgtgtaatgataattagagtaatcataatgatttctaaacatctctcagtagttaatagaataagcacaacaaaatcagtatgagctgactccagtacaggactggtgcttatccttattaataatcagatcaatacaaattaaaaacagaattagatatctttacacacgaccagattaagaagatttttaaagtctgccaattccaagcatgggtgaggatgtggagcaacgaggactctcatacactgctgctggtaggtgaagccattctgtgaaattccttggccttgcctattaaagttgaagactttaattccactcctagtcaaaaaatatttaacaaccagtacagaaaggaaactccatttctcacaaatggccatatacatgtgactccaggggagttctgacccacagcactggaggccacagccacaggaggtcagatggacactaggtatttatctactggggttccagggactactctgttttagggggacagccagagacccagaaccatcagggctggttgatggactcacacatcaggtgggacaaaaagagtagctccttagcagtgactaaataggggcccccagggctgcaacagagttgaaggggaacttggggatttgggatagtgactttttaccaagctgaataaaaatacttcaatattttgataattggcatggccttcatagtgggtactggctgaatatcagctctgaattttctttaaggcaactcaagcatatgtgcaaccaagtacatgaaaagaatttgtatgtaaccactaattcatcataagcaaagaggaaaaaaaacagcaaaaaggaaaatggatgaataaattatgttcaattcatacactggaatattctagagtaatgaaaataagctacagccacaggcaatgtgaatgattctcacatagagtagaggggagaaaaaagacatgaaacaatacatacactatgattccattcataaaaaggctttgctagattaaactattggatagagaagcttaaataggtagtaaaccactaaatatgcaaggaagtgattatcagggttgtgaaggagaagaacaggtaagttaaatgggcgattgtgaggagtagaaatttcctttacttcataattatttgttaattcatctttatatgtttaatgggcttttctctattattttatatttttcaataaaagaaaaaagaatttaaaaaatcttggagctcactgggagcaatggggtttgcagctgaagtccaatagtacaaatgatgtggtaagaggccggcagggctgtgaattacagcaacaaaggagaaaaggaagtgattggagaattaagcaacatgaatggtatttattcaaagacagctcattataggacacggaactccctgggtaggagtttgaagctttcttaactcagaaagaaacttccaacacagtttcccaaagaaaaatgggcaccaagggcaaagtaagcaagtaagctgtatctttgttcagtttgtgcttttctgtgtccttgtatgtttggctaaaaggagcttccttcaggaactcaggaagcagtgacttacagttgatcaaaaggatatgagtgacccctatgccaggaatttattctagggaaattaactgtggattgccaaaatgtttattagaagggtgttcagttaatattaatattatttaaatggccaaaagaagagagatttaagtaactgtgctgtaaccataaaatataatatgcatatgttacaaataatgttgcaggagaatatgggaaaatgttcacagtatattaatagtagaaaaagtatattacaaaatactatggacaatgtatcttatttggggatactcgaagaatctgcatcaaaagcataaagtgggtgatgagcttacagatgaatcttattctattttttgtctttaaaaacttgataggccttggcattttgaaacttcctgttaattaatatatacttcatttgaaacaaaataaataatattcaaaaacataattcaaaattatgtaactattgaaaaatatacattaatgtggtcaaagactttgggaaaagtataccaaatgtaagcatagtagtgttagaacagaagattataggtttgtttctttctactttctttcaatgttgcttatatttgaaattaaaaatataatttgaggctagaaaaaattggggttatagaatcctaaatatttaatttctgttcattcatctttacccaaattcttacaattagatgaaatttttatttaatttatatcctacagataaatttaataatgatgtaagcctcatttctcagacttttaatgaattctctggggatattgttcaaatgcagattttgatttagtggatttgaggcagggctttcatctctaacaaattcccaagtgatgtgaataaatgcttgtccgaggaccacacttcgagttgcagagatgtaaaacacatctattctccagcaattatctgactcaggtaattcagagctgatttcaaacagttcactcaatagatttttataggccatctaccttattcaaactccataaatctattctctctgttatagagggaaaaacttgagacattatatcaaggtaaactttaatacacctgtttttttttcaagaaataaaaaatgtaatgactataatgtagaatttaacttcttatttttctttaagatcccttgtctttaaaataatatctataagatccagctacaaactctttaactctttgtcatgaaattacagtatcaatatattctaattttttctcatgatctcctctctcctacccccaaccctgtcaaaatctctatctctatctccctcttccttttctttctctctttcaggttattaaatgcaaagcagccatcgcctgggaagcaggcaagcccctttgcattgaagaggttgaagtagctccccccaaggctcatgaagttcgcattcaggtaagtggagactttccttgggtgggaacagacagggccccaagtggagacctggcttctgtcaggtcaatcctctgtgctatgattcagaggccttggagtttctagtacagggaagctgtatttttagattcagtcaaaaacaggcattatcccaaaaaggaataaatcatccattattttagtaattttcaaataatgggcttaaaatttaattgatcttaacattaatcatttaccctaagaatcagacaaaggaattcactttggatttgaattagttaggttttctttttgctttccagttgctaattatttgaaagtgttattaaaaggaagatagacaatttgatcgaaaacaagacagaagaaaaaacctgacgtgctgccctaggcagccgaagggtcctgggtatccagaggaagggacaggagtaggtcacagggagaagagagtgcatggaatggagtgagatcactgatggcaagtttggacaatttccccatttttcccaagctgaccaggcttatattttccttgaggacccccacattaagagtctgtacatgagagtgaatgggacattctcactgacagaaccttaaagaagaatataggtatacattggtaattaattcagacaatccttgatttgatattgttctctcaactgtaaaaggtatattacctcaacttcatttcaataagccctattacctttgattttttcctctcctggaggcaataattgccaatcctatctcttttatgattttctgacaacagcaaaaggtagaaaacaaagatgcattataagaggaaaataatctaacccagtatatttttattggttcttttttcaaaaggtgattcttttattgagttctagaagtcttataaagttttaaaatgatatcaagcctaatcttatatgtaacatccagcccaataatatagttgcagaaacacaattaaagtctgtgattgccttgtagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtattttattttattcagaaaaaatggaaatgtcacaatatttcagagataattattgatagagtcctggcttggcatgctataattgatctctatttacaaaaggggaccatcttttccaaagtaaaacgagagacacaatttatcacagtctagcaataggacagaatatttgaaatcagaattgtctaataaaatctaggaaatgtggtcactttatttacacatagcactgagaaactgtcccatgaagcaaagttatgaggttagctctaactgaaacttccatgtttaacaaatgacaccttataaaagaacaagatcatgtcctttgcagaaatatggatgaagctgtcagccattatccttagcaaactattgtaggaacagaaaaccaaatactgaatgttcttacttataagtaggagctaaataatgagaacacatggacacaaatggggcaatgacaggcacactgggtcctacttaaggatgaaggatggagggaggagaggctcagaaaaataactatcgggtactatgtttagtacctgggtgacaaaattatctgtacaccaaacttccatgacacaagtttacttatatagcaaacctgcacatgtacccctaaatctaaaattaaaggtgttgtttttcctttttttttttttttgagatggagccttgctctgtcacccaggctggagtgcagtggcacgatctcagctcactgcaacctccgcctcctgggttcaagcaattatcctgcttcagcctcccgagtagctgggattacaggcatgtgccaccacacccggctaattttgtattttcagtagagacggggtttcaccatgttggctaggctggtctcgaactactgacctcaggtgatccacccacctcggcctcccaaagtgctgggattacaggcatgagccaccttgcccagacttttttttttgttcgaaacagagtctcactctgtgccaggctggagtgctgtggcacgatcttggctcactgcaacctgcacctcccaagttcacacaaatcttgtgcctcagcctccagagtagctgggattacaggcatgagccatcacatctggctaatttttgtatttttagtagagacagggtttcaccatgttggccaggctgctcttgaactcccaacctcaggtgatctgcctacctcagcctcccaaagcactgggattacagatgtgagccactgcacctggtgtaaaataaaaggtttttaaatgacatgttataataacttctatataaaaaagcaaactattttaatattaacagcaaactatgtaaagaatgaggacttagaggtagctttagtgagaaatattatatatatgtcaacgttagctgaagtgtttttttggaagtttgtaagataaagataatacctaaatgaagcaccccaatagctgaaattatttactccacattttacaacagatcctccagatactggaatatgggctatgtaatcctcatttggcaggccagatgaaccgtgccactcttttctcttttaatgagaatgctccaaagttagaggtatattagtatctttccattccaaaaaagattgtacaaacaaattgcttcccaaaattttgtgtcaatgaaggagtctggccaatataatccctttagccccagctctgccacttactggctatgtgatcttggccagttatgtcacttttctgtgattcagctcagatttctgttttctatagtgtgaataaaaatagggctcgtctcaaagagttgctctgagaattaagttctgaaataatacatgtaagtagttataatggtgtgtggtatgtattaaatgttgaatgaatgtgaattatcatcattagacctcaggcatcgaagcacagaagtcactattaaattggaatttattaaaaagtggaaaaatgtggaatttgaaagtgaatctaaaggtgaaacatagcaatgatataaagtttatacctagcctataattgtttacctctcctattatctaaggatgttatgtttcgtacatggtgtttggaaatgtaataaacaatagtcatgatgcagagagtcacaatgacagcaaagtcccagagttctgtatctgatgatatcaacatagatttgttgctggactgcctagcagagtaattttttaaaaaatacaatatatgcaatacgttggggaatctgcagtcttgtaaggtaatgaaatactgtagccacctatactttccactgaatataaaatgtatactataaagaaaaggtgttttccactgatttatctggtagaagctataagtaacaccttaggcaccatccaacatatggcctttctttctaggtgacaaagtaattccactttatgcacctctatgtagaaaatgcaagttttgtctgagtccactcacaaatttgtgtgggaaaatcaggtaagcactctacactgttagtattagtataaatttgaatgaatattttggaaagcatattgacattacctaaatggccttgaagaggtgcaaaccttccacccactaattctaatcctaggtgtgtacaagatactattgcaagtgcacacaaagaaacatgtgctggaatgttctttgtaacactgtttattagagtaagcaatttaaaacagcacaaatgtccatcagaaagagaatgaattttaaaactgctatgtagtagcacaatggactactacacaacaataaaaatggctaaacttgagctgcatgtattaacataaaataatctcacacacataatgttaagggaaataagcaaattgctgaaggaatatttagtaaagtgtcatatacaaaaagaatactatactttcttatggttatttgtatatgtagtaaaagcataaacaaatcactgaaataataaatgccaatttcagaataatagctacttctacagggatgagagagggatacaataaggcacagtaaagtaatttactccaaggcaacatagttataagtcttagagccaggtttttaaccccggcagtatggctctggagtctaaaatcttaatcatcttgtttttgctttactagactacagaaggatcctttcatccttaacactaattgaaagcagttatttaagaagctaaaattgtactactcttacatctattactgtgcctcaattttttcatctataaaatgaggagcaaaataatgcctgcttcatagacttgttctagatattcaaagaactaattttttttgcaaagctttaatgaaataatggatttaggcaataccaataaattctttctaataaatgttataaaaagagataatcagatattccaaatgaaatatacgataccacctataaagtattaccacaaaaatataaaatctgaatcagatcaagtgtttagatcaaaaatactaatttatgaggggatgcagggatagagaaatatgttcaaccagattacaggaatgttatgagcaaaattcagaatgagaaaaactctataggacaaatgattcaatttcttcaacaaataaattgcaaggggaaaaagagagggagaagggatctataatttaagataattaagagacaacaaaaatgtggacctaaagtaatcctttagagatatatggtaatgtttttacagatgaaatcgtgatatctgggatttgcttcaaaatattccaatgtgggggagggagcagatattgtggaggaataatagatgaaacctgactggccatgagttgatggttactggagctgggacatggacacataagggttcattatgctattccttctacttttatacatgttcaaattttccacaacaaaaatgttttaagagttaatacatgtaaagcccttaaaagcatttctggtacacaaaagcattcaatgaaagtttgttccctggccgggtgcggtgggtcatgcctgtaatcccagcacattgggaggccaaagctggcagatcacctgaggtcaggagttcgagaccagcctgaccaacacggagaaaccccgtctctactaaaaatacaaaattagggccaggcgaggtggctcacacctataatcccagcactttgggaggctgaggcgggtggatagcgaagtcaggagttcgagaccagcctggccaacacgatgaaagctcatctctactaaaaatacaaaaattagccgggcctggtggtgcgtgcctgtagtcccagctactcgggaggctgaggcaggagagttccttgaacccaggaggcggaggttgcattgagctgagatcgcactactgcactccagcctgggcgacagagcaagactccgtctcaaaaaataataataataataataatacaaaattagccaggcgtggtggtgcatgcctataatcccagctactcgggaggctgaggcaggaaaatcgcttgaactcggaaggcggaggttgcggtgaacggagattgtgccactgcagtccagcctaggcaacaagagcaaaaactccgtctaaaaaaaaaaaaattgttccctgcactccagcctgagtgacaaaatgacaccctgtcactttttaaaaaattgttgctgttattttttaaatttgctgttattcaacaaactatattttgtgaaaagtcttgttgtttccctaatttttctgtcttgtaaattgtcatcaaaaatatataatgctcaacatattttgtaggaaaatgatcagtgttccatttattataacttctctttatttgtatcactcttttttttaattttctagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtaaatggttaaacaccagtttgtgtaaaacagaagttactaggaggcagtgtgatacagatgaactagagttagttatcttcaaactgtggctgtgtcatttattacctctgtgattttaagcaagttatttaatccctctagaataatatctactacaaatacttatgaggataattgaataatattatatatgtaaaacatctggcccagtagcctacatataattgacccagcatatgttcttatactatactaacatattaggttatagatcttccctgatttaaatacagcctgtttaaatatgtctcctaaggatgaatgctcatcctaggacagctgactcagtcaaagggcaacaaaaatgacagaaactcacttccatcttcacacaaccacccctgtcttctccctgttgctacagatttatctccctccatcagtagtaattcatttctgctactcatcatgtccctttgtggcttcaaaggagggtctctggtagcagccgtaatgttgaccagatgtgtccctggaatcccatgttagaatttagaaactcttacaaagcatctgatctagaactagagagacatcaaagagggatctcacaattggacatctcaacctgcttatctgaacctccctgacatcaatctttattcctgactcaaaaccgcaaaatgcagccagagtggtctttcaaacaacaagtctgaagattttatttttcctgcattatttcatttttccctcagggtgagctcaaattcctcagtaggctacagtgacttcctacttctccctttccactgtgcactcactgttcccttggctccactctgagtctccaggcttcagtcactgtggtctctgggctttccacacttggcttccagcaacaatgcagagaagactgccctacctccttcaggctgactccacttatcacttcctctcagagatctacttcaggctctcagccatgctttgggtatccctcccagttttcaccccaaatttttttcttttttgagacagggtctcactctgttgcccatgctaaaatgcagtggcatgatcattgcttactgcagccttgacctcctgggctcaagtgaacttcccacttcagccctccaagtagctgggattacaggcatgcaccacgatgcctggctatttttttaattttttatagagacagggtctccctatgtcgcccaggctggtcttgaactcctaggctcaagcagtcctcccacttcgacctcccaaagtgctaggattacaggcatcagccaccaccagcctctgtcttcattcttatcacactatagagaaatctcccatttatttttttgtcctattgtactatttgttccttgagggcaagaactctctgttgttcattgtgatagctccagagcctggaattgtccctggcacataacaggagcttgataatttttcaacgaatgaataaataaaaccaggtgcataaaacatcctggtgaggcctggtcctcggctttgtaatccagaaagtccttcttatcaggttacctagagttgttcagtgtcaaggaaacaaagtcagcctcaccacaataagaggttgatctagtagccaagataccaaagtatgactcttcattgagaattttatctgccacatagacaaaaatgctaccctttgctatcaacatgttatctccctttaaaaatgtatttacgcacacaattactcattaataaaaaatttaaaaaattgtgttagaaaccaaactacaatcagagaagggtactagtagctgggtggagttgacagcagatgtgcacatggcagtcaaagcctattttctgctgtatggcgctagagacttagggaagaagtatcactcttcaagtcttcctttgctgggctccatgcagtccatcctcttctactactccagtccttttaagggccatcagcactagaggttcagctacagctttcttttttaattacttatttatttttaattgaaaaaaatttatacatttatgaagtgcaattaacgttttgatatatatatacactgtagaataattaaatcaagctaataatgtatccatcacttcatatacttatctttttgtggagagaacattaaaaatctactatcttagcaattttcagatatacaatacattattattaattatagtcaccagagcgtacaatgaaattccagaaattattcctccactctatccgaaattttgtaacctttgaccaacatcctcctattcgtcatttatccccccagactctggtaaccaccatcctagtctctgcttctgtgagcttgtcttttccacatataagtgagatcatgcagtatctgtctttctgtgcctggcttatttcacctgacataatgtcctccaggtttatccatgttttcaccataacaggattttcatttttttaaaagcataattagtactccattgtgtatatacatatcatatttttcttatctattcatctatttgtggagcaaaagccagaggtgtgcatacctaatattattgataaataaggaaaacattgcagtttacctgttgcttagtaattttgtttccaatttagaatgtattaaacttaccttgagcagattttctgttttccttttgtttaaggattggttccacattttggctattgtgaataatgcttcattgaacatgggtatgcacatctcatttcctttggttgtatatacagaagtggaattgtacagctttcttttaaatccagtcaaagtcgacctaaatttccaggagttgttcttcccactgttaaggaagagattctagctgctaagccacctcatgagatcctcagagagaaatgaatctgataggaagaaattaaggaaagtgaagtatcagtaattctgcccaaaaggcaagagctttagtaaaatttaacttacttctgggaagaaaagtgaagcaacttctctgtataattattgagaacacaccaacatcaccagaacccctctttctttttgatgtgcttgtatcctttactgccaattaaacaacattacacagagacctttggaagtgtggaaatgtcctctaacagtggtacttgcagatagataatcatctactgtgtgtagactcacttgcaaattgtgggggcaatttatagtgaccccacctaagttctgcaaacaaaggcacttttacacacaggggtccagttgtataatacaagtaatgcagcatattatatttatacactgttgtgagctagcctgagaatccaactactagttacattgctgcaatgggaaaaatgcatttccacttcctaagagactcacaggctccttttaactgagactctggagcaatatattaagaatcatactgaacacatgccacaacattatagtaaagaagccatcataagaacaatattcttactatttgcaatatatatacatatttattatttcctctgagtagcaaaagccagaggtgtgtatacctaatattatagtaaataaggaaaatattgcagtttacctgttgcttagtaattttgtttccaatttagaatgtattaatacttaccttgagcagattttctcttttccttttgtttatgttttaatcctaacagctttgcatcctcattaggaaatattaagaatttctctatgtagtatttttctatcgctataatagtctgtagaataacatattccagttacagcatcttttcttaccatcttatctattatttccatttaatgcaatgaaacaaatatttattaaagactcaatatacagaagactctttcataataatgtggaatttaaaaagtttctgccttcataaaatttacggtcttttaaagaaacacacatacacacacaatcaaggcaggttataaattatataataaaagaaaagcaaaaagacaggcattgatttctgattgaaaaatcaagaaaagtttcatagacagaatgtcttggaagtcaggcctaggagtataggttatactttaattaaagaaaataaggttaaaagtacatcagtctgagggagcagcgtcaactacggcatgagaagaaagtgcaacaatctgttcgcagttcttgtactgggaatatcatggggatgaagctggaaggtaaacagaggtcagacaataaaaatgctttcatgccatgcaaaacaaattggacttcattccaaactggtgatttggagtgatcaagtaaatcactgtaatattaatacaaccaaatgaggactattcgaaatatagatgtcaaattaatagtgatccaattttaaaaggaaagcaataaacccttcagaatgtgtgggttttcaaattttgttcagataacactgaagggaaaaagtaaaacaagggaattatttttacttgggtttgtttcttataatcttaatgaacactaaataattctccaaatttaagtagtaatgcatccattttcgcattggcagatttcctccattggctatatcatagagtttaatagaaggctgtctttaattcatatgttcatgcccccacttcctcctgactcttaaaagaaaaaaagtgggactggctgctttagaagttactttataattttcctgcttgcaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatggtatgtatattttgttcttggatcatattttcaatgtattctttggctgtcaaataataggggaaagtggattatgtttattatggtacttagtactttcaaatggatgacagggtggtagaactataagccacaaatcatttcccattccctcagctatactccatttccttcaatgcccatgaatgtgtccccccaaatgccagtactatcttggtgagttcagtcttctcttgtgataagaagccataccagcattatttgtagatgctgatttttcttttgagatccctttaaaaagctcaatattatttgtctggagataatattttctaattttgttttctatgataattccaattcctattccttggagacaattttaggggttttttcatttttaattagagaaatgttccttttgactattaaatcaaataaaatgacaagtgcattaactagacagcattctttagccaaagatataaagggatgaattaactgcaatgcataaataggaataaacacctattttgtttagctatcttatgcattatatacattattaatattaacatttgttaatgtagaatcttttctttaacagtatataatatttaaaattaataaacaatatgtgcatgtgttgttatatttaatattaacatattctcaacactagctatatgttagaatttcctgaggggtttttcgttgttttgttgcttttttaataccaatgaatgggccaaacccaggatattcttgtgtgctgggagcccactgacaacattttaaaaattaatttctcaagttgagaaccactgacctaaaaattagcatcttctattattaagctgacttattataccatgaaagtcattttcaattatggaacagaattatattagagaatccaaatggaaagagaaagatttatttaatcaccaaaagatgagttacctactctcccaccaaaagtttctatagctaggaaaagcttctatagaaagtttctaggttccaatgacctctaaccctctaaaccaagggtcaacaccctgtagcttaccagcacaaggattgtttactaacacctgctaaggacccttttaaggagctgaatgtagtgatactggagtctatgacctgactggaagctgtagaaagattttataaccttgcagtgattaattttttagagctttgataacccccagcaataagtcagagacttaatttagaatttaattttgaaagtgtttgtcaaaaatgttaaaggcctcaaaacatttgattaaaacagaaccacaggtcattgtaaaacaatagttacttatttagccaaataaatcatcaaaagactttaaaggcaatacatgaggatgtatggatgtaaaaaccttaacactatttttttaagcaattaaaaacctaatgtagacaacatgggaattattttgataaaatgtaaaatgttgtttcttaagtcagttaccagaaatggaaagaaaaactggtagtgtgactgcttctccttatgggaagcccatttcaataaacctgatgggaaaagtgcttgaatttaatcagacatgggaaaagtgtgttcaggattatgagtacagcaggggaatacataattcttagtaactgcatgagaaattttctggttacattgaaaaatttaaacatatcaagaaaagccaagagtacagaatcaagttgtactggaggaaaacattcactcctagacctttaagataaaacattttagtatcaggccataagaatagttagaactggaggaaaaaaacttataatagctgatgaaaaagctaaagaaaagagttatctctgtccaaggggagacaaagctgaaagcagggagacatagcaaaaggtgaactgacatatgattttgagaagttttcaaaagaaacaggttataaaactaaaagttaagtttcttttaattgtattaagagcaaatcaatactgtaaagagactttgttttaacataggggaataatcttagaaagactattctaaataatccttttttaatcacagcaaatttaatcacatacaaaatttttttataaattcctcttcatgaaacttactatgacttacacagatgatctatgacatgcttggacttctgacttatcctaattttttccttttaaataataagtcattttattttaggacaagattttaccataagattcttttttatatgaaattattcttttttaataacccttttattaaaaatacatttttatatttataactttatatttctctcccctacttacttttttttatctttttaagtaaataactttaaaataatttccaaattatgtaaaattattctttaataagaatacaggccaggcacagtgggtcatgcctgtaattccagcactttggaaggctgaggtgggcagactgcttgagcccaggagttcgagagcagcctgggcaacatggcaaaaacccacctctactaaaaatatgaaaattagtcaggtgtagtggcacacgcctatagtaccagctacttgggagggtaaggtgagaaaataacttaagcccaggaagttgaggctgcagtgagctatgatcacgccactccactgtagcctgggcaacagagtgagactgcctcaaaaaaaaagataatacaattatatatttatatatgaattagaattcttattcctagtaaccttaaattttcatgaaaacttagaaagcaagaaatcctgaactgttagatgtaagcattttatagatgaaatcatttcacaattttagaaacatgttttcctatatcataattttttaattggaaatgactcacatatccagcatttattatttaatttaaaataattttcagattttatattacacaaaaagtccacttataagcatttatttcatttacatatactttttcatttttaatagttatctagataacttttgataactgagatattatgcagaactagccattatttaaagttatttccttgttaactttttttttgagatggagtctcactctgtcgcccggtggagtgcagtggcacgattttggctcaccgcaacctccacctcctgggctcaagcaattttccttcctcagactcctgagtagctgggactacaggcacatgctgccatgtctggctacttttttgtatttttagtagagacggggtttctccatgttggccaggctggtcttgaactcctgatctcaagtgatccacctgccttggcctcccaaagtgctgggattacaggcgtgagccaccatgcctggcccttgttaactaaagtctaaacattaggtgaaaacctaagtaagaaccataaggttaaacacataggtattttgctgataaattaggtgattcagttgctgttattgacctaacaattttaaattagtcttatttgtcaaaaaaaaaaaagtcacacaatgatagatttggctgggtttacagtctcacaacctttgtcccaaaccctgacactttaaacatttagcagaggcaaatataaaacttatttacttacacacaaatgtatgctgattttttagacatctttatttttattttactaataattttttttttttttgagacagagtctcactctgtgacccaggctgcagtgcagtggtgtggtctcggctcactgcaacctcctcctcctcccgggttcaggcagttctccagtctcagcttcccgagtagctgggactacaggcaggcacaaccacacccagctaatttttgtatttttagtagagacggggttttgccatgttggccaggctggtctcgaactcctggcctcaagtgatccacccaccttggccacccaaagttctaggattacaggaatgagtcacctgcacccggactgtgctgaacattctatttgtaatggaacactgggccctcaaggctcaatctacaatgatactatgatgtcattagcttgaatcccattatcttacatgcagagttggattaatttttttctaaagcattgtacattgccacactggagttcatattctacttttccactgactcaagtattcttttatgctccatcacagaaagcagccctggactgtacaaccgcaggctggggatcatgtactttcattggagtagctgctggtagcaaaggattgactatttttccagaggagctaataatcggccgtactataaatggaacattctttggtggtcagttttttttttcttcatagctttaaattcttttcctagtagttctgaaattcttagagtgaaggttattgaaaagaaataaaaataatttattcaaccattgaatccctagagcatatccaaatactacataaaaactattaatgacttataaataatttatataaaaaggtaattataatttgcaaattgaaatttaatttgcatttgaatgaaccaacatggaggaacaaaaaataaacattgaccttattgagataatttcttatatagagtggaaaataatcttaaatttttcttataaagaaaaattttaaaatagatataagtacagaaaattaaagatggaaggagtttaatctatttgaagcaaaccaaatctgacctaataatttcattcattcagcaaatgctgattaaactacttcgtgtcaagtgccatgtctttattttgcattttgtccacattacaggttggaaaagtgtagattctatcccaaagctggtcactgactataagaataagaaattcaatctggatgcactggtgacccataccctgccttttgacaaaatcagtgaggcatttgacctaatgaaccaaggaaaaaggtacattactaatagatgactgaatgatttaaaaaacgtttacaatgattctatcttctttttgatgttaagaagcaaccagcttgttttttctgacattttccacatcccaggtactagatgtgcttaaaagattaaatagtggtcatttcagaggggaaaaccttccatttcaataatgcacatctgtacactgttacaatatagaatggtggcataaattgatacaatttccatttcacaaaccattaactcagttggggctgctccctagaaagagaggtttctgtgtagtataatgttagatccctctagtacagtgtacccctgagtttagcaccgtggtgttctgcagtttgacacagagtgcctaccccagacccttcacaatcagaatggggtgaaaaccatgcctctgtggcagggatcagacatgtaaaggatgccccaactgtctcattctcttgctttgtcatggagttcctctaagataccttctgatccactattttagttatacagtgctcccatgtcagggatcccaggaactgatgcatagaaatgttccacctggaagattcttaggggttgggggattagtaagactaggatcaatgattctaggtaaaatgttcaagcacagccttgatcaatagaaacaaaggtcaaaaacattaggaacaatgttacatagaggagacgcaggaccaagaagaaatgaaaagagaagatacaacaaaagagaggaggaaaagtctaaagtaaaattaaaataactgggatttgaagcagggaataaatgttgcagaagaagaagatagtttcatggtgtgaggacccagactacttcttggggaagaaacctgaggaaatatccccactgacatgaactccccaatttgcaaacgtgtcagtcacaacatatcagaaggaagttcaataaaaagaaaatacaagcattattttttaagctacaccatgtaaacttagtatataagccctgcaatgtattatacaacttcaatatccccataaggaatactcctcaagttaggagatagaggttgaagtggggtttgagcctcacacccttctattcatatcctcgaacacaaaccttttctcctagaattctcaattatggaatacatccataaggaatgctaagtggcagccaggtggaaaatgctgcattgctttatgggcaagtctcccacattctcccaggaggcttccctggtaatcagcctaggggtagacaccagagtgaggcctcctgctccttctctggcccactgagaataccacctgactgcccacacagatggaaaggtggcaatgaggaaggcagaagttgggcctcatcaggtgtgtccaccatatgggcacaggaagcacaagagagggcaggccctcctaccacccaactgcaaagaagcaaggaagtggggggaaggggatgggatacaatgactgactagcctgttgaggtgtagtgatcctgccccagagtgaggaaaggacacagagattctccttccacaggtaggggtgtcttccagtcctgggtgaagaaaacatttatgcatagcaccctgctcatagcaggggttccacagttccagcagtaatgtttgagataaggactgctctgtcgttgaggcttatccccctctttgtgtctacatgttggagttacccagaaataagaacatctgggttcttaaaaagtagcatcccaacacaccaactttgatgcccactccctccttcgatgctcaactttgccctcagctataggagatccgagaacagtgactattccaagactaaaacctgactccctccttggtacattctaattctcctcaacagcaccactgagtaacaaggacgctgcctaaggtaagtaagggtcctcaattccccccaagtttactagcacatgcataaaatattattaacaccatgaatggaagaggatgacgggataaaagaaattaggcttaataaagtgaatgtctataaaggaagaccagatcctgaaatgaaaaggcaaaacttatttgtgagctttggttaaatttatcatgaaaattacacttattaatgttttattgttattaacagcgtccgaacaatcctcatcttttgaagatgccaggagcaattcggaatactatctgattgaatgtgaacctgcctggttaatttattacctgatttgatgaaccaaggaaagccatgcgtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaatgcttgaggagatggacaccccatattacatgatgtgattattacacattgcatgcctatatcaaaacatctcatgtaccccataaatatatacacctaatacccacaaaacttaaaatataaaatgttttaaataaaaataaagaaaagatttcccacaataaaaagatttttactggaaaaaaatcactatatttcacatacatgtgtacatatatacattatatatatatatacactatatatatgaaatatatagtaattgtgattatgtgtgtatatatatattaatatatacacacatatatacataaaacattattatatactttgtgttccaataagccacaagctactttttaaaaataagttgctaaataattttctttttaacatctgctaatttcttttctcttagccccactctatcatattaactgcaatcacatggaaggagatatcagaatctatttaagtgaatattttaaaaagaataaaagcatatctactctctcaagtttctatctctgtaaaataactgccctttcatctttgataattttttttcttcaacttttaagttctggggtacgtgtgcaggatgtgcaggtttgttacataggtaaatgtgtgccatggtggtttcctgcagagatcaacccatcatttaggtatgaagcccagcatccattagctattcttcctgatgctctccctcccgccacccccctcaacaggacctagtgtgttgtttcccaccatgtgtccatggattctcattgttcagctcccattataaatgggaacacacagtatttgtttttctgttcctgcattagtttgctgaggataagggcttacagctccatccatgtccctgcaaaggacatgatctcattccttttcatggctgcatagtataccatagcatatatgtgccacattttctttatcctatctatcattgatgggcatttggtttgattccatgtctttgctattgtgaatggtgctgcaatgaacatacatgttcatgtatctttataatagaataatttatattcctttggagatatacttggtaatgggattgctgggtcaaatggtatttttgcctctagatctttgaggaatcaccaccctgtcttccacaatggttgaactaataatttacattcccaccaacagtgtaaaagcattcctttttctctgcaacctcaccagcatctgttgttccttgactttttaataatcaccattctgactggcataagatggtatctcattgtggtttgggtttgcatttctctaatgatcagtgatctttcctaatttttacaacacataatgttgagcttaatgatctgcaattggcactaattaatactattgatctgtaactggcactaattaatgctattttcaatagtcaattaaaagttacaaaaattgatgtacttataaaataatgtagtaagtaaacttttatagttataagatttaacagataaaaagatgtatacaaaaatagcaaaatggaaggtttcaaattattatactcgagatgttacaatgaacagtttaaaaggacaacatagaacctaaatgcccatcagtgatagactggataaagaaaatgtggtatatatacaccatgggatactatgcagtcataaaaaggaatgagatcatgtcctttgcagggacatggatggagctggaagccattaacctcagcaaataacgcaggaacagaaaaacaatcatcacatgtactcacttataagtgggagctgaactatgagaatacatggacacatcatggggaacaacacacactggggcctgtctggggggcaggagggagagcatcaggaagaatagctaatggatgctggtcttaatacctaagtgatgtgttgatctgtgcagcaaaccatcatggcacacgtttacctatgtaacaaacctgcacatcctgcacacgtaccccagaacttaaaagttgaaggaaaaaaaaaaggatcagataataatttagatcagagtaataaagactagctttcaccttggaccagaacttaaaataaaagttgaaggaaaaaaaacaggtaagatacataataatttagatcagagtaataaagactagctttcatcttggagcaatttctgaaacctatcagttttctttaaa

SEQ ID NO: 11848 - DNA, 27009 bp, Human
tttatgaatatggaagctgaagtcatacatattcaagcaaggctccaggccctgaaccaagtgactctaattccaaagcccatattcctgtagtacacttttcaaagttcctctaagttcccctgtatcttgacctgaggaaattacagttgcatgggtgctttgaggtaatcattaaaggcttttgtaaactttgggagtaggaccaggctcacagtaactaggagattgagtaccctgagggttctggccccagaatttcatagaaatatggtgtttagaagaaagaagtcatctgttaaattctctaaacctaaaattaagacttagctgctatatatccaaactgacccattttttttattaccttccaagattcagcttttggcactttatcatccaatcaagtttcatggagactggattaggaccataagacttattcagatattaagcctcacatgatacattattttttgtaaaaaattttttagattaatatgatacaaagttttgccaagcccttaagagggagtttatcaattcagcgcttttgcatttatgctgtcaccacccatgtttgaactcattttcttttgttcataagtaaacaagtttttgtttgaaagtcgagactaagaatacctgtccttgtccacacctgtttaactttgtcttatagtgccagcaaacatactggagttcttcagcactactgctaaagcaatggtgcttactcacaagccaaatcaactggcaatggtttttcctggtggatttgatttggttaatgagttgtagtaacaaattctaattacaaattctgaatttgacataatatatgttaaattggatgtacatttactatgttatattgaaagagagatgtgtggaaaaaatgtatacttatttttgaaaagaaacttttgtttgtatctgaaaaataaactcttagcaaatttcatctctgggttgttaagagtccaggttctggacttcatagcttgaacagctttgtctgaagacttagaaaacctgcttcactggatcacttaacaaaagtaaaatatcctttgtgtaaagttttcttggaggtgatggtgtaccagtatgctgaccatctggtgtaccagtatgctgaccatctactgtcaaaaataacatctatactggacattctcctatcaaataatagatccagaagcttctggagccattgcaacttatattaagaaataatggtctgtaatggttaaacagctactcaagaagacctaggtacttgcccaagtagatgaaaaccctctggcattcgatagccagtatgcaggctggatttcaatttctcttgagcccctgcactgtgttacattggtgccgtaaacaaactgtacaaccatatgaggcaactctgtggttaatgggatttggagtcagatgataatttctctatgtgcagacacagaaagttttacttaactttctacacctaaaatacttagaaaccatagtcatccatattgatattttatatcatctcaacttctcttgcccaaacttgacctactgttgcaattattttacatttccttggctctgttttcatttatatttaattccagaaaccacatcaagtctttgcagaatgaagtagagcattaagaagtagagatgtacacacgcatctctaaaatcagccatgcctaggcaaagcagcttgcacttaaacacccaatacatttttcatgattgtgttgaagtgaagtaacctaacccgtttttatatccttcaaaataaggtggataggaatgctttcagcccttttcaatagctttgattatcttgtttttgttagatccctcctcttggtttgatcatagtagttactgtatttctttttataagttggtctgcaaagggtagggcttgcagaccattgcaaagttgtgacggctgtgagtcatattgctgaaggtggaactctgaagccagactatctatgtgaaggcacaagctgctgttatatacaacagagtgaactgagcatcagtcagaaaaagtctatgtttgcagaaatacagatccaagacaaagacaggatgggcactgctggaaaagtaagtggaacatttctgtcccctcctcatcatgacctaatgatgtgaggctgatacttagaactttgaatccattaaagtaattaaacacttggagatattccttgaggaatgaaatgcttggtgagcaggcatacagtgagggaaacactggatatggtgtttcagagaatgtcagtggaagcaggggtaagttggaaatagtatatccaatgtcagcaagacattggtggaaaatagagaaattgatttatattggcattattcataatttgatttccggatagctgggcaattgctccaggaagccaaatgtttccacaaggacacttcaatcgtctcagtagcatgtgctgcactcgctgcagtagttcaatgggaaaccagggtctcatgcccagatgttggaagaaacgttcctgccattaagaatggaaaatgctaattctgggatgcaaaatggccaagaaagtgtcatgaattttaggtttcttacaaatgtaatttttatcaaaatatatatttaaaaattctttaaaatcaagactatattattggtaaagtatgtttatcgttctaaaaacaacagagttagcagagttggtattaactttagaaacagctttgctttgtttttttttatttgaaaataggtcagtatatttccttactttaaatgggtacataattgcttaaaggactaaatttttttgtttgttttgttttaacttgaacaattttgcatttagcttgcttaaggttttggaaaaataaagatgacatgagaagtctgggtaatgtgacaagtcaggagactctatgatgttagaatttgaaataagttttactagaattggatagaactggaataaaaccatcctaatttgggtcagaaatccagcaaaactagattacttgggaagttaattttgcactacagaaactagcaactctacccatggatattaatgaatcttagaactgaaaggaatcttaaaaatttgcaacttttaccacccaacagatgcttcaggtctggttacactatttctaggaagtcgatattcatccactgtaagaacatttctgatgatggagaaagtagcctcaaggcagcactttccaattaataatacagtatataatatataaagagtataaaagttatatgattttgatatatggtcatgcaatagtgtggtttgcctaaggattatatatttcccaactttctgtagtgttccagtgtagctcttgaaaggagtttccctttacattgggattgattttttctctttataataaatgttttctttttcattaaaaaagtaaaagataactgtattagtttcctagggcttccataacaaaatatcacagactgggtggcttaaacagcagaaatttgttttcttgtacatctgaaggctgcaattctgagattaaggtgtcatcagggttggtttcttctgaggcctgtgtccttggcttgtggatgaccctcttctcgctgtcttcacatgatcttcccttttcctaatctccccttctaataaagacaccagccatattggatcaggttccaccctgattaccacattttaaattaattacttcttgaaagaccccatctccaaatacagtcaccttctgaggtacggggggttaggacttcaacatacgaatttggagggagacacaattcatcccataccaatgattattctagaaaatttggaaggtcagaaaatatgaaggaaaaaaatcaatcataatatcacatccccaaactaccatttttgtgtgtgtgtttccttctatttttccatccatagtttatgtagctgtactcatacaatatacaaatattttatcctatttttccatcttaaacatttttcaatttataacaatttataaacatttttaaatgtctaatttctgcatttagcacaatttatttcatcattcctctattattgtttatgtattttcctttgtaaatagtgctgtgatgacatctgctatatagagaggtttttctaaaattaatatttcttcgaggtagcctttaaaaatggaattacatgggtaaacatgccacaacatccttaaatatcttgatgtaccatgcaaattactttctaaagggttgacataggtaagatggcccattttaccatttatctgacaatactgtgtattctcattaagttctcattaagtaaaaagtcattttcagagcatggtggcttgtgcctgtagtcccagctaactggggaggctgagatgggaagaccacttgagcccaggaactagagtacaatctgggcaacagagtgtgatattgtcttaaaaaaatttttttttttaattcattacagacttgataggcacagaattgtatctcatttttatttttttaaaaggcgtttttatgagtgagaacaaacatgtcacaatctattcattaatctgttgcagttttttccataggtcctttgcctgctatgtatctcccaggatgtaagtgtggtatgtggaagtgggaaggagtgttaggagtgaagttgttaacacttcctctgtaaatttgagtaagcattgtatttatcaaatgtggtaacttttatctatttaatattttccctcagtactatttgatgtcaatgtggaaaatttactatttctcaacacacaaaattttaattcttagaagctgtttcctttatgactttttttaacttttattttaggttcaggggtacatgtgcaggtttgctacataggcaaattgtgtatcatggggtttggtgtacaaattattttgtcacccagataataagcatggtacctaattggtggttttttcatccttaccctccctccaccttccaccctcaaatgggccctggtgtccattgttcttttctttgtgtccataggtactcaatatttagcttccacttataagtgagaacatgtagtatttagttttctgtttctgcattcgtttgctcaggataatggcctccagctccttccatgtccctgcaaagaatatgatcttatttttttatggctgcatagtattctgtggcaaatatgtaccacattttctttatctagtctagcattaatgggcgcttaggttgattccatgtctttgctattgtgaatagtgcttccgtgaacatacgcatgcatatgtctttatggtaggatgatttatatttctttgggtatatacccaataatgggattgctgggtcaaatgttaatcctgttttatgttctttgagaaatggccagactgctttccacagtggctgaactaattaaccttcccaccatcagtgcataagtattcccttttcgctccaacctcaccagtttgttttttgactttttagcaatagtcattctgactgatatgagatagtacctcattgtggttttgatttgcatttctctaatgattagtgatgttgagtattttttcatatgcttgttggccataagtatgttttgttttgaaaaatgtctgttcatatcctttgcccagttttttatggcgttgtttgtgttttgcttattattttgtttaagttccttatagatgccggatattagacctttgttagatgcatagtttgcaaatattttctccacttctataggttgtctgtgtactctgttgatagtttctcttgctgtgcagaagccctttagttaaattaggccccttttgtcaatttttgtttttgttgccattgcttttggcatctttgtcattaagtctttaccaggtcctatgttcagaatggtattccctaagttatcttccagggtttttagagttttgggttttagatttaagtcacatcttaagttaacttttatgtatgatataaggaaggggtctagcttcaatcttctgcatatggctagccagttacctcagcaccatttattaagtagagcattctttccccatggcttgtcctttgttattttttctatcactcttaagcataaaagttactccatgctcagtatgatcaatatttacatcttcactgattgataaaatagtttgactttaaaaataaatcttgggccaggcacagtggctcacacctgtaatcccagctctctgggaggccgaggagggcagataacaaggtcaggagatcgagactatgctggccaacatggtgaaaccctgtctctactaaaatacaaaaacatattagctgggcgtggtggcacacacctgtagtctcagctactcgggtggctgaggcaggggactcactgaacctgggaggcagaggttgcagtgagcccagattgcgccactacactccagcctagcgacagagcaagattgcgtctaaaaaaaaataataaaaaaataaaaatcttaacaatgaatccagcttgaatttgtttgggaatgtggtgtgagatttctaacgtcaacattgggccatattacactgtaacccataacattttcattagtaaggcagagggtaaatattaaattgagctactgatggctttcagccgcccatctgttaccagtgtatcatttttcacatttaacctttttacaaaagagccacttaagaatccataagagctctctaggactgttgtgtttgttgacaagttgaaggtaacttattttgcatctgaacaaattaattaaaatattttataggagtcctagacagattgggaggtaggaaggtggaaacaatttctctatgtgtgtctgtctctgtctctctctctctgtcataattcaataatcttagcaaaaccatttaattgaataactacagcaaaaccagttgaacaactggatgccagtcactggtatctccacacctagtgtccactactataagatgacaagctttaacctgcctatcaagccctaccaggtgcaagaactgggctaggtgcaaatgggatgcagagatgcagacacaaattcaatcatccaggaactcacagtcataatctgtatgcttcatgatgttcatggttctcttcatccttaccatgctaatagtctaatttcttcaccattgctatgtgattatatgcagctattaaatactggtttaaattcttacagacaagtcagcagcattttctgttttataaatttgtctcttgtgaataagcgatacacaaaggacaattttgttaatctattagatttgaaattgtaacaaaataacctatttttgggtgggggtgttatgtgaacagcaaacaaaaatcaataagttgggaaaagtacctcaggtctagtccagctctgcatgtcatgtgctaggtgaccatggatccatcatttagtcactctgggctgcatttctcatgccttaagcaaaggcacacacaagatgatttataaggcttataatactagtgtttgatgaaaatcattctggaaaacttaaaatattatatatgctcttctgttcatatttatactagtcagggagtctgtaagttaaaggcataattcagacccattataatacttgcctatttcttaggttattaaatgcaaagcagctgtgctttgggagcagaagcaacccttctccattgaggaaatagaagttgccccaccaaagactaaagaagttcgcattaaggtaagcgtgagccctagagaacttaagccaaaagcgttatcaaacttatattgaatatagcactgttgtgaggctggattcttaaataaggagatgcttcccatgtttggagtattaattcctttactggctcttatatattgttaaggatctggttgtactcgatgtgaaattaatgagttcattatccttttaaaaaacaacagtgctaacatgctttattatacctttgatttgttgaatttttattcatatagtgtctaatttaaaatggttaataatcatagctaaagacttcttttaaaatcttctgggagtcagattgttttgaggttactttttgcaaagaatgaggaactcacttgtgcctggagaaatgacaacttcgtggaacgttttcctccctttctttggacagagcttaaccttggctttggacaccagttgttgagtaggcattgctaccaatctttctttgaccctcttactgttacctgagcacaacagtagcaggaagattttgctctttgcttaccttcttgcatgccatttcctctgttctttgttaagagagcccaataagggcctagctataaaaatctactttggggccatcacatagtaacatctgtattctggttccctcacaagagcaccaatttactacagacaggcaccaagattcaacctagggtataagggagcaatattataagttccgtcagagagggatcttgtctgatggttgatttttggctcagaatagtctaagagtaaatgttgttatattaggcaaagatattgattaaacaattataatttcttcaagaagttaaatattctcccaacagtgaaatgatcagtttgttgattggtgcaatgtttttgtctttgaacacagattttggccacaggaatctgtcgcacagatgaccatgtgataaaaggaacaatggtgtccaagtttccagtgattgtgggacatgaggcaactgggattgtagagagcattggagaaggagtgactacagtgaaaccaggtatatgcaggtgtcaaaccacaagtttgaaataattaggctttgattagcctatcaaaggaaatagcacacactaggaattattagagggatccttaacacaattcagggaattaaaaggatacaagaatggattttactgagtaatgtttaatttggcaaaacctcaacctttagaaggcaaaccttacggtgtttataaaccttagaatatatttttaaaagttttacctatagtatgggctcaattcacatttgttaatttcatattttaacattaatgaacagcatcttatatcatgatttttttcctgtaggtgacaaagtcatccctctctttctgccacaatgtagagaatgcaatgcttgtcgcaacccagatggcaacctttgcattaggagcgagtaggtttcagtcatttttactttaatgtatttacatttttcctatgctaatttttgaattgaattaattaatacgtgtatttgatgtatcaaacagtattactggtcgtggagtactggctgatggcaccaccagatttacatgcaagggcaaaccagtccaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtaagaaacagggtaggctagtttatttgttcttctttccttttcttaaatgatttgcttggaatcttgaagagttttggaaaaaaaaaaaacatttaaaagaatgtattgcatattcaggctgccaagcaacacaatgccaaatcaactaaaagaaaaataaaaaattcagattagaaattttatttcttctttttacacttgagaatatttattgactatatttgcaaactgcatcatttctccatctttaaaatataccccttccccatatgttaagtttgttaagataggacaatctcagtattttagttacagcagaggctttttgtcagagcttttactcctagtttcttgtcagctaagtaagatttattgtataactacaaaatacagtagtaagtacattaccaacttctcagaaaaaagtacaattttgtcagatcacctgttatagataatataaagagcaataaaatcattaatcattttgattaccacctataatgcgtatcagaaataaaatacagtagtgtttgttgcctattatcagtaatgctgttactgttcaccaaaactgatttctcagtatacatttttccatcaactgtgatgttagataggatccctggaattttaagttaatcacatgaaatttcacaagtaaattggagttcaaggaattaagaatctttgacctcttattattttgagatacgtcccatcaatacctagtttattgagagtttttagcatgaagcattgttgaattttgtcaaaggccttttctgcatctattgagataatcatgtggtttttgtctttggttctgtttatatgcagattacatttattgatttgcatatattgaaccagccttgcatcgcaggtatgaaagcccatttgatcatggtggataagctttttgatgtgctgttggattcggtttgccagtattttattgaggatttttgcatcaatgttcatcaaggatattggtctaaaattctcttttttggttgtgtctctacccagctttgatatcaggatgatgctggcctcataaaatgagttagggaggattccctctttttctattgattggaatagtttcagaaggaatggtaccagttcctccttgtacctcttgtagaattcggctgtgaatccatctggccccggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgcatctatttgattctcctctctttttttctttattagtcttgctagcggtctatcaattttgttgatcctttcaaaacaccagctccatgattcattaattttttgaagggttttttgtgtctctatttccttcagttctgctgtgattttagttatttcttgccttctgctagcttttgaatgtgtttgctcttgtttttctagctcttttaattgtgatgttagggtgtcaattttagatctttcctgctttctcttgtgggcatttagtgctgtaaatttctctctacacactgctttgaatgtgtcccagagattctcgaatgctgtgtatttgttttcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaatgtatattctgttgatttgggctggagagttctgtagatgtctattaggtccacttggtgtggagctgagttcaattcctggatatccttgttaactttctgtctcgttgatctgtctaatgttgacagtggggtgttaaagtctcccattattattgtgtgggagtctaagtctctttgtaggtcactcagggcttgctttatgaatctgggtgctcctgtattgggtgcatatatatttaggttagttagctcttcttgttgaattgatccctttaccactatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtctcctgaatacagcacactgatgggtctcgactgtttatcgaatttaccagtctgtgtcttttaattggagcatttagtccatttacatttaaagttaatattgttatgtgtgaatttgatcctgtcatgatgatgttagctggttattttgctcattagttgatgcagtttcttcctagtctcgatggtctttacattttggcatgattttgcagcagctggtaccggttgttcctttctatgtttagttcttccttcaggaactcttttagggcaggcctggtgctatctatgacaaatccacagccaatgtcatactgaatgggcaaaaactggaagcattccctttgaaaagtggcacaagacagggataccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggacacaaaatcaatgtacaaaaatcacaagcattcttacacaccaataacaaacagagagccaaatcatgagtgaactcccattcacaattgcttcaaagagaatgaaacacctaggaatccaacttacaagggatgtgaaggacctcttcaaggagaactacaaaccactgctcaaggaaataaaagaggatacaaagaaatggaagaacattccatgctcatgggtaggaagaatcaatatcatgaaaatggccatactgcccaaggtaatttatagattcaatgccatccccatcaagctaccaatgactttcttcacagaattggaaaaaactactttcaagttcatatggaaccaaaaaagagcatgcatcgccaagtcaatcctaagccaaaagaacaaagctggaggcatcacgctatgtgacttcaaactatactacaaggctacagtaacaaaaacagcatggtactggtaccaaaacagagatgtagatcaatggaacagatcagagccctcagaaataacgccacatatctacaactatctgatctttgacaaacctgagaaaaacaagaaatggggaagggattccctatttaataaatggtgctgggaaaactggctagccatatgtagaaagctgaaactggatcccttccctacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacagacaacctataaaatgggggaaaatttttgcaacctactcatctgacaaagggctaatatccagaatctacaatgaactcaaacaaatttacaagaaaaaaacaaacaaccccatcaaaaagtggacaaaggacaggaacagacacttctgaaaagaagacatttatgcagccaaaaaacatgtggaaaaatgctcaccatcactggccatcagagaaatgcaaatcaaaaccacaatgagataccatctcacaccagttagaatggcaatcattaaaaagtcaggaaacaacaagtgctggagaggatgtggagaaataggaacacttttacactgttggtgggactgtaaactagttcaaccattgtggaagtcagtgtggcgattcctcagggatctagagctagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaacaaacaccgcatgttctcactcatagataggaattgaacaatgagaacacatggacacaggaaggggaacatcacactctggagactgttgtggggtggggggaggggggagggatagcattaggagatatacctaatgctaaatgacaagttaatgggtgcagcacaccagcatggcacatgtatacatatgtaactaacctgcacattgtgcacatgtaccctaaaacttaaagtataataataataataaataaataaataaaatagatctattttattagaaaaaaaaataaaataggtctattttattagaaaaaaaaaagaatctttgacctaatacattattaaaagaaaaacctttatcaagaaatgcaattgaaaatgaagtttctagatttaatttttgtttcttccacatctccttctgattcaaatttctaaaatttatatttgtatctaaatttatttacaaatgactcagagttatgattttttatttcttctattaaaaaatgggatatatgtgcagagcgtgcaggtttgttacacaggtatacgtgcgccatggtggtttgctgcatctgttgactcgtcctccaggttccctcccctcaccccccacctcctaacaggccctgatgtgtgttgttcccctctctgtgtccatgtgttctcattgttcaactcccacttatgagtgagaacatgtggtgtttggttttctgttcttgtgttagtttgctgagaatgatggcttccagcttcttccacgtccctgcaaaggacatgatctcatttctttttatggctgcataatattccatggtgtatatgtactacattttctttatccagtatatcattgatggccatttgggttagttccaagtctttgctattgtaaatagtgctgcaataaacatacgtgtgcatgtgtctttgcagtggaatgatttatattcctttgggtgtatacccagtaatgggatggctgggtcaaatgatatttctggttctagatccttgaggaattgccatactgtcttccacaatggttgaactaatttatattctcaccaacagtgtaaaaagcgttcttatttctccatagcatcacgagcatcgattgtttcctgactttttaataatcgccattctgactggcatgagatggtatcacacggtggttttgatttgcatttctctaatgatcagtgatgttgagcttttttcatatgtttattggccacataaatgtcttcttttgagaagtgtctgttcatatcctgtgaccacttttggatggggttcttcattttttttcttgtatatttgtttaagttccttgtaaattctgcatattagacctttgtcagatgagtagatcacaaaaatctcctcccattctgtaggttgcctgttcactctgacgatagtttcttttgctgtgcagaagctctttagtttaattagatcccatttgtcaagtttggcttttgttgcaattgcttttggtgtttttgtcatgaagtctttgcctatgtctaagttctgaatggtattgcctaggttttcttctagggtttttatggtttggggttttacatttaagtgtttaatccatcttcagttaatttttgtgtaagatgtaaggaaggggtccagtctgagttttctgcatatggctagccagttttcctagcatcatttattaaatagggaatcctttccccattgtttgtttttgtcagatttgttgaagagcaaatgattgtagatgtgtggtgttatttctgaggcctctgttctgttccattggtctatatatctgttttggtaccagtaccatgctgtttttgttactgtagccttgtagtatagtttgaaggctggtagcatgatgcctccagctttgtttttttggcttaggattgtcttggctatatgggctcttttttggttctagatgaaatttaaagtagtttttttctaattctgtgtagaaagtaaatggtagcttgatagggataacattgaatctataaattactttgggcagtatggccattttcacgatattgattcttcctatgcatgagcatggaatttttccatttgtttgtgtcctctcttatttccttgagcagtggtttgtaattctccttgaagaggtccttcacatcccttgtaagttgtattcctagatattttattctctttgtagcaattgtgaatgggagttcactcatgatttgtgtttttaactggaggcccttttcaggtttcactttttgaccctaacacctaacatgttcaagaacattcctctccacaggtcaaacctggttccacttgcgtcgtctttggcctgggaggagttggcctgtcagtcatcatgggctgtaagtcagctggtgcatctaggatcattgggattgacctcaacaaagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatggtaagacccaaaatttgagaagccacaaaatacccaagttattagacatgcacaaggtaaatttaattgtctataactttattaatagtcaataatggaaatatctctgcgatagtcagttttactcaggcaaaaactgataatcacatagcaattttgcctaaaaagtcaaacacttaagagcaggttcactggaccaaagttaaataccatatcataccactctcagctgactagatggcaaggtagtcaacccttctagataattgttttaagtaggatcttccttgtatatgtagatttcttggcgaaagcaattctgtctcttgaatgtcagcaaagtaagcatcagaaggtgactgaggagaggtgaaaagggattattccaaatgttgtggtctattcccccaaatctgtgatccatcgaccttctcactctttacatctgagctttgtttgccctcatctgaattcccttagaatatgaaccttcaattttctaaccatgccacctgtatggcagcccgcagcaccagaccttcagttagacctgtaaaacagatctgagattcctggaactagaaagctccaacctggcatagcgtaaagagacttggaaaaatggaataaagccacttttgctcaagattgagtggcagattaactcaccttaatgcttttggtaatttaagaataaatagtccttaatttatcattgctgtcatatttctttcctagtgaatcacttagatttatttcatatcaacaaatagcattctaggtcataagtttttgaagccatatgtgatactggatatatcattagagcctactgatttccagttgctacttgatgaaggctggtctctaaaaacaatgccatctgttgctccaatctagcaagtattaaattattgcttaataactggatgggttaatgaccagaaaatgtgaggttagtctcagaaatgctcccaagaaaagggactcttttgtcccacattttagtattttatttaattttaagactaaacttaaaaaaaaaactacgctaaatgatttggtatacttaattcaatttagtttggttcaaatggctttctaaggcttatctgaagtggtgatattggtatgaaaatatcacaagaatttcccttgtattttagtgcatggtacactaaaaatgccacaaacactgaccacattgattgctgtttctgccttaaagggcaaatgtgtatagaaatttaattaaggactaaagttgcactgaaatttttttaaagcaagtaaaaaacaaggtggcttaatttaatttcatgactttgtcatagtacataggtcatttcagagcttatgtcacactgtaagagacacaggaagcaaacgatctcctccgttttaaactcagattgatgccctggcatcctgccacatgaactatgggaccagcgtggttgtaggagttcctccatcagccaagatgctcacctatgacccgatgttgctcttcactggacgcacatggaagggatgtgtctttggaggtcaggaaagcaaagcctctggatggggagtgatggctttcactctggtgcttggcaagtgggagaagcctgtttcctcaggcctttcttccaagaatgagtatgaagtgatctaaaatggaactgtgatcataataacacaaaagataattctccactcctcaccttgatgtaggactaatattggtggacgcatttttaatattaacatctgcaactcaagttccccaaaggcctgaatgagagacaccagtagtgtttctatagggatgaattatgtaacaggaagttccgatttaatccattattattaatatacacaagaatgtgtattaaagtgaatttattcgattcataatagcaccaacaaaaatcctggacccaaagccaaaaccaacaacaacaacaaaagggattgtcacattttatgggaacagttcagattcacactggaaggacttagattatcactcaacaattaatattgttttaggagagatggagccagggccactctgctcaaggtaggtgacacagtgagtccttttttttccctccttcacaaagtctcgttttctagtgccttcatacagagttgtactgggtgctttgaaggtactcccaatattagagtctgctttatacaatataagagaatagtaactattcaagtacttgttaagagtataaaaaggagaaaatgattgttcttcacttagagaagtacataatgtagcgaaggatacaaaaacaaatataaaagaaagaatataaaaataagtgcagctataaatattataaaacaaattataagaggagttttttagcatttattctatgttaaaagttttacattaatgtgtttgaagtttattttatttctcagtaactctctgaggaagctacttaatgaataataaaactgagacttggaactattaagttttttgcccctatagctctcaagttgagaactgagatttaaagctggtccatgggagaacaaagtttttcctctttctgcaacattacttggggcataaaaaagcaagaggctagttggtatggatgaggttttatagagaaggctttttagggaaaatgaaacttgaagaacaaaacaataagagatataagaagttgaacctccttgctttgactatttgtgggaagtgggaagattatagattattcaggaatattagaggtaaaattcagttattcagcaaatatttgttgagtgtatactgagtacaggtaccattgtgtacatagtgtaccattccaggagctaggaacggagaagagacaaaacataccaagtccctgatctcaggaagtgtgagaatcctctcactttggtatagagagactgacaataaataaatgaatgcagaatataccataaggttacaagtgcaaaggataataataaaggatgggtaacgggcagtgccagaggactggggtggaggtggaggtgaatgctattttataaagttcaaggaaggcctccttgataaggtaacattggagcaaaaacataaataagatattcagaaatcttgggaaagaatattccaggaaggagacgtagtaaatacaacagggtgttggcaagaaccataagaacggggaaaaggtcagtatggctacaacagagtgaggacagaagaacagtcacagctggggtcagaggaccttaaattatatggggcctttgggccattgcaaggttttaggagtttattctgagagagaaataaaaccacagaggcttctgagggaggtgtcacctgatctgacttccattttaacactctccttctggctgctctatggggaatactctaaatggggcaaagggcacaagcagggagaccatggaagaagtcattataatgctggaaggaaaggatgctggcttggagtgatggggctggtgagaagtagtcagctcttggatacattttgaagatagagtcaacaaaatttgccgaaatagttattgtatggcaaaaagagtagcatccaagatttttgggcctaagcaacaggaatcatgtcaccatcatcatttattgagaaggaagactatagaaggaatagattgggggctagggtggaagtggtagaaaccaggagtggtttggggcaggttacacttgtgcaggtacctgtgagatacctgaataaagatgtctataaaatgtaggcaattggctatgagtctgtagtacaggtagaggtttaggatgggtatagaaacctaagtattttaagaggagtatatcgaaagccacaagaccagaggaggtcaccctagaagtaaatgtagataaagaacagaaatggaccaaggaccaagccctaggaatcgttggagttagaggtctgggagatgtagaggacccagcaaagatctgtggaagaagtaactagtgagcaaggaaagtgacaatgatgatgacgatgtagtatctagaagctaagggaacagagtgtttcagaaaaggggagccaccaacagtatcagttatacctaacagttcatataagaggaggactgagaaatgacccctgtctgggtcaaaatggagctcaaagatgaccttgatgatatccattacaggacagtgctgggggcaagagcgtaatcagagtgggctcagagagggtgagaggaaaggaacaggatccagaaacagtgaactgaagacaattctttctgtaaagtaaagaagtttctctgcaatagaagcaaagatatggggtgactggaaggagatgtgggtatcagaagagtttttttaacctttgtttctttttaatttaatttaatttttattttactttaagttctgggatacatgtgcagaacgtgcaggttcgttacgttggaatacaagtgccatggtggtttgctgcacccatcaacccatcatctaggttttaagccccgcatgcattaggtatttgtcttaatgctctccctccccttgcctgccacccaccgacaggccctggtatgtgtcattcccctccctgtgtccatgtgttctcattgttcaactcccacttacgagtgagaacgtgcggtgtttggttttttgttcctgtgttagtttgctgagaatgatggtttccagcttcatccatgtccctgcaaaggacatgaactcattcttttttatggctgcataacttttgtttcttatgctgggacaaatacagcttatttgtacactgctgggaatgatctaacacagggaaagtcatagtgcaggaaagagaaggaataaatataacataataaaagataaggattatttagtaatgtctaaagagaaaatgtgtgcttatttgcaggtttgaaaagcagagatgatgtcccaaaactagtgactgagttcctggcaaagaaatttgacctggaccagttgataactcatgttttaccatttaaaaaaatcagtgaaggatttgagctgctcaattcaggacaaaggtaactgtttcttatgatgatcttgtctcttctccacaggctacttttaaaatttagtacttataaatgtgcctgttttcttcatattttatttctaattatttaatctagccagattgatacagctaattacttctctttacccactgcattagtgtattttcatactactataaaaaaaaaaaactgcccgagactgggtcatttataaagcaaacagattcaattgactcacagttcagcatggctgggggcttcaggaaacttataatcatggtggaaggcaaagaggaagcaaggcaccttcttcacaggctgcaggaaggagaagtgtcgagcaaagcgggaagagccccttacaaaaccatcagatcttgtgaaaactcactcactatcatgagaacagcatgagggaaactgccccatgattcaattacctccacctggtctctcccttgacatgtagggattatagggattataattcaagatgagatttgggtggggacacaaagtctaaccatatcaccaacttagtatgccattgtactatattaatcaattttttaaaatcttttggattttgtttacctagttgatttcattgtggctatttttatttcatcataaagctgctatttatttcaagtaggccacaaaatttccttattttacagttttcaaagtgctttctcaaatgtgcattattcagatccctgtaagccaggtattatttttaccatttttagatgaagaccaaggttgtgaaagcaaataaataactggtcaaacctcctggggtagtgccaggatataaactaattgcaaaacttgtgctcttttgaccatataacaaacttctctgacagagcttggcaagctttgggtaaacatgggtgtgatgattactactcttgttgcttctgagggttgggcaaggatagaggtcaagtatgaattcatgcaaattttatctacaacatctacctcatggaggtctcaaacagcaatcaaaaagcctgtctacaagatgaaatgactttcactcattgggcctataaataattattgagcttccactatgtgccaaggacgtggatttcattagtaaaaggaactgtatattgagatccaaatttttactaatttttttttttacctgagagatttttcaatgttgtgtcttgtctccacatttggtctagcctacaggatcatcatattatgaacatacatttttttaagcaagtaaacaatgggattttgtaagaaaaactgtcagaaccactcagtactactttactcagataagcaaaactaacagcttagtatggcctgcttggaaaataattactatttgttttccaaagaaacataaattctgctttcaggaattttgcttcaaatatcaccttaaagcagggacatccaaactaacatttgtaaacctaaactcttcaatttccacctacttcctgcacagctctatttgaatgtcccacttggaaatattttttcgccagtaatttttatctcagtcattatattatgcgttcctcttttatagatgagaagccatagcatcatgtctgacttctttttcactcttgcctaccacatacaaaccaattctaagccttgatgatgcaacccttgatttctccttcagaatccctcatctcattgcccacgctcattgctttaattcagtctaatcatttctgacatggacatggtagtgagataataggttttccaccttctgtattaaaatacattccagttagtctttcactaagctgccaagctcaagttttgccaaaatgccaatgtcttagcatggttttgaaagcctttattattgaactaaaacctattttgtttcaacagttaagaatttggcattcattctatcaccctctgcagcaggcttttgggataaagtgagggaagtaggtctcatctacttgcaggatctcttgggcacccagaaatctaaacatattggattacctttcctgttcacatgttcctaggcttgttcatgctttctcctcaacctggaaaccacttccctcttgttggcatactgaaattatactgatgctttcagaattagctcagatacccttatcagagttgcgtaacaaagaaaactaattgttaaggactttgagcccagaggatttccaataacagaatttacttgaagtttctatgacagatagaaaggacaattgtttaaactatcctttcttgaaagatatgaaaacaagtcattaaaaactctcattttacatttcagcattcgaacggtcctgacgttttgagatccaaagtggcaggaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctataattgtatcttttaagaaaacatacacttggatttctatgttgaaatggagatttttaagagttttaaccagctgctgcagatatataactcaaaacagatatagcgtataaagatatagtaaatgcatctcctagagtaatattcacttaacacattgaaactattattttttagatttgaatataaatgtattttttaaacacttgttatgagttaacttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagaatcatattatcatacttatcataatgttcaatttgatacagtagaattgcaagtccctaagtccctattcactgtgcttagtagtgactccatttaataaaaagtgtttttagtttttaacaactacactgatgtatctatatatatctataacatgttaaaaattcttaagaaaattaaaaattatataaaatgttttgtggtgatatatttttaaacaggcatatgttgttattaagcttttatttgttataaacaaagtgttgaagcgcctgaaaacataaaaatactttataagacatataagaagttgggtggtcatagcagaaattgaggcttccaatgttagggcataatatagattggacacttctaccatggtaaattgcaaaatgtccaggtatttatgaaccacttttacatgatgaatatttcccagtgaaaagtggcatgaactcgaggagtaaaatttcctttttcttttaccagtttgtcaatctaggcttaatctaggtttaaaaaaaatagctgaaaagtgtaaataattattttgaagtatcttcatcatcagctgagtttagctatggcaattctcaaaacactatgaatatttacagcttataagaattatatttttatgtatacatatatatatctatatttatgtcaataaatagatacatagatagatgatagatagatagatagatagatagatagatagatagatagatgatagatatagataagtatagaaaatctctatccaagaatcatttggagacatttcctctgtccattagcaatatctgtagctaggatctcagaatccattaaggaaggaaaactgccccccaaaaaagcatttttaacaagaaaaatatgtagaatggattaattcctttatgtctcctgcctcaaattttgaaaaacatgtaaataaggatactaaaagtaatatgcaaatataggtacatcaaaagaaataaatccaagaaggaataaacacatttatattctcagatcacagctttttaaatgaaatccactttatgcttagataaaattatattttgacaaatatgctgcatatgtgacaattttatttatttaatatttattatgatactttgtggaatcattcctcatgtctgagcttgtcatggccaaataatgaacagaaagaccttctactatctttctcagggtaacctgcacatgaatagcattttgagtcatcagaaaacactggttctaagaagagatcaggaaatctgattatttttgcatatttcttatttctggtcaatgaaaccacaaagcattgtcaaactgagttcttgaatataaatcaaaatataagtaagcaataaatagctagaggaatgctaaaagaaatatccagcttcttctttaaagaatagtctagacttctaatcatttaactgatatgtggagaacattcattgggcaattttttttttaatttcaaccagtattaagcactgagctaggtgtttggtatacagtaatgaataaaacagaataatgaatgtcctttggagcatatggtctagtagtgatggcagctcctctctgctaggaactgaacactcttcgggacaccctggctgcagaaaggagtgacccactgcaggtctcctctgagctgttctatcactcaataaagctcttcttcaccttgctcactcttcagttgtctgcatacctcattcttccagttcgcaggacaagaacttggggcccaccaaatagccgggctaaaagagctgtaacaccaacagggctgaaacacgccccttgctcaccatgttgtgggtgacaaggagagaaaagagatggagagaagagctgcgaccctttggggagcccagacctaggagctccctaagccaggctgtaacaccctctttggaactctatggttcctgatgtctccaagcttccaggcaccactgcattcttggtgtcagctgtggaagctgcttatggtatgcctggtccagccacagacttgcaggaagcgggtgctcatgccagcacctggagctgcccaccctgctgcagccagcatgcctggctgtgtgcagtggccagaccccatacttcc

SEQ ID NO: 11849 - DNA, 22927 bp, Human
ccctcgggatcctgaaacacccctcccacctgccagtacccgccaagatgggtccctgatttgctgtgtggccttagaccagtggctgccctctctgggcctcactcccagctgagacctacaggctcagcccctgcccagccctgcctggcacccgctcaatctggctgagctccagagaatggcagggctgggctgtcacatgctgagccacgtgactggcagtggctgggggctccatcccacacagaggacaggggctctgcagtccttcacccccaccctaactatctaatcacgggccaccggtgtgggcatggtccagaagacctcaccgccctcccaggtaggcagggagctggcgggtggggggggccatgatgagcacctcccaggtgccacgttggcccagaggccccggggccgggagctacggaggcccagggcaccagggagatggtagcagcggcaggcccaggaaggggcatagaggaggctcttcctccacacctgtcaccctgtcccctgcctgtccacacccacagcagcttgcacatcatccccacagcacgctggctctgacaggtgtatccggggcgggctgggggcaggcagggacaggcttaggcacagctgcctgtgccgaacttgaggaagatcgggactacaggaaccaccaaggcgacacgtggcatcatgaccacggtcctaagcagagaggcaggcactcctcctgggaggcagaggggacatccgaaacgggtgcagccccagctctggagcaagaagctctgccacacacacgccccatgttcacatcccaccccctctctgcccccacttcctcgtttgtaaaatgttagatctgcagaaagacaggctctatgaatggggcggcccatggggtggtgtggaggaacacggaagcacagggcgctgggagaggagcaggcatgaggtatggtccctaagatggtatttctagactccagccacctttgggtctgacctctttgttttgcagaaggggaaactgagtcttgggtagggtgtagcaagacaagccacagacaaaacacctcagacactggattaaagaaggaagaggtttattcagctgggagcatcagcagacttgcgtcaagagccgagctccctgaaaaagacattcttggcctttttaaaggcttacaactttaaggggtccacgtgaaagggtcgtgataaatcgagcaagctcggggaacgtgaccgggggctgcatgcgtcagctaacagaacagaaagttttgcagtgctttctcatacaatgtctggaatttacagataacacaagtagtttaggtcaggggttgatattattatcacttttttttaactaccagggccaggtggtggcgccaaggtcttctggctatttctcttacttctgtttttttctaactttttgccttctctctttcctcctgtcttgtaaaccaggcaaggtggtaggaggagggcagcaggagtagtagtggtcttattccttaggggaggcattgagggaaggctgggagtggggggtcgagacttccttgctattctgggccataacattccacataatattataatagaatataattaatacaataatagttccccaccccacaccgggattcccagggcccactgccccactcctcctcctcaggctggccctcagctcagtgctcagccctgctgcacagcctctcctcctcctcctcaggctgcccctcagctcggagctcagccctgctgtgtggctctagcctggcgccctctgggcgttgacttcttctctgtggtctgggaggagatgtcgaggcccccgagggaggcggtggtgaaatcttggcttgcagcctccagcccgcccagagccagagtcaggcacgaggctagggcaactccgccccacccctcccccggggactggccctgcgttggacatttcttaacagcagggccaccaggcagagcgggacagccaggaggaagggcagcttggcagagcctcaggtagagtatcccggggaggctggggctgtagtgggccagcagtcgggccagagtccagctcagcaactccgggttacaggcagcccaggcgggcctagccaccggcagctgcactcagaggccactgtgtcctggctgagctcatctgcctgcctgctgggggagaaagcggaaggaggagaggcagatctggggagtggcagcgaggtcccgggcacccccctggccagcaggcacccttccgttgtccgagctgggttgccaccgcctccttttcctgggattcccggacaccctccaagggaaccaagggaacagctctgggtccagctgccccaggaaggactgtgcgccccttccccacaggggtcaagtatcccttccagcaacagccgtttcctgggcaccagcctgcatgcccagtgctgatgcagggatgtggccatgaatgactctgggaaagaatcattcttagcaatggactttgtcagggtccaagaaaggagtggccagccagccccgccccgcctgcaggaggcacttctcatcccgggaactgtgccccatcagggagccgaggctgttcagcctctttgtgacccggggctgggttggcccgagccacaaatgaggggatacgctggtccctggctccccaagggaggggctgctgagctttgggaggcctcatgaaaatccagcttaaggccatcaaaagacaaaatgacaacacatttagttatagatcaaattggcttctattcatgattcgtgaatccggacagcctccattctacaaaatggagtgagagctcccaccaggcagtggcagagcagggggttcataaggcagaaaggaggaaacagaaaaataggaaacaccaaaccgcctaataccggatcgctgcagactgcttttttctaagcggactgcttttttctaaggggtaaggcagaggggacctgatgatgccggctcaggtggactggaatctcctgcttcccggagaaactggtctgtggttttgggctctgtctgcttccttaaagcttcggtttgatgatgtggcatttggcatgagtgcctccattttggtttggtctggtctgttggggcctagtacaggagctcagttcaaaatcacagcctctcatcatgtttgtttaatgaagctacactgcaggagatcagaatcggagaccctgcggtattgggcctgtgggtcccctgaagttggcctagtgatccccgccttctggctgccctgatgggggtcccccaggccctctacccaccatgttcagtccctctgtcaccacatccctgtcctcagttgggtctcagggtgatgtccttgtctccccaacacccaccttggatcaaggccccttcaggcccctgccccaggggtctcctccctgagccctcctctggtacatccgtcctccatggatactgagcacttcccggggtcccagtgcttgaattctcccgacagtggtatgggtgccacaggcagtgcccaattttacagatgggaaacgtgaatacaaagaggtcaagcaacctgcccaaggtctccccactcacacatgtggttgctgcagtttaaacccaggtcattgggcccccagaccatgccatgctgggaggatgctcttagaaggcccatggtgtagatgaggaaactgaggcaggaagaatgagagaacgggcagagcctccgtttccctggaatccaacccacttgataggccagggtgtgaacgagcagggagtccctgcccagggacggtccctgctgtgaggttgggggcagcggctcggccagccattcactccctgtgatatgtcagccccgttcctccccactctgttcccggagcctgtgggcacccacagcgagcacccaggctggcatagtgcccagcacatgggcacctgagtattgtttttagaggcccgtggccttgagaggaagtggctggtcctgccctggcccccaggccagaggaaacagccgctatcttcatcaccaaatgatgtggcaactcccccccaccccagaagctgcaggtctgggccaaatgcacctcaacctgtgatggggggccacgccccagagacccttgggcccatcagcccctggacctcagtggctcagccgcaggaggcaagaggcagtctcagaccccacaacctaagcagtgtggggagtggcagcaatagtgaggagggaggccgaggaaatggaatccaaacagcaagagacctcccctcaccggtcacccctcccacagctggcctaccggagtccacccagccttgggtctgccgtccaggccccagcccagtgtcccttcccccaaggacttggctgcccatccccaggggactgtgagggaggtgggagctgaggtggatagccttctgctcttctggatttgggttttccaatgtgaggagctgggtggtatcaggcaagctctggccctctctgagcctcagcctccatctccttcagtggggtgaatagtggtccctcagtgggcggccgtggtggtgaaatgagcgagggcaggcatggggatcacactccttacaacctcacactgtgggatgagtgccgcgggggtgggcttgggggaccccagcccagtgcctgattcaggagttccctattctgtgtgtccacaatggctgcccagcaccctcgggagataacaggcccaggatccccccaatctcaggcagaaggcggccttggcttctccgcttgccagggtcctgccctgggcactccctgggggcctcagtccagagtgagtgacccgtaggggcaatgccagggctggttgccctgtgggagagatgtgtcctgtggccctggtgagttggtttcagcgttgctaggagggttgctggaatgttccctgcagaactccatcccccacagagctcccggcccacagtccaccattcacgttacgtgccttgcatttttgtggtttctgcagagattcttacaaagggtgagagaggcacaggcgtggtttgcctttgaccactggcagaagtctgaaggtgagagtagaatggagaaggacccaggagagtgcggagttgagggagataaatatttgcaggctacttagcaaaacacccagagctgacctttgtcgagtactttctgtgggcacaacagcaaatgttttatgcagcgtgatgtcatttaatcctcacaatgacaccaggtgccattagcatccccatttcacagatgaggaaaccgaggcagagaaggtgagtgatttgcccaaggtcccacaaccagtaagaggcagagcccggagacaggcctgatggtggctcgagaggctcgttcttggctcctgggtctcagtcctgctcccgtgacgagccatcccctatggggaccatggtgcctgtcctgtgtgcgggccactgcccagcttctcccaatcagagcaggaagatggtgggttcagcctggccccacaatcactccagctgagggctggcctggggctcctgaccaggctctcagtagcacactggtccagcagggccatcctgcagaccggagcaggtcccgccctcaaggtggccacttaacaatcacccacagccttgcgctcaccgatgctgggccctgggctcagaaccgactgtgtggtctcatcattagctggcaggtgccatcattacaccggtaacatgagaggcttcaagcactaggtctcaaataagtaggcacagaggggcctgcctcccagtctaatgagggggaaataagggagatgtggacagggttgggaggtgggtagagtgtaaccagacatttatcacatggcacaactcagaacgctggggagcagagtcaaggggccactgtgacagtggatgagggcataatctgggtgggctgcctggaggaagcatcagccaagctgagatctggaggaaagggactcggagagggaaggaggaaagggtcaccacgggtccttggcaccaggccgaggaacgagtgcgtcagagtgctcctccgatgaacttcaagtaaacaggcagggctcgggggaatgtctaggcccctaccctgcctgccagctctggctggcaccagcacggaggcaggaacgccctctcccccgccctgatcctctcccccacagctgtttctgcctcccagcaccacagccccggcagggtgggcagcagggcctccaggaggcccgaggtgttctccccctcttcctgaggaagctgaggcacagggagaagaggctattgcccactggcctggcctccctgggcagtgcccccaggctggggacagaggaagacggagaattctgtgtctggagtgctccaaggtggtggccatggtggcagtgagtcaccccctctactcatcaagctcctgcttacaccattcagactggcaggggtgaggctgccccgcctccaggaggggcatcagggcagggcagaggccatggcttggggttaatttctgtgcggcaggaagaagcatggcgctctgcctgcctgctcaccctcgggggctgtggtggagcagctgtccccaagcccacacccagtcctgcagccgcctccaggtccatggcagaggggagtggtgcgagggtcttcatgtgtgtctgggagtgctcactgttgggtgaaaggggttgcaggcagcctcagtccctgtggggtcatctgagtgggtccctgtgtgtgtataaggtagaggtgtctgcaagcccctgtgggtgcaggcaggtcaggggtgcccagaccctggggcggctgggtggtgcccatgaaggaggggcagccctggccacccagttcatgccaccccatctggcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggtgggctggggttgggggtatgagagggtgcactggggcaggggggcatggagggcagctgggacagcaggggatgaagacacctgcgccctccatgaagcggggctaaaagcagctcctcccctaggccagagccacccttgcacattcatccagtcacttatttctgtattcatgcagcaactatttgctgagcacctactatgtgccaggtactgttctaggctctggggatatagcagagaataaaacacagttcccatgcctacgaagatgaccttctatcggagacaataaaacagcaaataaataattgcacagcaaggccgggcatggtggctcacacctgtagtcccagcactttgggaggccgaggtgggcggatcgcttgaggccaggagttcaagaccatcctggccaacatggcgaaaccccgtctctactaacaatacaaaaattagctggatgtggtggtgggcacctgtaatcccagctactcaggaggctgaggcatgagaatcgcttgaacctgggaggtggaggttgcagtgagccaaggtcacaccactgcactccagcttgggcaacacagtgagactccatctcaaaaataataataaagataataattacacagcatattgggttgaaatatgtgccctggagacacacccagggtgaaggggagagagggggccaggatcagggtgctgttgtatatgtgggggtcagggaaggtttctctgagaagggggctttagagcagagacgtgaagatggaggggaggctccccatggatgctggggagatggcagcgggcacagcacgtgcaaaggccctgaggcaggaggtgctgggtgtttctgcttgaggagcagcaaggaggccagcatagctgtcgggggtgggagaggaagaaacagcaaagatgaggtctggggtatgggccacactatgtagggcctcggaggccgtgaggccttggccttctctctgggtacagcaggcatcatggcctctgtctagaccctgaaggcttggggcctcagcccctcccaatcccagtggcagccaaggcagaaccccaagaaacacacttcccccaacccctcacccatcagggcccatgcacctgcctgcccctgcctcaggacacctgcccctgcctcaggacaccacctgcccctgcctcagcacatctgccccaggggctgcccccggctcctattctctggacaaaatatctcctccctttgccttgaaggctgtagtgttcagaccttcccccagcccattgggctccctggggactgactcccccgccaccactgagcttctgccaccggccgcctgccggccttcatgagacttgacctgacgtctgtctggtcccttttctcccttcggctctgattccacctcctgccttcccatcccagctgcaggagcggggccctacaaaggcagcagtagcccagaacattcaacctggtccctccctctggacctggtcacccccctgtccccaccctcagcaggcagcatctgcccagcgtcacgtgcaccctctcagttaaccctttggtgaatctggttgggcaaccacacccagtggcccccagaagaggctcagagagagtgtgttcttgcccaagggcatgcagccaggaagagcagagccagagtttgaacctggctcaaaatagcccagtctcccaaagtcaggtcccaggtgacctaggaggtgtggcgggcaggccaccaggctcatggggccagagcacaggctgtgggaaagtccgtgtggaaggcaccttcccccagcctcagtggctaggaggtgccagtgggcgtggcgtcttcctccctcttggggctcagctgtagccctggccttgcccctggttcgctgagtgacctcaggcagggcatctccttctctgggcttcgctggtcctctggcccatccagcaccccactggcccgtccccctctgccctgacccgggagagcctgcaccccataacctcaggcgctgcctcagccagggagccagcctggccccagtgtccctgacctgttctccagcggcctgcagcctgctgcctggctggtctctcctcccttggggcgcagagggcagggagcactggctagccgagagcaggacaatgtccctattgattcgggtctcctcactcctgcttagaagcctgacagtggccctggcccctgggctgtgggaactgacagcatttacctaggggtggctgtgcctgtgtctcctgtggaccaatctccaccctgctctttgggagactgaggtgggaggattgtttgaggccaggagttcaagacctacctaggcaacacagcaaggcactctgcaaaaaatcaaaacaaactttttttgaaattaaaaaaaaacaaaaccctaagtcagatcccatccctgctcttctcaggagtccttgcctggctgcctggccccctcaccttgcccactctgcttcttgctaaacaggagcagagcaagctcacagccacctcggggcctttgcagccgccagggcctctgcccaaagtatgccgcctcccagtacccacgacttgcttgttccttgccttcaggtcactgctccaatgtgaccgccgcctggagacctgcactgaccgctttgtaaaaacagcacacacacacatgctcatgtggatgtatacatgtgcacacctgtgcacgcccacagccacacgctccagcagtctccacccccaccctgctccatgatttccctagcacagccacgtcctaatggagccgtcagcgttctcactttcacatggaacgactgccccctgcaaggtcggcctcagggccggtccctctgtttggcacagagacagcacctcacacaggaagcacgcactgaacatggagtgagtgagtgaacgaatgaatgaaaatgaatgaatgagttgtggaagcaggccctgcctggaggaggctgtgccctcctgccaactctgggaatcctggcccaccctgaccccacccacttcctgcagtcagccttcgagtcggaggtgtctgaggttgccatcagccagggcgaggtcaccctggccctcaggaacctccgggcctggatgaaggacgagcgtgtgcccaagaacctggtgagccggccgggctgaggcgggcagggggctcaggggatatttgctcccacagggtggcccctctgggtgggagctggctgctgaggggccggggtgctgagcacttaatttcatccccggctcccggcccaggccacgcagctggactccgccttcatccggaaggagccctttggcctggtcctcatcattgcgccctggaactatccgctgaacctgacgctggtgcccctcgtgggagccctcgctgcaggtgagagctgggcctgccccttccggtcacccttctccgctcgaggcctcagggccacccatggatcccaggaggacatgggagaactggcccaggtggcaaagaggactgtctggtccaccgtccccgggctgtgtggccctgggcccgtcatgttacctctctgaaccaggttctgcatctgaaagtgggtgaggctgatgcctgccctgcaggtgtgtggagaccaggagctggctacgcctcctccagctctctccctgcactgccctgcagggaactgtgtggtgctgaagccatcggagattagcaagaacgtcgagaagatcctggccgaggtgctgccccaatacgtggaccaggtgagcagggctgccgggcaggtagagcgggaacaggcagggctcaagggctgggcagcccctggcatggaagggcctgtcagtcagacccgagtccccacctcaatcctgcctcttctgagttgtgtaaacttgaccaagtcaccgcccctgtcagcctcagtttccctctgaggagcagcgagggcagcctgttgcccaggggttccgtgtctgcctccacctggccctggcatcagcccctccagcgccagctggactccaagctgggcctgccaatgccagccaaccttggggagctcccttctccccactttgcctccacccaaccctcctagagccctggctgggtcaggccaggcggggtggaggcagggcagggtccaggcagggcgggctgctcccttgtgttctcggagctggggtcccagaaggagcctcacccatcccgccttgcagagctgctttgctgtggtgctgggcgggccccaggagacggggcagctgctagagcacaggttcgactacatcttcttcacaggtgaggccgggacgagggtcgggacaggctggggtcggggaggacagctgctcaggggtcctgtccctaactctgggagtccacagggagactgaattctcctctctctctctctctggaccaggctgggagcagtcctggacccccaggaccccttaggaagggatggagtcccatgtccagggccagcccactgtgccaaccacagcgtcaggaaccatagcctctgcccccactgtccccagaccctcatacgtgaccctgctgccccccaggctcttagacaccaccctactggtgcccacagccctctctgcaggcagatgagggactgggcctcagtgtcctgcccagggtcaccctgctggccaggatggggacaggctggaatgtgcacacaagcccttggagaaatccacgccagaggtcactttttttttctttttttttgagacagagtcttgctctgtcacccaggcagtggcacaatcttggcacaatcttggctcactgcaacctctgcgcctcctgggttcaagtgatgctcatgcctcagcttcccaagtagctggggtgacaggcatgtaccaccacgcccggctaattttttgtatttttagtaaagacagggtctcactctgttgctcaggctggtctcgaactcttggcctcaaccagtcctcctgccttggtctcctaaagtgcagggatcacaggcatgagccaccacacccggcttcgagtttttgagctagggaggggcagagggagcgagaggaagacagtggtgctggcaggcgagtctgcgccttacaggtcgaggcagtcgtggggaagggcctggcaggattgacctggccgcctcccagcaaaggcaaaggagccctggaaggaaccacagagcccaggaagcactgtgccaggatggggcaggggtgagagtagagaaggcacagtggctcctgccggctttaatccttgaccacaagggggagaaatgccagggccatccccacagacgcagcagcgtggtccccgagtcaggtctggagaggaggccttgaggcccagacagggctagggcagagaaggctgtgtgcatgcggagactgctgggcccctggaggccagcacagaggagaggtgaggccaagccaggcaggacatggggacgcctgcatcagcctgggacagtccacctcaagggtcagaaaaaaagggctgggcaggtggcagaacttccaggtttaggtttagagaagagagacctgaatgccgtagacagagctggactccatccttgggtgataagggatccccgaagtttccaaaggagatgggtggggaggggttccatgcagcattttgcaaagagtcccctgcagggtcagccagggtcacaagcagaggcgggaggagccaaggggtttggctcagcagggggaccctgggggccgatagcagccgtgcaccattccctcctgagactctgtgcttaggggctggtcctgatgaaggatgagcagggccctgggctgcagggtggcagtgaggaacaaggaaaggccaggcgagggctgctgcccgctgactccaccacctctccagggaggagcggggccgtgggctgggccatcccgcctggtccaggtcactgaacggccactctggtttccttccatgcccagggagccctcgtgtgggcaagattgttatgactgctgccgccaagcacctgacacctgtcaccctggagctggggggcaagaacccttgctacgtggacgacaactgcgacccccagaccgtggccaaccgcgtggcctggttccgctacttcaacgccggccagacctgcgtggcccccgactacgtcctatgcagccctgagatgcaggagaggctgctgcctgccctgcagagcaccatcacccgtttctatggcgacgacccccagagctccccaaacctgggccgcatcatcaaccagaaacagttccagcggctgcgggcattgctgggctgcggccgtgtggccattgggggccagagcgatgagagcgatcgctacatcggtgagtcctgctgcccctaccacagcccacctgggccaagacccctcctcactggagggcccaaggctgggccacaactctggacccgcgcctgaaacctggccccactgccagagcccggccttgagccacagctccagtgccatgattccgtctctgtgcttctaagtctgtggccctatgaggccaaactctggtccctcaccttggattcgctgagctcagatcccagggctccagggctcagcgtgctaagatgaactcccatcccaccactggctatcctgaaaggctgtaacctcagattctccgagcccacaatccccaggttctaaactccgagagtcccgtcctgagcccccagtctcctgggccgtacggctcagcagctcatgggacactgcggcgccaacattctgggacgctgttgcctcatgaactccaagggttctaagatcccatcacccctgactgtgagaccaaggtcgggggattctctgtgtcccacaggccctgagcaggctggggaagctctagagtcccttctggggggctgtggggagactttcttccctaaacactccaaagcctgaagccttgggaagtcagaccttgggatcctggcctagagccctggcctgtggccctgtccccacctctacccccacccctgggggcggtcctgactgtggccccagggctgagctgtctctggtgcctgcagcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtgggggtgcggccgggctgggcagggtcaggagcccgcagtgggcagcacaagtggtggcagcagggggggcaccaaaatccagtggcttcaggactttgggatggtggacctcttggctctgtctctgcccactctcctggaagcagctgagcctcacccaccccaaccctgtccccagtctgggccccactctcctaggccttcagtgggcagcttcctggggtatgggccttctctagggtccagtgtttcctctaggtcagcccctgcctttgtccttcttacacatcggggcctggtggccacatgacccctcaagcctggctctgaaggcacaggcaacgtgtcggggatgacccaaaggtgcaggtccaagaatgagccctgatcccctacccctgcttaagctgcagaggcagcctgggaggcccaaggccagagtcctcagattaaaaaacaccaagaggtaccagcagtccctacccaccccgcccccttccccggccctcagccagttcctcgattccctccacttgaactttttttttttttttttgagacagagtctcactctgtcacccaggctggagtgcagtagcacagtcttggctcactgcaacctctgcctcccgggttcaagcgattctcctgcctcaacctcctgtgtagctgggattacaggcgtgtgccactatgcccggctaattctttgtatttttagtagagatggggttttgccacattggtcaggctagtcttgaactgctgacctcaggtgatccacctgcctcggcctcccaaagtgctgggattacagggatgagccaccgtgcccggccacttgaactttttttaaataaactttgtattgggaaatacttttagatttacagaaaagttgccaaaatggtacagagagttcccatgtaccccacacctaatttcccccatttaatggtgcttagatgggtcaaaactaaaaaagtgatggcagggctgggcgcggtggctcacacctgtaatctcagcactttgggaggccaaggtgggaggattgcttgagctcatgagtttgagaccagcgctggcaatatagcaaaaccccgtctctatgaaacatttttttaagattagttgcgcatagtggcgcacacctgtaatgccagctgctcgggaggctgaggtggaaggatctcctgacccataaaaaaaaaaaaaaagtgacagcagtgctttactattaactacactctagactttatttggattttgctgtttttccactgacatcctctttcggccccaggatccaagccagggtcccaccttgcattaataaccctctcagcttaaggagtgctggacaggtctcctgtagaacatccccagcctcaggtcatctggtgtatttctcatgattaaagaaaggttactggttttaggagagaatcccacagaggtgagcctgcctctcacaccacatctggggcacctgagatgcacacgtggctagtgagtggaaccttcactaccgggtcaggacggtatctgccagggtttccctgggaagctactattgtttgtttctttattatttggaagcaagtctctaagcctaccccaccctcaccaggtggaggtaattaagctgtatgctgctctatcatattgttagttattatctagttattttatacattcttttcttattccatttgtggtttggtggaattttgttgtattgccatttgatacctttctcttcctcctttgtatgattgttttatagggcctgtgagttttgtacttttgtgtgtattatggcaaataccaacttgtttttatgttaagactcctttgagcatttcttgcaggactgatctagtagtgataaattcccccagcctttgcttgtctgggaaaggctttatttcttcatctacgaagcatagtcttagctggataccgtattcttggctaacagcagtatctacatctatttcctggaattctgtaagaaagattcatctcttgaattgtttatttaggtcactacggactcaggtatatttatttgactccaggggctgtaatccaaggtcgtgtggtttgtctgaggctcgggctcagaagcccatgtaagatgtcccagcctcttgggttgtgaccacctccttcccctctggtgctacaagcagctccaggctcatcttgtatctcccctgctccaactccagaagcagccattccttcaaggagccctgcttcatctggatactttcacctttagaaaactctacagaggttttttgacagtggagtcatctggcttcaaacttttctgaccacccagaactgatcccaggacacacagtcacacctaagacacaagtcatgcacaaggtggcttgcccgtactacctgggacgccctctgctgccttctgctccatctcctccatctgctgccactgccattgtgggtaatgctggtctcatgccatgaagtgacgtctgaatccactgggggcagtccgctttccccacatcagacaagccctgacccagctgtgatcagaggttcacggtgattgcaactaaatatactgaagtttttgtgcagcaactatttagtgtctaccaatctttttttcctttcagtcttcaaataagtctacagattgaggaagaaggtccttctcaaggaccttcaagcaagggccaagcttctgtttctaaagtgcaaatctgaccacatcattatgttttcatgtccctgtgctcacaccacacagctcttcagcctccactctgtctgcagtgccctctttgcctgaacaacttctgtccctcccagtccctccactcagcaggcacatgacacccctctcctgggatgcctccctactgtccagtactgccctgctgccactacaccctccatgtccccaagcaacactaggtttcctgcccctacccccagccctaagagtctgtgccatcagcatggaccacacatgagcagatgtccaggaaacatgtcccaagttggaagcttcatgaggagctgctacacaaccccctgccccacctgtaccatcacaggcccttcagctgacatggtggcctcagaccctttctgaggcaagatcagtgtcacagagtccagcatggaacaggctctgggtcctgaggatcctgatggggctcaaggcagcctcacgcacatcctgttctctcccaggtggtcaagcgggtgctgacccagaccagcagcgggggcttctgtgggaacgacggcttcatgcacatgaccctggccagcctgccttttggaggagtgggtaggtgcctgctaccctgcccttctgttaccatttggtcaaattgcaatagtgttacctgcatacatttctgccaaagcaccccagccccacctcaatgtagagggacaggcaaggaggcctcaccccagaacccgcatcctgctccccaccccagagggtctgagtccaatctgggcaacacagtaagaccccatctcaaaaaaaagtctgtggtggaaccttctagaccatctctgcacagacacacaatttagtgaatttttaaaaataccacacaactatgatcacactgcccactgcgatgctatttgctcttctccccaacagcatgacctggtgtctgcccctcagcagcaatgccgccggtgtcctttactccagggcagctgctcctctaaccccatcccccctccagctctcagtacaacacctccccaccctgagaggcccggatgagtgccaatcctccaccccccagagcagccccgatgccactgcagagtcctggcctctgagtcaggaagcctcagagatggtcctagcaacacgctgaaggccctgtggcccaggtgacatctcccctttctgagcccacttcctcctcagagaacagtaggccccgagcaggtgacaggcagtcccgccacctgtccacactcagcaccacagtgaacgatggcagggccaggcaagctgcctcaggtgggtccatgcccttcctggagggcagccaggggcacaacagtgcctgtgctgctgtcctggctcggctcgagtttgggcggctgcccccgaccccacctagctgcctccccagccccagccccagcctcctcaacccgcctccctgccctggaggagagtcggggctgtctgtgggcacatctgaccctgctgctccctcaagaaagcctcccccagctcccaggcccccgagctgacccttcttggtggccgtggccccaccccggcttccccacctgctgctcccacagcctgagctctgcccaggtccctaacacaccgcatggcacccacctctaaggctccccaagcctgggtccctcttgcccccacccactctcttcgtcttattaactgcatatccttggagctcactcactgcaggaagccccccagccaaccccactccacccaggctgtgctctgaacgccctggcctggggcctcgtctgcctcccaacctagacgctgaggagagttcactgcacatagcacctactgggtccaggggtctcaacatcccctcaatccccaccacaaccttaggagggaggtacccttgtcaccccacgacagaggagactgaggcacagtccaaggtgacatggattgtttgcagcagggccagagtttaacccccggcagtctgactctggaatccatgcccttgaccaccacctgcctatcttgccctggcatctggcatccccagggcttactgagctggtgccaagctcggggccaagccctttacacacagtgcctcatgatcagcccactggacagatggggaaactgaggctcagaggggagaagtagcccgcctaggccccactgtctgtgactaggagacccccagcgcctgaccacctgtgttctgtgccactgtacaggtgccagtgggatgggccggtaccatggcaagttctccttcgacaccttctcccaccatcgcgcctgcctcctgcgcagcccggggatggagaagctcaacgccctccgctacccgccgcaatcgccgcgccgcctgaggatgctgctggtggccatggaggcccaaggctgcagctgcacactgctctgagcccttccccaggcccaggctgtagaccaccatgacagctgtcgcctgcggctggtggagacggggcctgggctcccgggcccgaggaggaaaaggattgccaaggctccagggcacccctcaaagcagcgcctgcctcctccctcctgggtcttccctctccctgcctcagcctcctccctcagccgctcccaaccatgagagccgaggtgggaggcatgggaaacagtgcagtgactcaccccctgcccccgcaccaaccacccatattcaggagaagaggacagacacggcacctctgagtcacccctctcctgtggagcgggcgtccgaggggccctggcatctgactcaggccacaccatggaatcactgcatccaaggccattcctgccctctctgagtctcagtttttccatttgttcagtggagagaattaaccattgatacctcctggctgggtgaggcggctcacacctgtaatcccagcactttgggaggccgaggcaggcggatcacctgaaatcaggagttcaagatcagcctggctaacatggcgaaaccccgtctctactaaaaatacaaaaattagcctggcgtggtggcgcatgcctgtaatcccagctactcaggaggctaaggcaggagaatcgcttgaacccgggaggtggaggttgccgtgagctgagattgcgtcactgaactccggcctgggtgacagaaggaggctctgccttaaaaaaaaaaaaaaaaaaacctcctgggactgttgcaaggatgaaatgaaggattgagggattgagggattgctgagctggagctccaggtgtcctatctttctcagtggggtggcacggagcggggccgcctccctcttctctccaggcaggtggggctgtggttatgcgatagggtctcccttccctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttctttttagactatatcaacctacaactttagtcgggaagagggacaggggtggacctgagtttcgtctcctgtctctctggctgatgtcacctgaataaagccttcttccctggcaatacttacatctcagtgatttgctttctgtgcatctagcaacaggactctggaccaaggccctggcgttgggtaacaattctgtaatgctgcaggacttccccaatccacgcaggaatccccgcaggcatccacgcaggaatcacctgatgaagggccagggtcaggtgtgggccaccatcccaagacctcccttctctctagggccagcccctctcctctgagcacctgctgaccagcccaaagccctctccactcctcagcttgaactcccccagggtctccctgtggcccacaggtcctttggaggctcgggcatctgcatgcaaatcccaaaccactgtcccctttgcacacactgagcctgcccttgtcctcgtcctggtctaccatgcgtgtcctccctctgcacgggcatgggacatgccctctgcctccttcctgtcctggcctgcccaactcctacctaccctcagcgcagatcctcccaacacacacatgcaggcagcctcggggcctctgcgggtccctctaccacagcattcccggggaaaggcccggcgtggtggctcacgcctgtaatcccagcactttggcaggccgaggcaggaggatcgcctgagtccaggagttccagaccagcctgggcaacatggcgagaccccgtctctacaaaaaatacaaaaattagccgagcctggtggtggcaggcgactgtggttccagctgctcgggaggctgagaagtgaggatcacccgagcctgggaggtcgaggctgcagtgagccgagatcgcaccactgcattccagcctgagccacagagccagattgtctcaaaaaaaaaaaaaaaaaaaaaaaaaaaaaaaattcgctggtaggaaacataggctggttgagtacgggagtcatacagatcaggtggatcaggcggccgcacaccgcagctctacggcccgggaacgttactaaatactcccatgcctcagcttcccgccttaacgtggtaacacgttactgtagtttctccacgcagagctgctgtgaggattaaaagaggccgcgtgagttgagcatctcgtcgccattaccgtcatcacacgccccccacccaacccggcgggcccaccctctgcacccacggcgaaagcactctttctaaaccacgccccggatgtcccgcctccagcggctcggaggtcttcacttattggcctccccaaaccaacatggcggccccctacaaacttcaagcgccggtctctcctagccaatcaaaagaaagatatttctgaatcccgcctctttcagcagccttgctggccaatcagaccacaccatgaagcatcaatacagaaaagggggaacccgctggcccaatggcagcgtcctacagtgtagcctccgcctcccgattgactggcctgcttggcaaggcaagtagcggcggcgcttcaaggtgggtgttcacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaaggtggggaaggtgctgggttgggtccctggaactgcagtcagtgatccaaaggagtgggcctgttagggggttcacaggtcgtgggatgagctcttatgagcgccggctaagtgccgggctctggggtgcccttggcatgtacgggctcccctaattcccaagaccaaccgcccccaacccacttcataggtgagaagacggaggtcaggtcacatcatctgcccaaggtcacgcggcaggctgggggacagttccaggagggccttgaagctggggaaaggaatgtggtaccgaggactgttcaggccttgaag

SEQ ID NO: 11850 - DNA, 55130 bp, Human
ggtaatgaaataatctatacaacacacccccatgacacaagtttacctatgtaacaaatctttacatgtacccctgaacctaaaagttaaaaataataatttaataataaaagcacagataggtaagaggaacagctagatatttaaaaggtagatattttggaggagatctgttttctttggggaagggtcttactctgttgcccaggctggagcagtggtgccatgatcgctcactccagtcttgaactcctggcctcaagcaatcctccacctcagtctcttgagtagtcaggactacacgcttgtgccaccatgctcggctaatttttaaaaatattttgtagagacagagtctcactatgttgcccaggctggtcttgaactcctggcctcaagcgatcctcctgccacggtctcccaaagtgttgagattacaggtgtgagtcctgtgcctggccagaggtttgtcagtcttatcatctatgaattaattcaatagacatcacgaccacatttccaaaacaaacatcaggaattatgatgtgacaagtcaaaatgcattggttggggacagaatcttttaaatagaaattgtcccataaaatttgagacgtatagtttctgtacctaaatgaccattcagtgatcttggaaatctatagtgctgctcgtcaccaactcctgatatgtttcaattctgtttgcaatggacaataataaaataatatgtgagtgtggcctcaggtattctgagtttgggcactgctgtttccatctgaggaccaagacctacacatctcagtagcactgaaaaagtgaacaaactggtatagagtgccagaaaacttgatcagaatacattatatatactctaaacctgaaaaccacactccctaatattgcgctggtgagctggcaggtaaaggaaaaaacattgagaaagacagcagcccccagaagagaaacaatcctaaaagaaatgtccaaattgccaattactttctgtttgtcaaagtctctactggaggtgcatggaagtttggtgagaagaatgaacctttgtgcaagatccctcagctgacagacctgtgagtgcctctgggtggctgctttgtcttacagaaggcattttgtttcctgacactttttcctgtggcctttgctcttcgtattctgtatgttaggcttctgtttctatcaatatttgtcattaatagcatttacattgctccttcagaatttatttattttgagacagggtctcgctctgttgcccaggcctgagtgcagtggcacgattatagctcactgcaagcttggacccccggggctcaggggatcctcccaccttagccgcccaagtacctggggccacaggcgtgtgccaccacacctggataattttttttttttctgagtttcactcttgtcacccagactggagtgcaatggcatagtctcggctcactgcaacccgtctcccgggttcaagcgattttcccacctcagcctcccaagtagctgggattacaggcgcccgccaccacacccagctaatttttgtatttttagtagagacggggttttaccattttggtcaggctggtctcgaactcctgacctcaggtgatctgcccgccttggcctcccaaagtgctaggattacaggcgtgagccaccgcgcccggcccaatttttattatttttattttatttttttatagacacgggatctctctctgttgcccgcaaactcctgggctcaagcgatcctccagccttggtgagagccacagcgcccagtctctctttaagaatttaaaaagcagtttcagatcacaatatcatctatctcgttcacagtccccttgctttttactgtcaccctttaaaaagcattatacaattacagaaacggtggtttagcagtgaagtaaccaccaaagactcttggcactccaatcctctgccttcttcaggcgataggattaagaatgggatcctaggatgcttacatgcaatgatgaacccgaaaacacttgcaaagtgctacgcaaatattgatcacgaagaaggaagtcctcttcccgcctggagactgtgtggggtatggcggggtggtggggagaatgtggtgtcttgctccaccctcctggcgaggggagggcctggcctggaccgcagaggaatcgagtgactgcccctaaaatctcctagaaccgatcccgcggccccgcccctcccgcggccccgcccctcccgcggcccgtcagcctctgccgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggtaactgcaacgagccggggaggctggggcgccctggggccggatgcgcggatttcccggccagcccccgtttcctgtgttctgcagcgttgacttgagcacaagacagtgacagtggagagtctaaggttgtgtgtgtaggcaactagcgattctggggcaacgcgagtgcctccgggcagggatgggtagggaggaaaagcaaagctgatgagttgcgtggtaggatcgtgagttgttttacccgggccagaacagagttcgcaaagtactggtgggggaagtcgtgcctctgttaacttccttttttgtttgttttgtttgtttgtttgttttttgtttgttttgagacagggtctcactctgtcgcccaggctggagtgcaggggcaccatctcagagctcactgcgccctctaccttacgggctcaagtgcttctcccgcctcagcctccctggtagctgggattacaggctcccaccaccatgtccggctaatttttgtatttttagtagagacgggttttcagcatgttactcaggctggtctcgaactcctgagcttaggtgatcctcccgcctcagcctcccaaagtgctgggattacagccgtgagccaccaagcccagccaactgttcccccttttaaaaccaggactgatgtattattgtcttcaaatgtgtgcataggagaggaattctaaaagaacggggcggggttgtggggaagataatcatttgtgctgggaatgaaggaacgctcacagatagtttctaatgactacgaatgaggactttgtctccacattctaatattaaaatatttctgcacattaatcagaattgggaaaggaaaaaaccccacctttattcagtactttcttccccagctttattgaagtataattaacaaataaaaattgtatatacttaaggtgtaaaacgtgttgtaatgtatgtataccttgcaaaatggttaccacggtcaatctaattatccattgcttctgcatagttaatggctttttttggatagtgaaatatttaagatctattcttttagcaaatttcaagtatatgatgcagtattggtaaccatagtcaccatggtctacatgagctctccacaatttattcatcttgctgaaataaaactttttaatccaatgcttaatgtgtgctaagcactgtgctaggcactggatttactctgggaactctgaaggtcacagagataaggaagaaggggctttttgttttggttttgtgttgtgtttattttgctgggttttatggaatatatgtggggagaaaaatgtaaatattttgtgtaaaatgtagccagagcaataaaactgatttgcaggggactggagaatttagtatttgaccatccacactaaaccacagagcagtgacttggcagagccagaaggcattatcacatctcttctttatataggaggaaacagcttctctaccccgacttaatcctgatacaaaagaaagaaaaattgctctttgctttaattgcctacagtgtgtgtgatcctcagccaccgcctttaccagctggctattcaagtttgtaacagaaattgcagatttgtgaaatctccctggaaagagtcccaggagttcttgtgaagaggatttgctgagttggcaaacttaaagaattcttgttggtagaggcagtacagtccttgggctatgggcctagaaaaactgattgtttcataatttgcaccagaatagggagagggaataaaggtggaataagaaaaggaaatctgggaatttttgagaaaaaaaaaatgttcctttagggttgccttatcctgatattactgcttattaactatatttatcaagtatcaagtagtatgatataacctacatagaatatagacaagggatttacagtcagagtttataacccaatagactgattacttttgactttcattttacaagacccctgagattctgagataatgtttaggagtgttgcaaaacttaatcagaagttaatgttagtaaactcaactgtaaaatagtagagggcaggggttcttaactctaaatccttgatgagtttagggcaggggacatgacattcctgtaattctgttatatgtttaagtagatttttctggagagaggtctgcaacttttatcagactcctaatgtcaatgaccgcaaaatacagttaagaactgctaggccgggtgtggtggctcatggctgtaatcccagcacttggggaggcagaggtgggtgaatcacttgaggtcaggaatgtaagaccagcctggccaacatgatgaaatcccgtctctactaaaaatacaaaaattagctgtgtgtggtggcaggcgcctgtaatcccagctactcgggaggctgaggcaggagaattgctggaacccaggaggcaaaagttgcagtgagtcaagatcgtgccattgcactccagcctgggtaacaagagcgagactccgtcttaaaaaacaaaaaaacaaaacaaaaaaacctgctagtatagagatggtcactaaatcaaaccatacataaaaacaagaagttacggtagcccacgcctgtaattccggcacttcgggaggctgaggcgggtgggtcacaaggtcaggagatcaagaccatcctggtcaacatggtgaaacccggtctctactaaaaaatacaaaaaattagctgggcgtagtggcgtgcactggtagtcccagctactcaggaggctgaggcaggggaatcgcttgaactcaggaggcagaggttgcagtgagccgagatcgcgccactgcactccagcctgggtgacagagcaagactccatctcaaaaaaaaaaaaaaaaaaaaaaagactactactaagagaatattgatagataatattttatttaaatatgtggcaacaatttgagttaaaactgatgtttccgctctttataggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggtatgttccaatttatttccttccagaactcagacattgctctgaggtttctttgtgatgtttgcagttcgactttgttgcaacattaggccgtaacgtttttataaaatggaaaaacatttccacatgctcaccttagtatataaaacaagtttttgttcaatacttcccatctggatgttggctcttggacatctcctttggcaggttttcatgtttgtaaagctttgttttgaattataatgcactctttatagctcatcgtcctttttttatttttattttttttttttttggagacggaatcttgctctgtcgcccaggctggagtgcagtggagtgatctcggctcactgcaaccttcgcctcccgggctcaagcaattctcctgcctcagcttcccaagtagctgggactacaggtgtgtgccaccatgcctggctaatttttgtatttttcgtagagatggatttcaccatgttggccaggctggtcttgaactcctgacctcaagtgatccacccacatcggcctcacaaaatgctgggattacaggcgtgagccactgtgcccagcctttctttctttttaaaccatgtggtttacttgtttcctttttattctttattttgatgattctcaagtctacctttctttttcagatttgttttcagatagggttttaagtatcgttactttaattgggaagatttcatagatttgtagatgttccctttaaaaaaaagagagttaaactttttttttacatcataaatatatacaatttttatttgtcaactaaaaaaaattgtaaaaacaagtatttaatactcatcgcaaaacataaaaagcctgcaatgcaaagggtttctgtggtgtagtagttaccacgctggcctaacacacggaaggtcctctgtttgaaacttgacggaaacaaaaggtttcttttgtttcccagaatctgaccaggctgcctcttcctgggagtccagagctgcgaggaacaagtgataatcctgcctccttttttttttttttttatacttaagttctagggtacatgtacacaatgtgcaggtttgatacataggtatacaagtgccatgttggtttgctgcacccatcaactcaccatttacattaggtatttctcctaatgctatccctcccccagccccccaccccctacggccctggtgtgtgatgttccccaccctgtgtccaagtgatctcattgttcaattcccacctatgaatgagaacatgcagtgtttggttttctgtccttgtgatagtttgctcagaatgatggtttccagcttcatccatgtccctgcaaaggacatgaactcatcctttttaatggctgcatagtattccatggtatatatgtgccacattttcttaatccagtctatcattgatgggcatttgggttggttccaagtctttgctcttgtgaatagtgctgcaataaacatacgtgtgcatgtgtctttatagtagcatgatttataatcctttgagtatatacccagtaatgggatggctgggtcaaatggtatttctagttctagatatttgaggaatcgccacactgtcttccacaatggttgaactagtttacagtcccaccaacagtgtaaaagtgttcctatttctccacatcatctccagcacctgttgtttcctgactttttaatgattgccattctaactggtgtgagatggtatctcattgtgggtttgatttgcatttctctgatggccagtgatgatgagcattttttcatgtgtcttttggctgcataaatgtctttttttgagaagtgtctgttcatatcctttgcccacttgttgatggggttgtttgttttttcttgtaaatttgtttaagttcattgtagattctggatattaaccctctgtcagatgggtagattacaaaaattttctcccattctgtaggttgcctgttcactctgatggtagtttcttttgctgtgcagaagctctttagtttacttagatcccatttgtctattttggcttttgttgccattgcttttggtgttttagtcatgaagtccttgcccatgcctgtgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttcctcatttcttgtttttctcaggtttgtcaaagatcagatggttgtagatgtgtggtattatttctgagggctccgttctgttccattgttctatatctctgttttggtaccagtaccatgctgttttggttactgtagccttgtagtatagtttgaagtcaggtagcatgatgcctccagctgtgttcttttggcttaggattgtcttggcaatgcaggctcttttttggttccatatgaactttaaaatagttttttccaattctgtgaagaaagtcattggtagtcttgatggggatggcattaaatctataattcatcttgtgcagaatggccatttttgcgatattgattcttccgatccatgagcatggaatgttctctcatttgtttgtgtcctcttttatttcattgagcagtggtttgtagttctccttgaagaggtccttcacatcccttgtaagttggattcgctgggtattttattctctttgaagcaattgtgaatgggagttcactcatgatttggctctgtgtttgtctgttattggtgtataggaatgcttgtgatttttgcacattgattttgtatcttgagactttgctgaagtagctaatcaccttaaggagatttggggctgagacaatggggttttctaaatatacaatcatgtcatctgcaaacagggacaatttgactccctcctaagtgaggtgacctgatttttttctcctgcctgattgccttggccagaacttccaacactatgttgaataggagtggtgagagagggcattcatgtcttgtgccagttttcaaagggaatgcttccagtttttgcccattcagtatgatattggctgtgggtttgtcataaatagctcttattattttgagatatgtcccatcaatacctagtatattgagagtttttagcatgaagggctgttgaaatttgtcgaaggccttttctgcgtctgttgagatagtcgtggtttttgtctttggttctgtttatatgatggattacgtttattgatttgtgtatgttgaaccagccttgcatcccagggatgaagccaacttgatcatggtggataagctttttgatgtgctactggattctgtttgccagtattttattgaggatttttgcatcgatgttcatcagggatattggtctaaaattctctttttttgttatgtcttggtatcaggctgatgctggcctcataaaatgagttagggaggttccctctttttctaatgattggaatagtttcagaaggaatagtaccagctcatctttgtatctctggtagaattcagggtttttagcttctttgtgatgggttcaaacatcatcctttacctcagagaagtttgttattaccgatcttctgaagcttacttctgtcacttgtctaagtcattctccgtgcagctttgttccattgctggtgaggagctgcgatcctttggaggagaagaggcactctggttttgagaattttcagcttttctgttctggtttctccccatctttgtggttttatctacctttggtttttgatgatgctgacctacatatggggttttggtgtggatgtcctttttgttgatgttgatgctattcctttctgttagttttccttctaatagtcaggaccctcagctgcaggtctgttggagtttgctggaggtccactccagaccctgtttgcctgggtatcaccagcggaggctgtagaacagcaaatattgcagaacagcaaatgttgctgcctgatccttcctctagaagctttgtcccagaagggcacccacctgtatgaggtgtcagtcggcctcgactgggaggtgtctcccagttaggctacttgggggtcagggacccacttgaggaggcagtctgtccattctcagatctcaaactccatgctggaagaaccactactcttttcaaagctgtcagacagggacgtttaagtctgcagaagtttccgctgccttttgttcagctatgccctgccgccagaggtgcagtttacagaggcaggcaggcctccttgagctgtggtgggctccactcggttcgagcttcctggctgctttgtttacctagtcaagcctcaggaatggcagacgcccctcccccagcttcactgccaccttcgcagttccatcttggactgctgttatagcagtgagcaaagctccatgggtgggggacccgccgagccagctgcaggatataatctcctggtgtgccgtttgctaagactgttggaaaagcgcagtattagggtgggagtgtcccgatttcccaggtaccatctgtcacggcttcccttggctaggaaagggaattccctgaccccttgtgcttcccaggtgaaccagtcctaatgagatgaacccagtacctctgttggaaatgcagaaatcaccgtcttctgcattgatcacgctgggagatgcagatcggagctgctcctattcggccatcttgattctggactctgatagttaaactttttatagtcttaaagatcagaagtaccagatgttcattatagaaagaaaattcagaagagaatacatcaaaataagaatcatggatagctgagtggtaggtctgtggtgactttttgtcataagtatgttacgtcagaaactgtgacgggtctgagagtttccctgctttcaagagtgtgtgtgtatatgtgtatatattacatacatatacatataaaacacatataatatacatatacataattatacacatataagctatgttatacacatagaataatatataatctatataatatacatatattctatattatagttgtaaattacacaattatgtgtaatatatgtatattttatacatatatatattctagcaagagacatgaggctttttggatcacagagaaggatggtttattacagcaaaatgcagcagccatagcaataccttagcactaatttctgtttatttattattattttttttttgtgatggagtctcactctgtcacccaggctggagtgcaatggcacaatcttggctcactgcaacctccgcctcctgggttcaagcgattctcctgcctcagactcctgaatagctgggattacaggcacatgacaccacgcctggctattttttgtatttttagtagagacagagtttccccatgttggccaggctcgtctcgaactcctgaccttaggtgatccgcctgccttggccttccaaagtgctgggattacaggcatgagccactgcatccggcctagtttttttgttttcaaagcaccggtcaccacggtgagtgaggggatgggatgagaaccaggtgagatccctgtgcatgcaggaagttgcaccaaaggagaagaaccctaaacttctgagattcatttaaatagaaactactggcacatctgcccatcctcttctctggggagagagtgagagagattgagattacttattaagcaaatctccagggttgagagggaaggtatcactaagtttattatcctggagtataagcacatgtttcaggaacaggaagtaaagaagtttacatttctaaatttctccagatttgtttatctttagggagatactgtctctgcctttcaaggcctttgctattcaatcaactcgtcagtgtcctttgcttggaaagccctgaccatgcagaaatatcaaaatattcatatagaattttctcccaacgaagtattttccccgttattaaaaatttatttttaattcgataaaccaaagataactcaaagcagataatttattattttcatttgcccattttttttcctgtgaatgagcagcattgtagggctgttaagaattggctcctttattgttaggaaatgacttttattgatcctgggtaatatctaataatattttttgctctgaaatctgttgtctgatactaaatttcatttctttttactttaccctcccctttacttttcctttgatacctgtgtggtgttttattaatcaaaaacccactgcttattattaagtgtttattaatcaaaaacacttgtctgattatcgtgctctgaacctgccttcaccccaatttattccataactgaatagatcccactctgtgaccacacctacaatcatattagccctcaattttcttttaagtgatttttctagttaatcaagatctgcagttctttgttcttttttgacagggtcttgctctgtcacccaggctggagtgcagtggcacaatcatggctcactacagcctcaacctcctgggctcaagggatcctcttgcctcagcttcccgtatatgtgcaccaccatacctggctactttttgtttgtattttttgtagagataggtttacgccatgtttcccaggctggaatttaaaaaaaagtattgctgtaaacaattattttttaaaatattttaagaataaggtaaaatatttcacatttgtccacatatttaccatttctggtgctcataagtcatttgtgtagacccagatatctgtctgctgtcattttctcttctgctagaacgaatttcttcagcatttcttttctgttttgttttgttttttgagacaaggtctcgctctgtctccccagctgaagcacagtagtggaatcatagctcactatggccttgaccttctgggctcaaacgatcctcccacctcagcgtcctgagtagctgggactacagactcatgtcaccacacttggctaatttttgtattttttgtagagagcgggtttattcatgttgcccaggatggtcttgatctcctgggctcaagtcatcctcctgcctcagcttcccaaagtgctgggactgtacgtgtgtgccactgtacccagcctagaattaatttcttttcttttcttttctttctcttttttttttgagaggagtctctctctgtcacccaggctggagtacagtggcatgatctcggctcactgcaacctccgcctcccgggttcaagtgattctcctgcctcagcctcccgagtagctgggattacaaatgtgtgccaccatgcctggctaatttttgtatttttagtagagatggggtttcaccatgttggccagggtggtctcaaactgctgacctccagtgatccgcccacctcggcttcccaaagtgctgggattacaggtgtgagccactgcaccccgccaggctagcatttcttatagtgcaggtctgttggtactctttcagattctgtatgtctaaaaaagtctttcttttgcattaatttttgaatgaattgtaggtaaatagttttttctttcagtactttaaagatgttgctccactgtcttctgatttgtattgtttcagaagagaaatttactgtcatttttatttttgtatctttgtatgtaatgtactccctctaccccccacccctggctgttttaatatttttctccttatcactggttttaagcaatttgattatgatgtcttttggtgcagttttcttcatatgtatttttcctgaggtttattgatcctcttggatctgtaaatttgtttcatttggaaaaaaaatttggccatgatttctttagtttttttttttgccccctcttccatcacttctccttcagggcctccaattacacatatattgggctgcctgaagctatcccacgtcactgatgctcagttcattttccagtttttgggtgtgtttatgggtttttttctccttctgagccttccctcccacccgctgtgtgtgtgtgttttgttttcaggtaatttctattgttatgactcaagttcatcggtcttctatagtgttttatctgctgttaatctcatctagtgtattttcatctctagattaatttgggtcttttatatatgtgttctgtggctctccttaacatgcttatgtttttctgtgccttcttgaacatacggagtatagctatcataacttaatgttcttgtctactagttctgttgtgttatttctgaatgtgtttttattggttagtttcgcttcctggttaaatgttacggttttctactttttgcatgcctggtagtttttgatcactagacatatgatctctagtgaatcactagggcacattatattgctgggtgctggatagtcttgtactttaaaaaatattcttaagctttgttctgggacacagtgaagttacttggaatcagtttgatccttggaagatttgcttttagatcagcaaatttcgccatgttattcaatacccttctgactgcttaaccctgtgatccgggtgttaatgaggttttctcactatggctggtgggaacatgaactatacctggccctgtgtgagttctggggctttttttttttttaaaaaaaaaccttttcttcttgggtagtccttttcccagtcttgggtagttttctcacactggtactcaaaggggaatctgcagatttctggggttctctatctgtgcagctcttttcccttccacactcagtcttgaagaactgtagccactcaaagttccctaaactcccaccctatcttctcaactcatgtgtctgctgggcgccacctagcttcctcctccctgctctgtggcctgaaaactttctctaggcagtagactccagcaattgtagggctcacctcattggttccctcctccagggaccactgccttgagttgcttaatgtctgatgtctgaaaatggttcatgtattttatctggtgtttttagttgtttaaggtgggagagtgaatctggtccctgttaatccatcttggctagaagctcattgattcctagtggaaatgaacatttttttccatattttctcatttttactttgaatcctttggtacttataccagattgtatagatcttgtctgtgagacccagtcatttttcagttggagaccccttgtgaagtagctatcatttggattaaaagaggagggagaatgttacttaaaacaatgacaaaactatctaaataaagaagagattgtgtatgtaggttatcttcttgcctccagccctggcccaggttggtttgtcttgtacagtgccaccagagtggtcctcctacagaagcacatttgatcatggtacatccttgggtaaaactggccatggtccccctccttaacatggccctcaggccctgtttctccagcctcgtcttttctcttcacacaccataagacccagctctcctgcactactggtccttcctcgtttaccatgtgtatactgtcacacctcatgcttttacaatgccatgacgctgagtttggtgctattcttttgtttttcttgcctcttgtgcttacatgtttagcatttagtggtctgtactgtaatttatccctccctccctccattttttccttctggacaaggtgattgttgtacataattgtattagcaaaagcatcttgagatgtatatagctattttacctatttgagaaatgagaaaatgctcaaaaaggttaaatagcttgtcttagatcatataactagtaagtataagagctagtctgttgggcttcaaagctagacattaagccctgctgaggggttcaaagtgaaagggagaagtgagggacctactcttggcttctaatctttcatcccagtgaacacctggtcaagtcatattgtaaagcagggtgatatagaggaggaacagggttgggaacaacacatgtatttcctaagaaatacttgtagcagtatgttgttatggtgaacaattttatcttatggttactcttgcaatagtagcaggcagaaatttttgtcagagacatctttgataatccttacgtactatatcagaagatctcctaatgctcttagtagataactttttttttgtaaggatggagaataatagaataacacagaaaaaatttcccaaggccatctaattaactgaattttctctgagagttgaaaccccaaaacagcccccaaaaccacttgcctatccattattttaaaagagaaaaaaatctccagagtaaaagtttctattctcttagtaaatgttccagggcttagcagcgatagaatcacagattacttcctatttgttcactcttacactaaagtgtaagcagaaccgtgtttcactattgccagtgtaatatctcttccctgtatttgaaatgttctgtactgattcatcactttattcaaccgattaatgcactagcctctctagggcctagtttcctcttgaattcaagaaacaaaatttaagctacttatggttgattatacctttggaaaactattttgtgttaattatactcaacaaacttaagaatggggaataatttatgcttggcgtaagaattgatgtatgttttcctcttagggtaccctctttctagggtcagcatactgggaaacaagttaattgtcaaaaggttgttttgttgagtgtagagtcaggaagggagaaggtaaattgttggtttaaaagagagtttaatttagaccaggtttgaatgtgaacagattatcctttctgaaggaaaatgtctattcaaaaatttcaatattgatttaaaatgtgctgacttgcccttttagaagtaagctcttaaagggatagacaggactgatactcttttccctagtaatgaatgtagaatgaatgagtcaaagcactttatacctctggcctttataagaaatacagcatgtccaaatctcactatccaactgtcctttcttgtatttcatattggttttcatattcctactttcatcttttctgagctttgtactgtggatagatgcttgagttagtttctgttgcactccattttgcttctggccagccttactgcttatcagttttataaacagaatgttccttcttgtcagttgcttaatcttttatgtatgttctgatagtcaccctattatttattttaaattggacccataatagcaactgcctacttcttacatattcaattcttttatgttctttagaccaaagaaaggcattatttagctttctttcttaggtctaatttcctaaacctttaagctcatcaccggaccatctattgaatttctttatccttagtaagttgtggagcccagaactagaaacagtatttgaaaatagtattgattgaatgctaagtattagaaaatattagaagagaatatgctgcaattctttgggtgacttaaagtgacgcatattacaacctcttaaatgcaattgtgtgttagaatattttgtataatttccctaagaactgttttctcttaccatatatgagcaaacatacatatttacgtacatgtacgtattacattcattttccaaaatgaattattcttccacttgtgagccatccattttctctccattctctacccctcacctcttcaataaatatacacttcaaatcagaatgggcctgccctgtgactttcagagcctcagagggcatgggttcattcctgcctggtcttgccccttcttttactaactgatcttgaaataaagtagcggtcttaaatctttgtcgattaacgagggaagaacagggctgctgttcagctataagcctttatctctcttctaaatgtaacactgccatttcttttcatttaaagtgaaagctatttctagttttaaaaattgagcagtgtgttctatttaagcattaattacatcaagacatattggaatatgtcttaaatctagtcttctgctttacccaaaggaacgggaggatgaaattgctactatggagtgcatcaacaatggcaagtccatctttgaggcccgcttggacatcgacatttcctggcagtgcctggagtattatgcgggcttggctgcatccatggctggtaagtcctcacctggtgtctgtgaccagctgataatgaggcagaagagcagggcctagtggtgaagggcaaagattttggaattaagacaaacctgggtgaaagtcttgggtttgtcactttctacctgggtggcctgggaattactttatctttcctaatctaaactggagataataattcctaccttcttgggttaaggattaaatgagatagtgcatgtaaagcacctagcatgatacctgagctttagaccaaattgctgaaaaaccagttttcacaagaatcggtttgtcatatttaccagttttatctatttagcaaacttttttttgacagtgtataaagttttcaacaattgatattggaaggttggtagggcctaggaaggttgcaaggaacttacatgcttcccctgctgttgagtgttcctctcatttccattttgtttcatctaagctatctaatagaggctcagtaaattcttagagaattgttaaatcaagttagatgaacatgtgtttgaaggataggcagggttctctatgtggagagaatacgtggaagccagtggaagactgcctggaacaaatagaagaatggagacagggtgagcctggtgtattgggagaagtggggaggctgcgttgactggagtacaagtcagactggtacagatgttggtgaaatcttggggagcacagacctgcatcctcctttactcctgttttccccataggtgaacacatccagctcccaggtggatcgtttggttataccagaagagaaccacttggggtatgtgtgggaataggagcatggaactacccctttcagattgcctcttggaagtcggctccagcattagcctgtggtaagaatgaattatccctccatttgagagccattcgttcattctctcgttcgttctctccccattctctacctttcacctctctataaacacacactttaaatcggaaggggcctgctctgggatattcaaagcctcagaggacatggctcgttcctgccctgtcttgcccctcaaggagcttatagttaaggttgtacacaatcatgtctagatattctcaggttttatttatttaattttgtatatgaaaagaaatttaattttttcttattaaattgaattagatttgtgctacttataagttctcttcctttctggacaagaattttaaggtaggagttagcacttaggagtttgacttcatttacgaagcagaagataaactcctttcttcatttgggtcttaagagaaatgataagcaaggctttgataagcttcttatcaaagaggagctttggctgattgacataaaatagttttcttacagtatttaaagagaagaatctttgaggaaagaagactaattttatcttagaaaaaattgtaatgttagaaagcattactgttaggacattatattgaaatgcagcttttgtcctgttgccattgcatgttcttgttttagcctatttctctttgagatacagctgtgaaagaggaaaaatagtcactagctttaatagtcaccagaattaagtcactagctttggggactctcatcaagtgaaccattctggtcttcaatgtcaacttttataaaatggagctaatgatacctacttcatactgctgttgaaagtgttaaatgagataatatatgtgaaaaggcctagatatgcaaatgtgagactgggcaactgtagggtttgggatctgtttaatgagagaaaccaagatgaaaaggacaagagttgtttacttattgatatggtttggctgtgtccccacccaaatctcaacttgaattgtatcacccagaattcccatgtgttgtgggagggacccagggggaggtaattgaatcatgggggctggtctttctcatgctattctcctgatagtgaataagtctcatgagatctgatgggtttatcaggggtttccgcttttgctgctgcttcatttttctcctgccgccaatgtaagaagtgactttcacctcccgccatgattctgaggcctccctagccatgtggaactgtaaatccaattaagcctctttctgttcccagtttcgggtatgtctttatcagcagcatgaaaacaaactaatatggttattaataacatttttgatgtaggatttggttggggaagaggaaacaattggaatcatttttgaattgtcctctagtcctgttttcaggggatcactggtcttagaaagtctttttatgtttgtgtcttgggtttatgcaggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaaggtgaggacaaaaccagtattggtcaacacacatggcatttggatgtggcaaatccggtcctacccagagtatattttggaggcttctcttttgattttacctagcctgaattgggaatgggaaggagattttattaggcagaggtgtgaaatttcctgtaaaagtatgaagggggaaagggagtacacatggggtgatttgtgttaggccaggtaggggtggaaattaacagccccagcctaaggagaggatgtgtcttagtggacaggggcctgggctgccacttgtattgtttagtgacttaatttcttgtatagaagaaaggatttttactcaggctatttcagatccattattttgacattaatttgtgttctgaactctgtcagccttaaacacagtaacaataacacaaaagaatttctggctatgacaatcctgtgaattgacaatattttttatttttatttttttgagacagggtctcaccctgttgcccaggctggattatagtggtgtagtcacagcttactgcagccttcaactcctgggctcaggcagtcctcctgcttcagcctcctaagaagctgagactacagtcatgtgccactgtgcctggctaagtttcttatttttctgtagagatagggtcttgctatgttgcccaggctgggacaatattttttaaatgaactccctcttctaatgtcagtgcaactctgtggattctcttcagttttctggaatagaatattttaatagccaaaaggcaaaggatattgacaagaataaggctacaggtcacaaacagttcaagatgattttgtaggttcagggcctagttgacttagcatgcaatataatttgtgttaaagttctgaataccttgtccttgttctgcaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtatgtacctgtccctggaagaggtgtaaaaggaatctctaccccctcatccaacagtgtgttttaaagctttttgttttacaatactttcagacttacagaaaagttgcacaaatagtacaaagaattcccatgtacctttgaaccagatttctcaaatattaacattttaacagattcactttatcatcttctttatctgcctgtacatacgtaggcatattaagtttttctgaaccttgagagtaaattgtagacataaggcccctaacctctaaatataaagttcctaaaaacaagtgcattcttttacataagcacggtacacttagtaaaattaaaaaattaacattgatatagtactgttactgaatctatagcccttactcaatctatagcccttattcaaattttgccacttgtttgactaatgtcctcatagtaaaatagaacaaaaatggttttttttccggtctaggatccagtcaaggatgatgcattgcctttagttgtcttgtctttaatctcctttagctgagaacagttcttcagttattcttgtctttcaggacattgacattttgggagaacaggccattcattttgtagaatgttccttagtttgggtctgtctgatgttttctgttagattcatattatgaatttttggcaaaaataccacaaacatgatgtcatatcctactcagtggtgatttaactttgatcacttgctttaaggtaagtcttcactgtaaagttactgttttttactttgtggttaataagatcttgtaggaggtattttgagactatcctgttcctcatcaaactttcatgcagtaaatacttctatcaccactgacgattcttgctgaaaacaatttttattatggggttgcaaatggtgattttccaattccatcatttcttctatatttgttcaccttctactgtaagaaagaacttgcccttcacccctgtttgttttccattcatttatttatatcagtatggacccatggattcttatttcattctatgtgttataatccaatactatcattatttatttattttttatttttatttatttacttacttattttttgagacggagtctagctctgtcccccagacggtagtgcagtggcacgatctcggctcactgcatcctctgcctcccaggtttaagcgattcccccgcctcagcctcctgagtagctgggattacaggtgcccgccaccatgcccagctaatttttgtatttttagtagagacagagtttcactgtgttggccaggctggtctcaaactcctgacttcacaatccacccacgttggcctcccaaagtgctgggattacaagtgtgagccactgtacccggcctttattttatttttttattgagacggagtctcactctgtcacccaggctggagtgcagtggcacgatctcagctcactgcaacctccaccacctgggttcgggttcaagtgattctcctgtttcagcctcccaaatagctgggactacaggtgtgtgccaccacggctggctaattttttttttttttttttttttgagacagagtcttgctctgtcgcccaggctggagtacagtggtgcgatctcggctcactgcaagctctgtctcctgggttcatgccattcttctgcctcagcctcccaagtagctgagactacaggcacccgccaccacgcctggctaattttttgtgtttttagtagagatgaggttttaccatgttagccaggatggtctggatctcctgacctcatgatacacctgccttggcctcccaaagtgctgggattacaggcatgagccattgtacccagcctcattatttattttgatgctaaaataattgcagatggctggtgggaatccctttccgtgaccttttgatatgccctcattattctttgaatacttcattactttctggcatagcaaagtgttccagactcatacttcccctggctgtgctctggaaccagccatttctctgaaggaggcctggttccattattgtttatctgtttattattaatttttgagacagggtcctgctctgttgcccaggccggagtgcagtggtgctttcttggctcactgcaatctcggcccctccaaggtcaaacaatcctcccacctcagtctccagtgtagcacaccaccacattcagctaatttttgtattttttgtagagacggggtttcactgtgttggccaggctggtcttgaactcctgggctcaagtgatccaaatgcctcggcctcccaaagtgctgggattgcaggcatgtgccaccgtgcccggcctgttttttattttttgtaaatttttttttatgatttagaaggactatcttcaaaccagtacaagtatttcataaataatatctgattgttttctaaccagttgagtaatttgttgcacgataagccacctcacatctttcagcaagaaaaatactaagtctgaacagtaaagacattacacaatgagttaggacacaattaaaatctgctttaaatatttttttgggggagaggacaccacacttctctactaaataaagagaaacaattttgcagtccagaggtcttttatttttttatacctatcatgccatgaattcatagggaataggttccagcatctcaggctccttcccgttggttctcacacagtgggattccctgggtggagtaggctggtgcttcagctgaaaccaggtacctttctctttggcttccttctttttctgatcatcttctttcatgcatttcagaagctatcttgggtcttagagcgcttaatgtgctcaatgtgcacgttaattctcttggcaagaattttgcccttaatttgtttacagcagtgccaacaacatgctgggtaacattgtagactcttccagtttttcccaggtaatgcttttgggcattcctttttgaatagtacccgttcgcttgatgtctacagtattgcctttcttatagatttgcatgcacgtggcccaaggaacaactccatgttttctaaaaggcctagagaacatatattgggtaattcttctctttccctgtgtttgtcgttttggtgaattactggaagacggcagtaccaaccaaaagccctggttccatttagtggtaaatggtatttagaaaccaagatctgagtgccaggtgtgcttgttgctactggtgtatcattgcttctaggccctctcagaggccagtgctgggaaatacatgtttgtatatatgtctgtgcacatatctagttctgtatctgtctgtctacataataataagttcatccagatactttaattatagtctaataccacagggttcatttctgccttctccctttccatatttgtatttgttctctgacagtaagaaatttgactcccattatccacaatgtttatctaattgctcatcatagaatacacttagtattctaataatagtagtttcagatttgtaaatccatacctctgtggaaaataaaccttctaattagagctcagaatttttttacagttgtttttatattcagcgtgagagtatagtcagaatactgtgttcaaaagttacttgggtcagttctacctttccttcaccctccttcagtgtggttatgatactcatttaaaataacagattcatttgtttgtgtttgtattcatttgggttttatttcccccatccttgctgattttaaaattttattttgattaggcaaaacacaaacatggttctaaacatcagaattttacaaaaacagatactcagaagtgttactgctccccatcctgtgtactctgtttccagtgcctccttcccacccagttttgtccatctcctgtgggtagccagtctgatttgtttctggtttttgcttcctgtgtttctttttccacaaatgaataggtacttgtatatttcttattcttctttcatacacaaaaggtagcacattagaggtactcttttgtactttgctttctttgctatgtgtgtgtgtggatgaatatacacacacaaagaatacatatagtatagaatatatagaataaatatatagaatattctacataatctgtactatgtatactttatatatatagagagagagagagagagagcactaaaaataattgtgacgtaatgtgaatttattttattattattattttttcgagatggagtctcactctgtagcccaagttggagtgcagtgacacgatcttggttcactgcaaccttcgcccctggagctcaagcgattctcctgcctcaccctcccaagtagctgggactagaggcatgcgctaccacacccggttaatttttttgtatttttagtagagacagggtttcaccatgttggccaggctggtcttgaactcctgagctcaggcgatccacccgcctcagccttccaaagtgtgggattataggcgtgagccaccacgcctggcatgagccaccatgcccagtgtgattttaaatatgtatcacaatttatccgttcatctggcaatggggttatttccttatcttggttattgtgaataatgctgcactgagcatgggagtgcagatatgtctttaagctactgatttcatttcctttggtatatacccagaagaggaattgctgaatcataggatggttctatttttaattttttttttttttttttttgattcggagtctcacttagttgcccaggctggagtgcaatggcacgatctcagctcactgcaacttccgcctcctgggttcaagtgattttcctgccttagcctcctgagtagctgggattacaggcatgtgccaccacgcctgactaattttgtatttttagtagagacggggtttctccatgttggccaggctggtctcgaactcctgacctcaggtgatctgcccacctcggcctcccaaagtgctgggattgcaggcatgagccgctgttccctgccaatttttaattttttaaagagcccctatcctgttttccttcatggctatactaacttagattctttttttttttttttttttttttttagtgaaaggaagtttattaagaaagtaaaggaataaagaatggctactccgtaggcagagctgccccaggggctgctggttgcccctttttgtggttatttcttgatcgtatgctaaacaaggggtgggttattcatgcctcctcattttagaccatatagggtaaaatgacgttgccatggcatttgtaaactgtcatggtgctgatgggtatgtcttttagcatgttgatgcattataattagcatataatgagcagcaatgacgaccagcggtcactcatcaccatcttggttttggtgggtcttagctggcttctttaccacagcttgttttatcagcaaggtctttatgacctgtatcttgtgctgatctcctatcttatcctgtgacttagaatgtctaacttcttgggaatgcagtccagtacgtctcagccttattttacccagcacctacttaagatgaagttgctctagttcaaacacctgtgacatttcccctctcccttttataaaagaacccttaatcctaagggttgcagagggacaaagatccatcttctgtaaactttttcatgctgaataggggcaatgatattcctgtctaattattagggtctcttgtattcaggatagagaggagctcagtcagaaagcgtcagggtgagggtcgcttataactccgagttccgacaaaaggtgatatccagagttggccaatcagtgctgcagtctatttcttttgggtcgggaggatctcctcagtattgtcccttccatggtttgccagaaagatgttactgcaaaggggccctgatccagaccccaagagagggttcttggatcttgtgcaagaaagaattcaggacaagtccataaagtgaaagtaagtttattaagaaagtaaaggaataaagaatggctactccataggcagagcagcctatactaatttatattctcaccagcggtataccaagatttccttttctccgcatcctcaccaacacttgttatcttttatctttttgataataaccatgctaacagatatgaagtgatacctcattgtgattttgatttgcattttcctgatgattagtgatgtggagcatcttttcataaacttgttggccatttgtatgtttctggaaatatgtctatccaggtcttttgcccattcgtaatcagaggttttttttttttttttttgcaattgaatagtgtgagttccttatatattgtgatgatttttttgtgtgtatggtaaagcctaatgtaaaatttaccaatttaaccgtgtgtgtgtgtgtgtgtgtgtgtgtgtgtgtgtgtgtgtgtttgtattttttttattttttatttttttattttttggagacaggatcttactctgttgctcaggctggagtacagtgacatcatcccagctcactgcagcctcaacctcccaagctcaagtgatattcccacttcagcctcctgggtagctgggactataggcatgtggcaccatgcctggctaatttttgtattttttgtagagatgagatttcgccatgttgcccatgctggtcttgaactcctgagctcaagcaattctcctgcttcagcctcccaaggtgctggaactacaggcgtgagccaccacacctggcctttttgaaccatttttaagtgtagagttcagtgacatttaatacattcacgttgtgtacaactatcatcattattcatctctagaactttttcatcaccccacattgaaaactgtgtaccccattaaataataactctgtttctctctcccctcagcctctggtaaccactagtctaattcccgtctctatgaatttgactattctacgtaccttttataaatgcaatcatacaatatttattattttatgtctggctcgtttcacttagtataatatcttcaggttcatccatgttgtagcatgtgtcaaaatttctttcctttttaaggctaaataatattccattgtatgtatgtatacacacacagcacacatacacacacacacagcacacacataccacattttgtttatccatttttttatttgtgaacacttaggtggtttccacttttggctgttgtgaataatgttgctatgaacattgatgtacagatatctatagtagaagtatctgctttcagttcttttgggtatatatccagaagtggaataagtggatcatatgataattcagtgtttaattttttgaggaaccactgtactgtgccctacaatggcagcaccattttacatttctacaagcaatgcacaaagtttccaatttctctacatccttgccaacacatgttattttcttattttcttgctttctctgtttttgataatagtcatcctattgggtatgaagtggtatctcattgtggttttgatttgcatttccctgattattagtgatattgactgcatatgtaattttataagatattgccaaatccctctctaaaaggaaatgttgcattcttttttttttgtttgttagttaagcaattattttattgctcaagtacatagacaaatttatgcaaccagggcagaggctgtatatgattcatatttccagttgggagagaggactcacttggtcttataatatcgagccaaacagtgaatccggctctctatcagaatcagacagaatttagcatcctcatcctttctcttcctctcaagaagcttttgaacagcaactgctgccttaattaaatggtagagatcttcagggagattaggagcggtcccttagacttaagaattcttaagattttattgcctgtcacaaatcgtacttgtgcagcatcatgtgaatctctcaggatcccaccgatttgtgaaggagtcaggcccttcttggccagtttttaaatctgctccttcatgtcgtcagatgtcaacttcagcccctacttcagcaaccccacttcagtggggatgctgcagcgatagagcaaagctgactgagacagacccttcccagaagcgtgcatgtgacccatgatggcagctgtcaggcagcaaaaggaacattcttactaacgatgcatgagtacctatttcttcatagcctttcttaacagcatatatagtcacaattttaaatttttatcagatagatgagaagtggtatttcagtatagttttaatttcagtttgtttgtttgtttatttatttattatctttgagacggagtctcgctctgtcgcccaggctggggtgcaatgggacgatctcggctcactgcaacctccatctcccacgttgaactagttctcccaccttagcctcctatagctgggactataggtgtgcgccaccacacccagccaattttttgtatttttagtagagatgacgtcttgccatgttggccaggttggttttgaactactgacctctagtgatccacctgcctcagcctcccaaggtgctgggattacaggcctgagccactatgcccaaccttgttttacaattatgaatgacattgaacgtctttttcaaaactcacatataataaaattcacatttttggtatgttatattatgagatatgattttccattaattgttaagagttttttaaaattagtgatgatagccttttatctgaggtaaatgttgcaaataattttattccaattttttaatggtcttggcttagtttaaggtatttgccatgcataaaatttttatttttctatagtcaaatttatcaattttttttctttaattgtgtctagattttgggtaatagaaaacctttttctacacctaggttttagaggaattaccagtattgtctctttttttaaaaaaaaaaaagtctcgctctctcatgcaggctggagtgcagtgacgcagtcagggttcactgtgtgtatccttgacctcttaggctcaagtgaccctcccaccttagcctcccaagtagctgggactacaggtgcgtgtcaccacacccaactaatttttatgttttttgtagagatggggtttcatcatgttgccccagctgattttggactcctgagctcaagtgatccgcccaccttgtcctcccaaagtgctgggattacagatgtgagccactgcgccctgatttcttattttatattttgattcctgatacatttggagtttatttttatatgtgatgtaagatatgtatcttattttatgttttccacattactgatgatttgttctagcaccatttatttagttcatctctgtcctaatagtttagctttcacttttatcatagactagatttccatgagcacttggctgtgtttttggacttttctgttctgtgttcttacagcatttgaacagtttttatgttcctttctataggagggtctaaatagtgattattagtgatttcagagacaaattttttaacaattagatttaagaccacagttcttgatataggtttactgttaagttcccttccattcttaaaatatacagccagattgagccctgatatgaggaagtaggagaggtgctgtgggttatatggatctagtaatggcctttaaaaaatttaaacaagcaaaataagaactaacttttacctcaaagggcagattttgcttgtggagtggtatgtccacaattacgtgtgtgatccttcttattcagtatggagacaatttttagaaatggaaatatccttttaaaaaatgtatagtgtctcttttcagtttaaagtttttagattgtgttcatttttccttttcccttttttctccttacacacatagaaattgatgtcttgtgtttgtcctttaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcaggtaagaaataattggcagtagggtggggttggggaagattatactactcctaaatcacatgctttgtgcccttttcatgttaatattcgtatgactattattcattggactattagcatccctggctgtgttctgctttgtacctgcactgggaagactatgtgtttgttcgggatacaattaacatttcaggaatgcattttggggttatatttttaatacaacatatcttttttccttttcggcagggtgctaaagtgttatgtggtggagatatatatgtacctgaagatcccaaattaaaggatggatattacatgagaccttgtgtattaagtatgtcctctttttgtttgcttttagatgatttgaattaaatactgaatagatagagatgaatatttataaaatatgtacatgatataaagcaagggctggcaaattatgtggtcctactacccaagtttaagaagtagaactgctccattatctttgaagccttctgtgtgcccctcctttagggcacccatatgtattagtttatccaggaccacaactattgttctggaagcaaggagctcaaaaatatgaaagtgcatatttgattaaaaaaattaataaatttaattccttgagaaaataaagaatgtttttcatgtgacctgtagatcattgtattagacattttgcattgctatgaaggaatatctaagactgggtaagtagaaaagatgtttatttggctcatggttctgcagactgtacaggaagcatggcaccatcatctcctcctgttgaggcctcaggaagatttcagtcatggtggaaggtgaaaggggagcagacgagtcacatggtgaaagagagagcaagagaggcaccaggctcttttaaacagccagctctgtgtgaactcacagagtgagaatgcactcattaccatggggaggacatcaaaccgttcatgagggatttgccccgtgacccaaacacctcccactaggctctacctccaacaatggggatcatacttcaacatgagatttggaggagaaaggcatccagaccatatcagtcatcaatataataaaaccagtatgtcagataatatactaatctttttagaaattacataatttaataatttttagcacctccattcagtcttaaaaatctagttttgacagtcaaggtgtatatgggcatcctactcccacccatctacttccctcctacttcagaggtaactactattctcagtgttgtttttatcattcttatgcttttctctatcattttatagtgtatgttagtatcccctacaaaaatgttgatagttttgtaggctttaaacaattatatgtaggttgaaccatgttgtataattccttacatcttatttggagataaattaagctggtttttgcccctaaggttaatagtggtgtcagtttttaacaacttcatatttgatgcagtatataacctttaatcctcactagaaagaaccattgacatttaaaagctgaaaacctaatgtccatcccccatgaattaggttgcagttattacatgaatatttaataaataggaaaagcttacaatacattgttaaattaaaaatattggggctaggtgcagtggaacacccccagcactttgggaggctgaggcaggaggatcgctggagcccaggtgtttgagaccagactgggcaacatagtgagacccgatcttcaaaaaattagctgggggtggtggtgcacactgtggtcccagctgctcaggaggttttattttaatgtttgcagctaattgcagagacgacatgacctgtgtgaaggaagagatctttgggcctgttatgtccattttatcatttgacactgaagctgaggttctagaaagagccaatgataccacttttggactagcagctggcgtctttaccaggtatgtggagtgggacactgagagcagttttgaaggagcggggctgcagtatctgcttagatatttaattgatcctattctctcactttagtttgccctcataggagccatcagcactttctgtttgcttcaggttaagtcagaagacaccaaagcagcattttgcagtttgctgtaaatggccagagaaccctgctattgagttttaaattgagctcgtttaataaacacttaagattctgatctatgtaaagcattgggttagatgtcttttgaaaacacacatgtcaaggaatttagaaacctgtaagtatataaattgtgggcagtattcttcaaaaacatgatttttagtggcattatagtagttcctaattggaatgcattataactcatgtagccattttttctgtggttggatatttgggatattgtttctattttaaatattatagtaatatgattaatatctttgtgcataaactttactattacaagtaaaaatgatttgggagtacaatttctttgaaaccaattgcagattgcttggttttatacaaactttgattagtctttggcagtagaaggcagtttgctaaagcggctttacacttgggattatgctgtttctttggtgatacataaagttcacatttttttttttataacttcatggtcaagagcttgggaagaaagcccaagtctcacttgaggacctgatgtaattgcttctctttgagctccgaagaaaagattgaggagctgctcttttgatttggggagtgagcaggttaagtgctcttactttactttgccaccctcgtacagacaaagtccggttacaaaggcgggtaactccaatgtgctattctttttttcttaccagctttactgggataatgcacatactgtacaattcacccacttaaagtgtacaattcagtggttttagtttattcatggagttgtgcaaccatcaccataatctatttttaggacactttcatcatctcaagaagaaaccttgtgcccattaactgttgctcttcattcccactccccacccccagcccctggcatccactaaactactttctatctccatggatttgcccattctgaacattttatataaatggaatcatacagtatatattcttttgtgactggcttctttcacttagcataatgttttcaaggttcatttgtgttgtggcatttatcagtactttattcccaaataatattccgtggtatggatatgtaccactttttgttcgtccattcatctgttacaggcatttgggttgttttcatttttggctattatgaataatgatgctatgaacatatgtgtacaggcctttgtgtggacatatattttcgtttctgttgggtgtatatctagtagtgaattgctgggtaacatggtaactttatgtttaactttttgaggaactgctaaactcttccaaattcgcagcaccattttacattcctccgaacaacgtatgaaggttctaatttgtccacatcctcaccagcccttgttattgtctgtccttctggttttagccatccttgtgggtgtgaagtagtatctcattgtggtttttatttgcatttctgtgggttttcttttcactttcttgatagtcttatttgtagcacaaaattttaaattttgaccaattctaattctgttttttttatctgttacttttggtgtcatagtctaagaaatctttccctgacccacggtcatgaagatttattcctctgttttcttcaaagagttttatagttctcagtctgacatttttaggtctgtgatgcgtttaagttaatttttgtgtatggtgtaagaaagggctccacctttattttttgcatgtagatatccacttgtttcagcaccatttgttaaaaagactgtttttcctccattgaattttggtacccttattgctgttacttattttaaagataccatgtgcatgggactataaaacccaatccatatctgttttgcctggatgataaaagattttaaaacattttgaagaaatgagaatttagtaagatttgagaaccctagaactggcagtgtaacttttcctgttaaagtagtagcctaagaaactctcaataatgcacacattttttttttcttcatagggacatccaacgggctcatagagtggtagctgagcttcaggctgggacgtgcttcattaacaactataacgtcagcccagtggagttgccctttggtggatataagaagtcaggtgaggagctgggaggtgtgaatgcaaactaggtctctagagctaggtcgtaattcagaccttataaaccagtattcctaaacctgtctgcatatctgaattacctggggaaatacaggttcctggtccttccccagatccactgtagcagtctctgggaatggaagtcaagcatcttcccctacccaacactccctaaatctttctggagggttctgatgtatagcctggcttgtgaactgctgatagatatctcaaaaaggtttatcttgtgggtagaatactttttcttcacagcctgtgacttctgtaagcataaaatcactcccttaggggttctgtatcagggatgtccatcatcatccactgtggagtttttagattccatttaggtaaagtgtctttcaagtaatagctcagtaactttgtttcctctgttatgtcaaattaacaaaatctttaaatttatcattaagcaatcaattataatcgttttcattacccttgatggcatataggagtgtgtttccttagccactgctcattcatttcattcattttatagtcagacatatgttaccacaacatataaatttgtaagtctggtatatcaggagaaggtttgaggcatcaggagtatagccagaaccttgaggttctttctttggagtttgttgcctgtaaatattcatttacatatttctcatgctgttcttctagagtgaaaattggtttggactttgtcgaggcaccattctaagagtctgacctctagtttctgtggcaaatatttacagccatcacagtgttggcaaatatataaactctgatgaacactgatgagatggtgggtgttaatttgacagtcttatttgtcccggtggggtactcagaggagtcgtacacacaggcacaagtgcaggtgggaaccaaggtgccatcttattaacatgtaacatataacattacatgttaagtttctgatagtccctcagtgcagggaattatttgtttggaatcagcagcttaggcctttggagggcctcctaactttccctttcctttggaccagaccatgctatgtggaatgagagagcgagaaagatggccagacgtgcagagcaacacctggcctaacaggcctgaccagctgtgtgcttaggggatttggaaaggaacaaaagacagagtgaggttttcccaggacctttgtgtgtgataccatttgagtggtgctccctggaaatgcacatatttgggacctcggccttgcccttggaaggcagagcctacctaagtctagcacagggtgtacaggcagggccaagggtgggatactacccttttagcacagtaacctcacccactagtaattgggcagtgtcttgaactctgagtaatcagagggaccttcagtgacccctcaccaacatgagtgggtaggttaagttactaggttgctcttataggtgtttaagaaatggtgaataagcctattgtgtaaagttttaaattagcatcagctttcaagggtgtcaggttgattattgtagagattgcctttaacacttgatataaaatccaagcatttttcagacctcaacccagaatagtagatacctgaaattaagattcctattggtgagaaacaagatctgtatatttccctatccctatccccaaatgccagtgggtcattttccccatgcctagctccattcacagctaatatgtggattgaggctttattccaaaacatttaggttctatattcttccctagccctgattagcagtgctcatctttgaagatcattgtgacttttcagactattgtagtgatggctcaacctgaccccttctcctcctttcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattcgataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgttttcctatcgtgttttgaaactaaacgtatcttgaggttatgggaggacagaggatagggctgatgttagaagcacaaagcagggggatttgatcttgtagtaagaacaaaagaacaggtttggttgcagtgatgaactttatggtccaggtaagcatttaggctccatgttcattctcacccggataagcagtgcctgtccctgaagagttgtcaggtcactgtggcttttcagactattgcagtcatgcctcactctgcctccttctcttcctttcaggagaagagtttataaatcatagctaatttagtagtcagagataagggatgcttgttgtcactgggcctggatctaattatgtattatgatgagcaagtactgtagttttagagcataagaacaaccaaatcagcctttcttggtatttctttgcacagaggacacatatgtgatactggacaaagccaatagcgttaccctgtgtccaaggggatcctatgcaccttaagcagtaggagctgcctgggagaagataagtttctgatagtccctctaaagcaagcttgtccaatccgcagcccacagtccatatgcagcccaggacagctttgaatgcagccaaacacaaatttgtaaactttcttaaaacgtgggtttttttttttttttggcaatatttttttcttttagctcatcgactgtcgttaatgttagtgtattttatgtgtggcccaagacaattcttcttcttccagcgtggcccagggaagccaaacgattggacacctctgcaagagaaaacagcaggggaaagggaagcaacatttaagtactcactgttcctactgctacattccttctcatttaatacactaagcctaagaaagggattatctctgattttcaaatgaagaaacagatttggagacatcttggtcccaggcaagtgtgatattttgtgcctatatataaaattatatatcttttcatccatggttcctggctcataagtcccttggtacggttttttgttacaatgttggggcactttaggcctcagaaaacagaatgtccctctctgcccttctgccctcctttttacctgcccaaggctgggctctaatcttccaccacttttctgattatgggtcataagaccttcatttcagaaggggtcctgcctgctgccctgcaggaaaaatgccgcacaagccaggaatctgaagacccttgctgggtttccccgctcagcctcctttgtattagatcatacccctttagtccagtcacatttctacatggtgtctgtgcttcagtcatgcctctctaatgaagtctaagaggcccaagaggacgggcttcagggagctcctggagagctgaacatgtggaggtttataggagggtgaataagaacatgtgcatgtgccaggaaggtggtgcaccccaactccacgggaacagaggctcctgtgcttgggacccttgcagacctggccgtatgtatcccttcatttagttgtttatttgtgtcctttaaaatactctttttttttcccccagaaacagggtctcactccatcatctggggtctcgctctgtcatgtcactgaactaaagtagagtggtgtgatcatagctcactgcagcctcgaccttcctgggttcgagtgaacctcccacctctcagcctccccagtagctgggactacaggcatgtgccaccaggcctagctaatttttgtgttttctgtagagaaagggtttcaccattttgcccaggctggtcttgaactcctgggctcaagtgatcctccaacctcagcctcccaaagcactgggattacaggcatgagccactgcacctggcctaggatattctttttaataaactagtaaatgcatgtctcagttctgtgagtcactgtagcgaattaaccgaccctcaacttgaagccagttgatcaagttccagaagcctggacttgcagttggttggggtcacgggcagtcttgtgggactgagccctcaacctgtgggatctgatgctatctccaggtagatagtgtcagaattgaactggaggatgcccagctggtgtccactgcagaactgatttgcctgcttggtgtgtgaacagaaaactccaacatttggtcacagaagtcttctgtgttgattgttgtatgagagcagaggaaaaacagtttgtcttccacatcagcaagtctataagttgactggcaacttcaagccaggtgtgagtctccaattcctgtgctttctgctaccctctctgtttcctggaactgaacccagtatattagtttcctatgcttgctgtaacaaattaccaccaacttagcagcttaaaacaacacaaacttattatcttacagttctggaagtcagaagtcccaaaatggtttcacttggccaaaaccaagaagttgtcagggccacactccttgaagaggctgtaggagagaatccttttccagcttctagagcggcattccttgcattcttttgctcgtgtccccttcctcttagatgccagcagcttagcatcttcagaatctctccctgccctgctgccttcttctctgtgtagtcaaacttccctttgcctccctcttagaagaacacttaaaggacatttagggcccacacctataatctcagcagtttgggaggccaaggtgggagaattgcttgaggctaggagtttgagaccagcctgggcaacatagtaagaccccatctctacaaataaaaaaaaaggagtgtggcggcccacgtgtagtcccagctactcgggaggctgaggcaggaggaacacttgagcccaggagtttgagttgcagtgagctaggatcatgccactgcactcagcttgggcaacagggtgagaccttgtctccaaaaacagaaatgaagactctcaattccctcctcagacctatgaatctgaatctgcattttaataagatcctcaggtgactcataagcacaagagtctctcaagcactgcttttacagcaatggttctccactttcactgcacattagaattgcccagtgagagctttaaaaataccaagattctcatttaattgatctgggcatctggattttttttttttttttttttttttgagatggagtttctctcttttccctcttgttgcccaggctggagtgcaatggcacattggcggctcactgcaacctccgcctcctggattcaagcgattttcctgtctcagcctcccgagtagctgggattacaggcatgcgcccccacacccagctaattttgtatattttgtatttttagtagagacaaggtttttctatgttcgtcaggctggtctggaactcctgacctcaggtgatccacctgcctcagcctcccaaagtgctgagattacaggcatgaaccaccgcacccggcctggactcctaaaaggcacccagatgagcttaacagacagccaaggttgaaaactgctgctttaagagctgtgctatccaagtatagtagccttagccatatgtatgtacttacatttaaattaattaaaaattcaactcatcagttgctgtagccacattcagctcagccacacatgggtaggggttatactttattggacagtgcagacagaatatttccatcatgtcagaaggttctgttggatagtgctgcttaagagggaaggaactgagactactcagttttttattaagttaggagagcacctttggaggcgagtgctattagggatgaaatagaaagctgggcaaactctgtgggtccttagaacataaagaagataacccggttgctgacttttgctgaacaagctacatcagcagttggctctcgtgcttcctaccacaatttgtgtggctacaagacccctggtaggcactgtgcatgcattattgtttgatcctcatgaactttatatgataaaagtattttcatattcccaacttacagctgtgtaagctgaggcttagggaggctaataagcttgcccaagggcacacaggcacctgaaggtgggaatacttaaggttcactatggatcaattaggcatttataggctggtatggctgtctgattttcatctagcaaaattcagaatgtgtttcccttatacaaataaatggactctttggaatgtacactgccaacagattagtattaaatagttaatggtagaaacacttatgccaagtttttctccacaagacaagggactagcttgtaagagttattctctaagcagtctttaccaactggttctgccaagccctagggttccctggaagtgcagtgagtggggaagtagggcactgaaaggcagagctctcggttctgcacttcaaccacagcgccctttatgtaccgagcttccttacaaaactccatctgaacccagtgcgcaatagcaaaatgacaaactgggatcacattacggacgctcaacttatgatggggctacatcctgagaaacccagcacacgttgaaaatattgtaagttgaaattgcatttcatacacctaacctactgaacatcatagcttagcctagtgaccttaaacatgctccgaacacttacattagctgacagttgagcaaaaccatctgacacaaagcctcttttataatgaagtgttgaatatctcatatgacttattgaatactgaaagtcaaaaacagaatgattgtattggtactcaaagtacgatttctactgaatgaatattgcttttttttttttttttttttgagacagtcttgctctgtcactcacactggagtgcagtggtgtgatctcggctcactacatgttccgcctcctgggttcaagcgattcccctgactcagcctcccaagtagctgggattacaggcatgcaccaccatacccagctaatttttgtatctttagtagagatggggtttcatcattttggccaggttagtctcgaactcctgacctcaggtgatctgcccgcctcagcctcccaaagagctgggattacagccatgagccaccatgcccagcctgagtcttgcttttgcaccatcgtaatgttgaaaaattgttaagttgaactgtcataagttggggaccatctgtagtttgaaaagtacaccctgttaagacttttaaaggtgaaaagccagcttcatctccaggtcttccctgccctgcttcactgatgcctgctgttctctgcagtgagaaaggaaacctcggcaagttctctggcctctctagatgtgtttcttatgaagcaaaaaccaaaaccctgtcttattgtaaattctcaattatatcattttttcaagccaggaccaaaaatccctaccattcatcgtcaccatcatttcataaagaacattttaatgtaaaaagtacaagtcaaagctttatgaaaaacagtccctcattttccttattttgctctccactggtgaaactttctcatgaactaacactggagtgtgtgctaaactggtccagcctcctcatcaaatgccccaagggctccaggtggccatttggccaaggctgaccatcttcaatggctggccatggcattctatccttaaatgcttcatcttcggagcttaagcaataaactggtacaatggaaaatgcatggattttagagtcaggactgggttcaaatactgtctctcatcctcacaggctattgagcatttgaaaaatgggtagtgcaactgaagaactgcttttttatttaaattaatttaaatttagatggccacatgtggccaattgggcagcgcaggtctagacactatatttcctattaaggtagtttatggccacatcagtgttttggagtaactatctcattctgccaacttggcagtgttctctaaaccaactgaaatcttctaagtcttcctcatttgtacgtaggcaatcagatctttgtttctaaatgtagcaagttacattcatctctgttaaccttcatcttacatttagtctattgcttcagtttttaagcaacagaaacaatctttaatagaaacttaatttttatttatttgagacagggtcttgctctgtcacccacgctggagtgcagcagtgtgatcataactcactgcagccttgacatcctgggctcaagtgatcctcccaccttagcctcccaagtagctgggactgcagacatgtgccatcatgcctggctaactgttgtatatttttttgtagagatggggttttgctatgttgcccaggctggtcttgatcttttaggctcaagcattcctttggccttggagtatctgtagcaagtgataatgcatatcctgagagctagaagatttttctttaatttttcatcactgtggcatgactatacctacatcaccacaatcagactttttctcaacctcacatactacagaagcatctgctggaagggtgaggagagggcacaatacttgtggctcctttctcatctagtaggactaggctactgatttcagatacagactcaaacggaaatgagtggtaagagtcaggagttttaggtatgaggctgatgccaggtaagtttttattatatttagaaaaaaaatgtaactggaaataaaggtaagtcatttaaaatgaatgagagtttttaaacccctataattctttaatggcagcatttgggtccactgcccaagccacttttaacccaaccaagatgctggaaagcagagcacacagttgtgcccaccaagcccaggagggcgatggaccccagggctcctcgactacgcttgctgggttctgaaaaagaagaaagaacagaagttaccaggagtgctccagaattatgatgctttcaacattcgcaagccattctatcatcgcatctgaggttgtacattagacaaactggccttaggaggttaactaactctttagcctgaagctgttggcaagtcagataccacatgccaagtaacgtgccacagtagtattgcttggatcttagaaaattatgggataataattacagcaactttgctctaggacctttggaaggagttccctctgtttcaaagaagtacagctaaaaatggcttttcctcctccttactcagatatagcaggtatagtaatggtgaggctctggagtcggactgcatgggtttgattcctagtttactagtttacgcttagtagctctgtgacctagagctttaatcatgctgagtcccagtttcctaatttgtaaaatgcaataatatctgtattacagaattgttgtaaggttaaataacatatgcaaagttcttagagtagtggttggcacatagaaaatgctcaataaaaataagtttcgttacaattgaaagattaataaaaagaaaacagacctttcacctaaatatcaagtgacttccccttttctcaaattcccaagaagaaaaatatagtagcataagattttatttttttttgagataggatcttgctctgtctcccaggctggagtgtagtagtgtaatcatggttcacagcagcctgaaacttctgggctgaagcaatcctcccgcctcagcctcccaagtagctggaactacaggtgtgcaccaccacatctggctaatttttgtattttttgtagagacagggtttcaccatgttgcccaggctggtatccaactcctgagctcaagcaatctgcctgccttggcctcccaaagtgctgggattacaggtgtaagccactgtgcctggccagcataggatttaaaattttaaagttgtttccttggcaaatgtcaatatatactaacctcccgtgtaatagccataagcataaagaactcgtccaacaatccaggccaagcccaggccagaagctatacgctaagaaaaaagggctacattagtatttgcatgaaagaaacaagcaaaccttttttaacacctaaggttgattacacaatatgttagcaaaaagttaacaatttcatgatttggccaactactccccacccaaattaggtagaattaagttagtttcagcaggaaaataaaatatctgtgattcttctatgaatggcttggcttgtggacctgggagatgagtattggccttctagacaggtgggatagaaggaatccccccacttgccctgggcatcttggggaacttgtgtcagagcaagagaaggacatgtgggccagccggtctcagggcaggccagaaaagagaactgccccaaagtcaggactaggggaaatgccgttttctcaaatgggtctctgagcatgagattgactgaagactcagctgctgttctatgtgaagtcagtcactggcagggctgggctcaggtggttctgcaggctacactgggggtgtagctccactagaaagaaggggagcgcttctcccagaatacatggtcttcgagggaaaagtctccctgttcccaatgtccttgagaagagagaataaaaacttagatgaaaaatccatccctttggctgtcatgctggggtgacttccttggttaaaataagcaaggagagaacacagaagacagcatgtgagaaggccgccttccccagtgtctttcccactcagcagtgctactgttagggataaggttactgcatcagggtttttgtttgtttgagttgattttgggtaacattaaatgtcaacaggagggtgaaacaaatgaaaataacaccagtccctcaagtcacgatatagcagctctagtctctgccaggcccttctttactataatgttgcctaatgactggcaacctaggaacaattgttaggtgcttgtccccaaactagctcttatttttcagaactacccataaggaatgggatccagggatgtgtgataggaatggggatggagtggggacaccaaatgaggactaatctagagacctgagctattcagatcagctagtctagtcacttgctaggaatggggatctttagaggcaccagaaagatacattttctaagagatacaagagcagtagatgtttctttgaaaaaaatgcaggccttcaaggtcataagcagtagatatgccattctggcagctttttaacaaaagtacaaggcattcaggatgaaccagatggttaggaaaggcttagaaccagaagtctgaagggccactctggtcagaacttggtttcaggagataatctgtcctcagaaaaggggaacacttctgtctaagacaagacccaaatggcaattaattagaggctgataaacttgctttatttagatatgtttaagtgcagactaaatctccatcccacagggctatctatactgcagaggcctgcaagtccccagtgacctgcctcatcacccctctgccctctgttgctgcccctctcctggctccattggcttctcactgctcaccaaacaaaccagacaggtgcctgcctcaggccttgcttgtcttctggctggaggttggggaaactcgtgcagcacctgctccctcacctccttttatacttgcttaactatcatctcagcaaagcccccctccctgaccaccctattcaaaattatcccactccacatcccctttccaccttccccactttgttttcttctctgcactcaccacctcctaacacatgatgtaatttacttaggttgcttcttctctgtgaccaccccacaccccacaacaaaaaggcaagctctatgaaaccaggggtctttgtctgctttgatcactgctttaccccaggtggtgagtgaaagtttgttgtgtgaatgaattactataacaaatgaactcttatagacatgaaacttagaaccagacagacctgagttcaaattctaatccttctactctgtagctatttgaccttgtgaagtttaaatagtatatgagaggcttttccttatctgtaaaatatgaggaaaatcccatctcctttaaagaactctgtaagaaataattgaataaaatccttttaaatatgcagtgcctagacactgaagatattcattaaatgtttatttccttcttctgtgcctgataatagctcagtgaactactatccaaatagatgaacacctcctggaaaacttaccgggtggtaaacacctccaacagctagaaaaaataagaagggaggatacacttccaacctggaattgacagaaagaaacttttaaaaagtgccctttttaagtatgcctgtgtagaattatgaatttttttttttttttttttgagacggagtgtctctgtcacccaggctggaatgcagtggcatgatctcagctcactgcaacctccgcctcccgggttcaagtaattctcatgcctcagcttcctgagtagctgggattacaggtgcgtgccaccatgcctggctaagttttgtagagatggggttttgccatgttgaccaagcttgtctccaactcctgacctcaagtgatccacccacctcggcctcccaaagtgctgggattacaggtgtgagcccacctcacccagccagcactatgaatctttacatcttccttgccaagttagaagcttgggggtaaaaataaacattcaccgcagggagaagacctggtcactatcatccaccctcctttgctctgcatgggattagaggtcacttggaacatgctgagtaaaaggacctcacatctaacaaatggaagtggaaggtcctggtgagtcagagtgggtttccttacagcattcaaaacctcttcactccctaggcctgggagagtcaacatcggtttagatgggtcatgctgcaaaactgtagtaggtaatgcaaccatgaagacattttttgaaaagaatatcccgaaatcccaccattccaaccactcttaagtttgcttaatagtcaatgtgttcacatacataatttttgaatacttttaatgaggtgcccatgattgtcaccatcactatgactcagcaaatacagcgcactaagggctgaggtgttagacagaaaacacccactctgcagatgtctttggtgcccggcagggccgacactcacgtgttctggtgggctcgctgaatgcagttgaagatgtgcccattttcagggtccgtgctgtacatgataggatactgtcacaacaaagcacatactgatcagatggtcaagaggagcattcagtgttgaaagttaaaatgaaccttaaaaacaatatattccaaagtatcttctttcacacccttgatagatgaccattcaatttctgcttaaatatttatggtgacaagggtctcaattctcagaagcagagtcaatgtttctattaaatatccaggaataagaatgtatgtctgcgctgtagttgcacaagggaaagaggcagctttgcgccaaactccgtgcttttcattgacgttaagcatcaatggtggatttcagatgcattacaaagatactgtagggaaatagagccttcctaagagtcatcaaataccacatccttttaagatttcccttaatagaagaacagaaattgagtgtgtgagaatcttaatggaagtgtccactggaagggaaaaaaaagaagaaactaaatataaaaacttaaaagaagctctagtaagggagtttaattattaagttgctaaacagaaacagacatttaaaaccactcaccagggacaactttggtaattatcccttctagatcacctaaaactaaaggaagtgtttaatagaccaccttcctatgtctaagtccaggctaatctcaacaccacatacctcttttctacttggaaaacaggaaaatcaccataagacatcatttttaaagtggcacaccatgaaacaatattgctatttaaccctctgtggaaaatacagtaactctcttcctagcaaatagctccaagcagaagtgtactattggaatcccagcattcctggtctttctaccgaagagacaaagtcaaacaagatggaaactactccctagcagggccctgtatttcttgcctctttcctaccatgaagaagcagaatcgctaacacagtcctgaaactgccacttctcacaactagctccttgcctctccctccatggctgaaaataagttcttggctaagcctgtggcccccagacaagcctacaagggcaccagcttgtgttcccacttacctccactttgtacttcttgcgggccttggaaacattgatggctaggtgggccaccattataaagctggcagcaccagttagaagcacaaaaccatattccttagagaggacagccatcttgcgtctgtggaagaaagaacacgttgggacggcccccagcactgtggctatttcatggtgtgaagccttagggagcaagatgctttattactggcaaatgagtaaatagagaccaaaaaaaggtatgaatcaatctgatgtttctgagaagtcatcaaagacagtaccatataaaataatttaaaaattactcaactatgcagtctatacacagaaaagtatacagtcatgtatctttttttctcttttgtgcctgggagattctgatcaacattatgagatttatctacaccactgcagtagtcgttgctgtagaataatatagccaacaaaaatcacattattgaaaaaatatttaacatggtaaaatgctaaagtatacattacatagggagggggagggagggagtgagaggagcaggacatggtggggagagggatggagagggagagagagggagtggggagggaggagagggagagagagagagagagaaagcaagaaagtgagaaagcaagaaagcgagcatccaaaatagtatatgcacagtgattccaagttttttgccttcagacatgggggacactgtgagggcaggactctgaggcctcccttcgatcctggggcacgtgcgggtgcagcagcagacatctcacacaggtaggggaaggcccaggttgagtactctgaaagcagagcatggctcctgagcctatgaggctttgggcagctcctgaggaactcagattgcccatcaaatcatcacttcaaaggcttccacgagccagcagctctggtgtgtgttctgccgtcagctttaaaatttccatccctggtaattgcctggcttcagtccctgcttttaacctaggagagttaccctgatctggaatgtatctaatcatcctaacaaaccaaccaacaagatggtaaatccttattttcaaaagaggttaagtaatgtttccaaggtctaaaacagacagtgacagacctgggattcccattcagattcatttggttccaatattccctttcagtatcccttgaaactttagagccaaactgacactgtggtcagagcatcttccttaaaacagaatttgggataggcatgcagctcagttcattaaaagtaagtttctcttagcacagcaaaataggcctaactgcttttttttttttgagatggagtttcactcttgtcgcccgggctggagtgcagtggcacgatctcggctcactgcaacctccatctcccgggttcaagtgattctcctgcctcagcctcccaagtagctgggattacagatgcgcaccaccacacccagctaatttttgtatttttagtagaaacgaggttttgccatgttggccaggctattcttgaactcctgagctcagatgatccacccacctcggcctcccaaagtgctgggattacaggtgtgagccaccgcacccagcctaacaggcctaacttcttaaaacccctcctccccaccatgattcacaataattctcatcagttttccccttctaccgtcttcactctgagctgctctctgaggcatgcccgctgcccctccgggggctggggggcacacactgcagcgggctggttccacaggtcagcagatcctggcctgtctgtgcagctgcagagagcaaggagtctctggcttccctccaagcttccttgcccacattctcttcccaagtgtagaaagtcagcatgaggaggaagccacagtagttattaaaagaaaaacagagtgtgaattctgaacacctctttgaaaataaataaaaatgactgaacctccagcctatccttaaattcaacacatctggggcaaacaggtcatttaaaataaagctgccacctaagcatggtggctcacacctacagtcccaacaatttgggaggccaaggtggaaggaacacttgaggccaggcagcctgggccacacagggagactctcatgtctactcaggaggctgaagtgggaggatcacctgagcccaggaggctgaggctgtagtgagctatgattgcaccacctcactgcagcatggggcaacagagcaagaccttgccttaaaaaaaaaaaaaggtgtctctcagaagcaataaatgtaaggacaataaaattaagcatatttgctttaggttaaagtttgcaaatcagtagagtgagctttcagactctaatctttggacaggatgctgggctccctggctatgtgcagggctaccttgtgtcagcccagcacttttcagctcacttttactcttcacaaaactcctattagctccactttatagaaaaggaaatagaggctcagtaaatgagggcagagctaagaccagagcaggttttagaattctcccccaaaacactccagctagcccaggtaacacattcaaatttggtggcttagtcactgacttctatttttcttaattttaagaggctagggtaggtagatggcaagataagagaagtgcctcttgcatagatgcctgtcacagcaaagcaactgctctacaatccacagttagaatctataattacaaattaatatttactactgagctcctcttttaaagtataaatgcaatctgtgaggttaaacttgatgggcatttgcaccctagtgaaagttactctcctcacactttgttaaggtatgtatggcgttatgaatctggatgatgacaagcagagccagcaacagttaggaccttggaaaggcagtgaattcacagtaagggtacccagagtctgatgctacagcagtggtttgcagaggatgcatactcagtcatagggacagtgcaagtgcctggggcagcagcgtgactgttctccctgagggtcccccgcacgagccatggacacgtctgcataggtgcaggagcaatgcctgaaaagctgcctgcgagaagggcagcagaacagccctccctgatacctccttgcactcctaccaagtgaggtgtcctgctttatacaccataacaaccttcacttaaaacagagcaggaccacgtttgtctggcatcttccatgtcaagcacagtgtgcacgctcatagatacttacggaataaatgatttgagctgcaactgcaggtgtctttcagaatgaccaccaccacgcaccccgtcccctgaatacacacctgaaataatctctatcatctggcacagtgtctggtataaagtatgcatctaaccaattcaggtttccgtttcttccctcaatatctattgaaaccagggaagaaactgaatgtatttaagaaagactggtttatgactaatccagaaagagaaatcttaagaaagaagaattcagaacacagagaaaactcttgtcgtagttgtggaaaacataaatgcaatagggagtgaaaaatcattaaatcttctctttcaaagaaagaatcagcttaattaaatcaacattcaaaaaaactatcatttgctacatcattattttctgaagattccaaggcgaagagatagatattcccactccttagagagtgacttttgtgtgtgcgggtgtgcaccaggaaggggatgcagctcagttcacagtggccacaccctaggcagtcgcagccacaccctgggttgtgccagccccagaggtagcagatagcttccagggacagggtggaagaactgatagctggcacccaaccaatctctggcatgagcactcatttgaaccgcagaccacattttgctgattatatacctactctgtgtcaccagaaaccctttcatgaacccaacaagataaagttcttgagagtgggaactttgcccttgactttctcttctacgtagtgctagatacacacagtccaaacagtcctttctgagctgaactttaatacaggtgtagatgactttgcaattcacttggttatatcgtagcatttgttaatcattatgcagtttcctgggttagtcataaaccagcagtataaattaatatttatgaattgaaaccttctaccacatgcagccatgcgtttcagtgatggactgcatatttaacaatggccccataagactgtaatggagctgaaacattcctattg

SEQ ID NO: 11851 - DNA, 71278 bp, Human
  misc_feature (1)...(71278): n = A,T,C or G
gcaacagagggagactccaaagagtcgaaaagaaaagaaaagatttaaataagctgaaacatattctatggatcagaagacttaatattgttaaagtgacaatattccccaaattgatctacagcttcaactcaacccctatcaaaatcctagcttgctttttggctgaaattgacaagctgattctataatttatatggaatctcaaaggatccagaataaccaaaacaatattgaaaaataaagaacagcgttggtggattaacattttccaatttcaaaacttactatagcactgcggtaatcaagcagtgtggcactgtatagcatgtacattacagatcagtggactagaatcaatgtccagaaataaaccgttatgtttataatgaattactttttaataaggtgtcaagacaacgcaatgggaaaagaataatgaattcaacaaatgatgcatggacaaccggacatgcacatgcaacacaatgaatttgaattcttctatcgctccatgcataaaaactaactcaaaatgggtcacggatgtaaatgaaaagctaaaactataataatcctagaggaaaacctaggagtaaatctttaagatgttattgtaggcagtggtttctcagataggaccccaaaatcacaagcgacaaaagaaattggacttaaagttaaatacttttgtgcttcaaacatcatcaagaaagtgaaaacacaacccgcagaagcaataaaaatgtctgtaagtcatgtatccgattagagacttctatccaggatatataaataatgcaattcaatgataaaaaagataaatagcccagttttccaaagagtcaagcatctgaatatacatctctccaaaaatatacagatatccaacaagcatgtgaaaagatgttcaaagccatttgccaggtgcacaaacccaagacagtatgaggagatgctacagggactctgctgcttcacagacatgaagcgttggtgagaatgtaggcagccgcctttggggacttcacatccccgccgccccacgcacggtgagctagtgtttaaacttagccgagatcaatacacgcgactgtgtgcccgtcagaccctgcgctgccggcggggctgggagaggcgggcgccaggagtgggcgggaacctgggggtcaggccccagccgcgggaagccgcccaggagcgcgcgaaaccttctccacacccttccaggcatttgcccgccgcgattcagagagccgacccgtgacccctggcctcccctagacagccccgcatgtccagatgtgccgtcccgcctgcctcccgcgaccactggccatctctgggcctgggcgcggtctcggcgcccgcctgcccccgccaggagccgcaggtccagccagtgaagaagcccgcgctgaaggagcctctgtgctccagaatccatcctcagtatcagcgctggggtggcctcctccaggaagcccttctgattctctcatgggtcgctcttcctctgcagactcccggagcacccctgctccaagtaccgcaagtggcactgagaacttggggagagcagaggctgtgcctagatttgtagggagtccccgcagctccaccccagggcctacaggagcctggccttgggcgaagccgaggcaggcaggcagggcaaagggtggaagcaattcaggagagaacgagtgaacgaatggatgaggggtggcagccgaggttgccccagtcccctggctgcaggaacagacacctcgctgaggagagacccaggagcgaggcccctgccccgcccgaggcgaggtcccgcccagtcggcgccgcgtgaagagtgggagagaagtactgcgggggcgggggcgggggcgggggcgggggcgggggcagccgggagcctggagccagaccggggcggggccgggaccggggccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtgagcgcgggcggggcacgggtggagcgcgggctgaggtgcgtccgggacccggtttggacggcagaggcctgggcgggggcgccgagggcccgtcggggcggcccggacaggactgggggtgtccaggaccctgtcagggcgggcagaactgcggtggggcgtgccctgggctcccagtggccggtgggtaccctggtgggcaagcgtccaggacccctcgcggcggccgcgacccctgtcggaaacggagacttcccgcgtgccgcctgcaaggcgtcttccctgggaggagaaggcccaaggtttcccctccacttcaagatctgggctccgaggctccggagcccccttcactgggccgcgtttcttgtgccacctcttccttaggctccttctgcaggtcgcacagggagggagaggcagatgagtcatgctcacagaactctgagggcacctcggagcagccagctgtgagccgtggggaagggtgcacgtcagcgggtccagaggcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagtccccagaggaaattaaagggaaggaacagaacccaggccaggagaggcttttcctaaatggaggggctgcactccctcccagcagaatgtacaccagggaacacttccacgctaggtgtgaggacgcgagggagccctcagcatttggaagctagttcctaatgctgatctggacctgaattccagccccacgactcttttccatgagcatgggcaggtcgcagttctcactgagcctttaatgaagtgcctaatccagtacctggcacagaggaagcgctccgtaaatgactggtaatagtcccagacatactgcaggtgcgcagggaatatcagttcccttccaccccaccccagctcctaactggaccaaaaagatttagactttaccaagctgccttctcaccatttagtttattatttgatcaaaccttgtgaaattgctcataatggacaaatacaaccggcaagttcatgtttcaactgattactcttggataaaatttgtgttttaggtgtgcagagcctaaagtaagtaaaaactactctttttctggattccaagctctccatgggctcgattcctatccaggagcccataccctcgctgtagcacgacatggccctcagccaagttcactagcatcctggcttgagctcccttcaagaagagttaggtgttgagtacaagagcaaccttcagttgcttagttgccccagtcggggaactgaccctgaggactgcggtgccctggagttaatgtgtcgtccatttagggtgatggcaccctctgccatttctgacgcaccttcatttacttccattatttcatggattccccacacctgggggagaaggacagggtacaggctacttcccctttgtaagtgcttcctcctccccattctcctccacacatcataaggttctagaagcacaggccattggtgtgctcacactgcacagcacgggcaccccgtgtgtgctttccccctgcaggggacatgataacgtggccatagcgggctcttcggacaaagagtgaaggcactgttttgtccactatctccctctctcttcccctaccctgtctgtcttcccctaccctgagaagtcattcaaatgacattataattaaacacctcagccggaatcccaggggcaaatttcaggagagatttgcatgtcacatttccattgggttgagagggctataagtcaggggtggggcggggggtggttgggggtgggggctaccgcagggtggggaaccagctaaggctgaaagtttccttgaaaaaatcagcttttgagaaagttcctgttgatgcaaagttactcaacactttctcttgcccagcccagaactacttcctcattctcccagcttggtatctgtaaagacaatcatcctttttgggtaaaggtaaaagagaaaccctagaggaagtacttgctgagaagacaaggttatcccattttacagggaaaagtgttaaaatctgtattgttaacagtagtaacgataacaataacaataaaggtatttccacacaatttaatcatttccaagttattggcaggtcaacacccccctcctccagggcatagttcagtcaaataatggacaggactgattttttccttgataaagtgagtcacaggtcccttgttattctcatcagagttccgcatagtgattcagtcaggactgggaatcaagtccttcgcaggtgggattatcctataaacggttgtgtcttccttggctcctcactgtctgctggagaaagccgggatcctacacagaatggccctgtttccagaggctaacccaagtctaggcaaatttaacaagttgatttatttctttaactctgtaaatttaaagtaattcagatcggatacgataactgtaacagatctgaagatttctgagaaatcttagttggcccatttcattctgtgctggtacttttaagaaagctaagggcaatagcgtggtgtttaatatatgatacttgaatatgttcaacaagtgtagaaaagtgttataatgattcatgcttcttaagtcagtgagtattcttacattcatgaaaaattaattctagaatacctccttcttgtgaatgggaatatattagtggagcataaatatttctttggtatgaccctcaatccgtctctcatctcccagtctccccctctgagccatcttttccctacattctgccccctcttctgcctcctcttccttcccctgctcccagttccctaaatgccccccgtttctgctctctaccctacaactctcccttcttttttgctctgaattttcctctacactctgtcttccagccacctctcagaggccccttctctgctccctcaatctccggctctctgtcccacattttcccccttctctgccccttggtctccctatccactaccccaatccctctctccgtcccttgttttcctcagctcttccccatagcctccccctctctcatcccgagtctctgttttgtctggcccccaatcttcctctctgctctacagcttcctcctcccacagcccctcattagtccccctccaagatgggtagtctgggggtggggcacacatccttgcttccgcagagagatccgtctccctgtcccagcaacagcagagatctgatgaaagacagatgaaaactttcctaaaatgctgatagaaagctcacatgaaaactgaccaactgactctttgccgaaatattcaaaagctttaaaactacatatccaataaaaagttaaaagcaacaagcaaaatcagcaaagtggccccttgtgaaatgaggccggtgagttgcaggtttcccttgtttctctccagcatctgcaccaccacgccacccacttctgtccccagaaactgtgtccagccttcctcctcccacgtgtgaatcccccggggaccctgccctcccagttccccacatctgaaatgtgctacccatgcccatcctcctactcatctgccctctgaaatctgatcagcccctaaaagctgcctgaaataccctcttatgaagcttttccctgtccttccatgccactccacattgcccctttacactccatccagggtacaaaccagggctcaaagctgggccttctagcttccggttcagggcttttctcaagatgtggccttggggaactgtgggaggaacctgggcttggccatcacacaggtgtaggttctgatcttgaggccaccattgctctctgagcctcagtttctatctgtaaagcaggataatcactcgctcggccattcccaggcccagtgcttcctgagggcctgttggggggtgtccactgttgatagtgcccaccataattcagtgtgtcacctgagaatttaatgtgtcacagcaaatagacaaatatagcatcagcccagtgtacttggcccagagaggagggaggaaggtggccattgtagttccacaaaccttccgaagatattttgcagtttgacacatgtgaccctggtattttcctggaaggaggcctttatctgtcattcttccattagtggcccctgggatgttagaaccacagccatcaagctttgtcttttactccctgagttgggtcaaggctggagccctctgccccttgttcacctcttatcatattcaggcttgaagccagcaccaggaaagtggctgggctggccatagaccagccagactgcaggcctggccccctcctgctgtggaagtccctgtcagatggcagatggagtccttgtaaatctgcctagtgatttcaccccaagtgaaactcaggggctctccaccaggtgcctgcaggtgtaggtagggcagggggccaggagtgtcccagtcccctgtgactgcaccacaggtgtgctggagggtcaccccactgtccactccctcagagaagctgctcagtctcttcgtgtgggtcgtcacccccaggtagacatcgggccctccctgtgggacctgcccagtcctggaatgcctcctcagcccatctccctcccctcttagtccaaggtactgggagcctccctcccatgagagtgtccctgttagctcctcccaccccaccccagctttcctgtcatctatcccctggggacaccttcctccctctccagcccctcagagccataggaaagctacttcccctgcagcagccacactcagaccaggcccgggcctctggtggccgcccctcagtcctcaccgcacacagacttgctctgcctgccccaccagcattcagaatgcctcccactctccctctgtcctcacagccctgtctccagcctttcaggagttccttctgggctttgagtgaaggagtttgaggtcacaggttcagtttcctcctcccatgtgtgctccagttactcggattggcacatgtagtcacgaagtggccgtgacgcaggggcccatgctagctcacaggcggtgtggggcctggtgccctgcaaccccctggattcaggaaggggcactggtggttctgatgcacacaaccggtggcctgtgcctctggagaaaggaggccacccaggatggtgtcatttcattttctcaatggtcctgcaagtgaggggtatctcctttgggtagatgaagaaacagcttcagagaatgaagcaatgtgcccaggccatccagctacttgcctgaagctgggatgtgaattcagagctccagaccccagggcccaccgagccttctacccctcactgccctctccccactcctcggtgggatcaggaatctctgtcttggctcacaacctgcagctaaggcctctgtaaatccctgtggcatgcagggcctggcgtggggcaggcccgacgcgtatccagtcctgggccactcagcccccactctgctcctccagatgggcccgagcccctgagatgctgagactcctgtcccatcagaacctgcccaccctgtccatgatgggcgaggccttgtgtgtggccctgctctcctgaggacaagctgtggcaggaaggctttctcagaggtggcagatgaggctgatactctccctgcaggaggggcattgtcgtggggccgaggctggtccacatgtggctggacccaagacatgtcatcccaccacatgggcctggctcctctgtcatcagaaactgttcctagggcctctggcctagactacagagcacagggaggaagcttccgctttctgaccacaagcgtctggcctcagcgtcagccaccccaaactgctcacggtattcagagccaggaggtttgtggaaaacactcaagttcccattcctcttaggaagccctccaggggtcctcctggcagcttggaggcagggcatggaatggggatgcctgcgctcgcacaaaggatgatacccctcgccccttccactttgccatcatgctgagaactctaggttctgccgccagggataaagttcaagggttgatgaatctggcttagaaagtgccttgcaggggccaggcacagtggctcatgcctgtaatcccagcactttgggagaccgaggcaggtggatcacttgaggtcaggagtttgagaccagcctggccaacatggtgaaaccctgtctctactgaaaatacaaaacttaaccagatgtggtggcaggtgcctgtagtcccagctacttgggagactgaggcaggagaatcacttgaaccctggaagtggaggttgcagtgagccgagatcgagccactgcactccagcctgagcaacacagtgagactccacctcaaaataaaaaagaacatgccttggagggcatcgagtccggggctttccaaacctgctggtcatcagaatgcgtgatgcaatgcctgagcctctcatcccaacttcctgtctgccatccattgctgcagagacaaaagccctccagaagctatggctgttgcctcagagccgcctgtgtcctggaagcaggagcctggcagggagggggccaagcagccttgtcccagaggcctgggcagctgcgctgtacacagcctggggtggtgccttctagctgcaaggctagcctcaccctgccaccagtaatgccacaggtgcagcagagctgcttggtctcactgttctctgggcatcaccatgcagctgtgaactgcaaatgtcccaggacgactcgaatccatgcaagctccctgtatctaagcctcaccattttcactcacttattatccccactgaaaactggaaagagaggaagtggctatgatggaaagacctggggtgtgactccagctctgctggcaagtggcagaggtgggagtcactgagcctcgctgtcttcatctgtggaaggggtggtaactcccctgcactcccagagtcattgtggggatccactgtcagcaagcccatctccagttgtaaaggtctcccacaaggctatcccatgtgggggcagctgcggaccctcactgggcacagcctcgcaggtgcaggcatgagcctgggcatctccccatcctccagcctgagctaagtgcagtcagcaggcgttgccctctgagcagcacagcaccatcctggctcactggattctctctcctcaagggcagggcccaggatttgtccatttctttcacctgcctgggtcgtagcactgagccttgtcaggggcaggccttcagtgaatgtcttggctaaatgaattcaggagttcatttaaggtgttcatgaagaatcttggctccatgaactgtagtggaggcaaaactccacctcttcccatttcagctaggtctgagaatcggcataagacagattcatgggcgaaagcctacagatttctttaatacaagttgtacgtggcatgggagccctcttaaaaagatgaagaccccaagaagcagttagagtcaatcccccttagatactgcattgaatgaatcatcgtgagatgtgataaggccaaggggcttgggctagggcaggtaactgggcagggaagtgactcgggaggtaagcgttcattgtacaagatctgtttgtatggatttcctttggcttcaacttcccaaccttgatgaaaagagtgttactttccttttggtatagtgaggacatctttcataggggactttcatctcctgcttctaagaaacagcacgaatgtcagagtatcttgcacctgctgtttttttaagtgcttttcattcaacgtagtccctgtgccacagcagcataccttggggtgacaaattcttaacacctccagaacaaaggctcaggagaccacgcatggcctgattgcctgttctccttcccaggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcggtgagcagctcaggccccttctgccccgggcttcccaagaaccgaaagttcttcctgtcctcaaagcactgtagtcataggaggaatgacactgctgtgcaggggcgggaagtgggagggctctgccctgtgcctcgacacacctgcaggaggcatgactttccttgggattcttacaagcccctgagggtggagcgggtggccccaggcctcactgtcgtcatgtcctcactctgcgctacagttctacaggggagggttgtgcccctctttttgtcagtgggtaactagggtccatacaggcagatacctatgggacatgcccctggatgggcacttctctagttgccagggtgtggcatcactttctagttcatagcctgccctccgtgagatcacagtagggctcaggcaagctcagggtgccccatgtgggcctagggagggaaggggtggacaaggagcaccccaagtgccagctctgaggagccatggacaagcctgcaaatcacagttaccagttcttcaacccgaagtctcacctttcgctgaaagaaagaagaacctcaaatctgttccccttactaagatgcccagatgtgcagaccccagttaggaggccattctttgttagggacacacagctgacctggtacagagcatcagagacggacgcaggcgtcaaggtcagccaaggctccctgaatgaaccaccttgcatacccagcctcctagtgtgcctggcaaaatcctacctcacttcgagtcataacccttcagcttgctctcagtttaaacctggaaagataagccttcaaaggccaggcagccaccgtaataagagaaagccactgcttctgccatgacagcgtcaaactctttctctttgccaagtttcctgtagctagtgtgttcttcacgaagtttggtggggtaggtaggaagagatgactgttacccccattttatagctaagaaaactgagacaaaggagaaaaaagttattctgtacctgctgttcttaagctaccaggccacatcccatcgtttctgatgtggaatttgacttaagaaaccaaatttccagaatatttctgaacatggagttaagaggatttttgtccccctacctaatgacaggaaaaaaaatcacaaagttcatttattcctgtggtcaacagaatgtggaaggttgtggacagggcacttctctttttctggtagttagaaaatgctggctctgaaactccctcctgcacatctacccaaggtctcggttatgaagcccttcttcctgcagacccttcagctcatcttggcaaaaaacagatggtacactaggatgagggtttaacaaaggggcatcacaaaggtgtgggcccatgtgcagagggaccatgcagagtgcggggccatcagcaccactagtcctgatgcagggggagggggaaggttgtgggagtaatgcagaagtatcctggagacagcacccttggaggagctgcggccctcagtagaaaggttctggggagtgattggcctctccttcctctacacattccctcctttctggtcagagttcccagtggaaaacccattgaggcatctcattccaatcactttcagggacagcacaggttggagggtgagcatagagaagctgtccagcaagttccattctctctactgctgtaaaaccaacctccttggtaactttaaacagccatttaattttgttcatgctcttgcaggtcaggaatttaggaaaggcttcactgggcagttcatctgtggccatgtagcatcagctgaagggggctgggccttcttctgtcatgtgtctggcacctctaggctccttggcctctctgtccatatggagtctcattctttaaggcttctcacagaatggtgtcctctgggtgcttgcatttcttacatgatggctggcttccaagagcaagttttctaagagacagaaagtggaagctgccaatctcttcaggcttgggcctggaaactggcacactgtaacttccatcatattctactggtccaagcagtcacagagcccacccagactccgggggtgggggtggggatgcagacccccccatctctcaatggaaggaatgtcaaagaatttgtggcctattattattattattattattattttgggacagagtctcactctattgcccaagctggagggcagtggcacgatctcagcccactgcaacctctgcctcccaggttcaagcgattctcctgcctcagcctcctagggagcttggtttacaggctccaggtagccaccaagcctggctaatttttgtatttttactagagaaagggttttgccatgttggccaggctagtctggaactcctgacctcaggtgatccacccggctcggcctcccaaagtgctgggattacagtcatgagctaccatgtccagctgtggccaattattaatccaccacatggcaaaacaaccaatcccttgaacaacctggaaatgaggggggccagcctacaagtgattcaattactcaccatatgatcaccccttaaatctaatatttcaccactacaccttgggtgaacatgaatgtcagagggccattactgtggccccacagatccagagcatctgtgtgaagggacagcttcattaaggcactgtgtcagtccttggaacctgccctgctgagctcttctgccgtcagtccaggctttctcatcctgctgtgctcccagaacttcatcagccattggataaattcttcaaacaccttcgggaccaggggagacagaactattctctttttgaaacttggcatgttgcaattccgcatgtactgacttattcataccagtgaaactgaagagatccagctcctcagagtcaaggtgcccaagagattagctggttccttaaggtagataagagatgatgaatgttgagtgcctccagaattacccccatagccaatgataacagttattgtcaccattaatactcagcttgccttctgtggcctcaagcctcccctcctggctggctttacatccccaggggaggatgcagaggtatcccgttaatattcctttttggaccccagttccaagctcaaggatgaagatgtctcagcctggaagtgctgtcgggtggacagctcagaatgtggcctgagtgtcatctgagaactaactgcgtccaggtctgcaattagatcagtacagaggttgaagcctatagttccagcactttgggtggctaaggcgggaggattgtttgagtctaggattttgtcacaagcctgggcaatgtagagagaccccatctctacaaaaaaaattgaaaattagctaggggccgaggcgggtggatcacaaggtcaggagatcgagaccatcctggctaacacagtaaaaccccgtctctactaaaaatacaaaaaattagctggatgtggtggtgggcaactgtagtcccagctacttgggaggctgaggcaggagaatggcgtgaacctgggaagtggagcttgcagtgagctgagatcatgccactgtaccccagcctgggcaacagagcaagactctgtctcaaaaaaaaaaaaaaaattagccaggtgtggtggtgtgtgcctatagtcccaactacttaggaggctgaggttggggaatcacttgagtcctgaagttcaaggctgcagggagctatgatcatgccactgcactctagcctgggagacagagggagaccctgtctcttaaaaaaaataaaaataaaataaatacaaaataaaatacaaagactcagaggaggggttttagaaacttttatagcaacttaacagaacaattttgtgacttttgcacctaataagaaaaaaaaagacttggattttgaatatctttgggtttttaaaatttcatttttctagtaattaatttttattatattttacaaaaatataataatctgtgttgaaaagtaagttttaaaacacaatgctttaccacgagagctagagaaactattccaggacctgttttcaggagatctgggctccccctattcacagctctatgggctgcgttcacaggcttggccttaagcaatagtttaaagagtggtcatgatatgacctcatctgctctaaaggctctgagaagcagccccgcccttagctacctgctacctgctccaactcctgcagtgagagacggcagcaggacaggctgagagataagatgctctcagagctaggcttagagggaggagcagaaccctcaggccagtgatgactataggcataatgataatgatcattgttcccatccattggcatttactgcgtgccaggcgccgtgtggagggctttcctgcattctctccccaaatgcacaccatgacccggagaagtaggcattatcatctccattttacatgtgagggggtcagggcaactcttggtcacacagcttcagtgacagagcccaagtccaagcacatgtgtctcttctaaagccatctaggacactgcactcttttagaatggagctcattctcaatcctctgtgtaggcacgacagggaaccgggttgtgtcatcgtcacacatttctccatgaaacaatgaaatggacttagaaacataagagctgtgagaactgctgctctcacaggcaacactaaaacccagagtgaactcccgtttttgctcagtataagaatttcagagaagaggagtaaactattctgcagtgatttaaagatacccaccaagggccacgaaatgcctttctcctggagcaaaaaggcagctctgcaccaggggcccttaggtccctgaagagtcttgaggggctgagtggaaggttaggacctcaagtggaaatgcacacgcaggccagagttaggcatgtactgtgcctgccaagcccagtgagaaccaagcctggctcttgcatctgaacatgattctctaagcactgaaaggcaggggccccaaggcttgctgagtgagtgggcaagaggatgaggaactggatttggcttttgtaaagtgagtggctaagagcacaggagttgagttttatgttgaaaattcactaattcagactggttccaagatggccgaataggaacagctccagtctacagctcccaacatgagcaatgcagaagatgggtgatttctgcatttccaactgaggcactgggttcatctcactggggattgttggacagtgggggcaggacagtgggggcagcccattgagtgtgagcatcacctcacctgggaagtgcaaggagtcagggaattccctttcctagccaagggaagtggtgacggacagcacctggaaaattgggtcactcccaccctaatactgtacttttccaacagtcttagcaaacagcataccaggagattatatcccatgtctggctcggagggtcccatgcccacagagccttgctcattgccagcaagctcgaactgggtggagcccatcgcagctcaggaaggcctgccagcctctgtagactccacctctgggggcaggtcatagccgaacaaaaggcagcagaaacctctgcagacttaaatgtccctgtctgacagctttgaagtgactagtggttcacccaacatggaatttgagatctgagaagggacagactgccccctcaagtggctccctgaccccagagtagcctaactgggaggcaccctccagtaggggcagactgacaccccacatggccaggtacacctctgagacaaagcttccagaggagcaatcaggcagcaacatttgctgttcagcaatattcgctgttctgcagcctctgctgctgatactcgggcaaacagggtctggagtggacctctagcaaacatcaacaaacctgcagctgagggtcctgactgttagaaggaaaactaacaaacagaaagggacatccacaccaccaaaaaccccatctgtacgtcaccatcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgcagccaacagacacatgaaaaaatgctcatcatcactggccatcagtagaaatgcaaatcaaaaccataatgatataccatctcacaccagttacaatggcaatcattaaaaagtcaggaaacaacaggtgctggagagggtgtggagaaataggaacacttttacactgttggtgggactgtaaactagttcaacctttgtggaagacactgtggcaattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccatcaatgatagactgaattaagaaaatgtggcacatatacaccatggaatactatgcagccataaaaaaggatgaattcatgtcctttgtagggacatggatgaagctggaaatcacccttctcagcaaactatcgcaaggacaaaaaaacaaacactgcatgttctcactcataggtgggaattgaacaatgagaacacttggacacaggaaggggaacatcacacaccaaggtctgtcatggggtgggggtaagggggagggatagcattaggagatataactaatgtaaatgacgagttaatgggtgcagcacaccaacatgacacatgtatacatatgtaacaaacctgcacgttgtgcacatgtatcctagaacttaaagtagaattaaaaaaaaaaaaagaaaattcactaattaggtgtgtgaccttgggtaaagttcaagagcaaagctacacaacttccctaagcctcagtttcttcatcattaattggggaagtgctctgaggctcaaatgaggtcatgcacataaagcactcggcatgggcagggcatctgagggaagcctgaacacttggcattgggcattgttattgttcttcctcaggctcctctcatgttgttctttctttacagcaaagttggcccgagatgaccaaattcacattctcaagcaacaccgacgtaaagaactggaaacacggcaaaaacaatatcggtgagttatgacatcagatcgagtggccacggggccatggtttcttctatctcaagagcatggtatgaaataaaccctttccacagtgtatggcctgtcactgctggaaagtcaccaaggcaccagctcccagtgtgggtgcacaatccccaaacttcaccttacctacaactccagacaagagatggagaggagagtaatgaaaataactttggatcaaccatattggcatgtaggaagaatgggcagaaaagcttgagtgtaccttaatgttctccattgtaggggttgcctcttacttcttatgtcttcttataacaattcaattataaaagtgatacatgatcagcaataaaattgacaactcttcagccaactgaccagaggattcaaaccattaaaatgagcaataagagaaaatcaatacagaaattaaaatgaataaaaaaggaaaaatgagactcataaaatgagggaaaatcaatacagaaattaaaattaataaaaaagaatactatgaacaattgcatgccaacaaactagttaaatgaaatgcgcaaattcctagaaagacgcaaactgccaaaactgactcatgaagaaatagttaatctgaataaaacaatcacaaccaaagagattgaattactaattctaaaatttcccacaaatagaagcccagacccagatagcttcactggctaattctatcaaacatttaaagaattaatactgatcttgcataaactcttttaagaaatagaaggaacacttcccaattcattgtctcatacccatattataccaaaactaaaggcatcacaagaaaactataaaccaatatcccttagcaatatagatataaacattttcaacgaaatactagcaaacctaacccagaagtatataaaaggcattaaacaatatgaacatgtgggatttagcccaggaatgcaaagttggtttaacatccaaaaatcaattaattgaattcaccatatcaatagagtaaataacaaaacaaaacaaagtacataatcatttcaatagacatacaaaaaaggcatttgacaaaatccaacacccattcatgataaaacactcaaaaaataggaattgaagaaaatgtcctcaacctgataaaggtttgaaaattcacaattaggctgggcgtggtggttcacacctgtaatcccagcactttgggaggccaaggcgggtggatcacgatgtcaagagattgagaccatcctggccaacatggtgaaaccccgtctatactaaaatacaaaaagtagctgtgtgtggtggcatgcgcctgtagtcccagctactcaggaggctgaggcaggagaatcacttgaacccagaaggcggaggttgcagtgagctgagatcatgccactgcactccagcatggtgacaagcaagactccgtccccccacatacacaaaaaaagaaaattcacagttaacattatacttaatgatgaaaggctgaatccagaaacaggataaagatgttcacttttgctacttctattcaacattgtactggagggtctagccagctcagttagggaataaaaagataagtaaaggcacccacaatggagtacagtaagtaaaactaccacaatttacaaataacatgatcttatatatagaaaatctgaaggcattcaccaaaagaaattattagaactaataaaccaccaagattgcaagatacaagataatcaattgtttttctatacattaacaaccaactatgtgaaataaaagtaagaaaaagttcaatttacaatagcatcaaaaacagtaaacatttatgaataaatttaacaaagtagtctgagacttgtacaatgaaactacaaaacattgtttaacattattaaagaagatctaaataggttgaaagacatttcatgttcatgaatcagaggacttaattttgttaaaatggcaataccccacaaattaatgtacacgttcaacacaacccttatcaaaattctagctgatttctttgcagaaattgacaagctgtcaattctgcaaattcatatggaaatggaagggacccagaatagccaaaacaatcttgataaaaagaaaacaaagatggaggacttgcacttctcaatatcaaaattactacacagctatagtattcaagacaatgtgatatcggcataaggatagatatatagatcaatgaaatagacttgagagtccagaaataagcccttacacttatggccaattaatttttgacagaagcagcaagacagtttaacagagaaagaatagtcttttcaacaaatggtcctagcaaaactggatagccacatgcaaaagaatgaagttggatccttagctcacaccatatacataaattaacacaaaatgagtcaaatacctacctaaatgtaagagctaaaactataaaactcttttaagaaaacacaggagtaaaccttcatgactttggatttgacaaaggactcttgatatgacaccaaaagcatcagcaacaaaagaaaaatagataaagtgataaagtgatgtcatcaaatttacaaacctttatgtttcaaaggacaccatcaagaaagtgaaaagatgaaccacagaatggaagaaatatttacaaattgtatatctgataagggccttccatccataatttataaagaactcttacaactcaataaagacaaatagtccaattaaaaaatgaaaaaaatgagtgaggatctgaatagatatttctccaaggacccattagtcatctaggaaatgcaaatcaacaccacaatgagataccacttgatactaggatggctagaataaaaaaatccgacaagaacaagtgttgacaaggatgtggagaaatcagaaccctcatacactgctggtgggaatgtaaaatggcacagctgcttgggaaacagtctgctagctcctgactgttcaacagagagttacaatatgacagcatttccactcttaagcatattcccaacagaaatggaaacatatgcccacacaaaaacttgtacatgcatgattatagcagcatgacctgtaactatcaaaaagtgtacacaacccaaacgtccattaatggatgaatggataaaatatagtatatctatataatttgaccatgaaagaagaatgaaatactgacacttgttacaacatggatgaatctcaaaaacattatgctaagtgaaagaaaccagtcacaaaagatcatatattgtatgattccttttatatgaaatttctggaaaagaaaaatctgtacagatataaagtagattactggttgcctaggggcagggaatgaggaagtggtcatgggagtgacagctaaaggatacagtgttccttttgccggggatgaaaatgttctaaaactgatggttgtccattgtgtaaaaattaatactaaacatccttgaattgaacactttaaatggataaattttacagtatgtgcattatatttcaataacgctgctagataaatttaaaaattaattcaaaatggatgatagatctaaaagtaagggctaacaacataacactcttggaagaaaacatacaagtaagtcttcataatcttgggttcggcaaagtctcttagatatggcaccaagagcacaggcagcaaaagaaagtagacaagttagatgtcattaaaatgtaaaagatctatgcttcaaaggacatcatcaataaagtgaaaagacaatccacagaatggagaaaatatctaaatcatatgtctgataagggacttgtatccagaatatataaagaactctgacaactcaattttaaaatattctgtacaaaaaaccccgtttaaaaattagcaaaggatttaattaaatagttctccagagaaaatttgtgaatctccaataagcacgtgaaaatatgctcaacattattaatcatcaggaaatttcaaatcaaaaccacaagatacaattctaaccactaaaatggttagaataaaaaagacagatagtaacaagtgctgccaaggatgtggagaaactggaaccctgatgctgctaccggaatgtaagatgatgcagccacttcagaaaacagtttagtggttcctcaaaatctgaaacccagctacaatatgacccagcaattctactcctaggcctctacccaagaatattgaaaccacatgtctatacaaaacttgtacacacatatttatagcaccattgttcacaatagtcaaaaagtagaaacaacctaaattccattaactgaggaatgaataaacaaaatatagtttatccatacaatgggatattttttggcatcaaaaaggaatgaatgccaagcgcggaggctcacacctgtaatcctagcactttgggaggttgagacgggcagatcacttgaggtcaggagtttgagaccaacctggccaacatggtgaaaccccatgtctacaaaaatacaaaaattagccgggcatgttggtgcacgcctgtaatcccagctgcttgggaggctaaggcaggagaatcacttgaacccgggaggcggaggttgcagtgagcctagatcccgccactgcactccagcctgggtgacagagcaagactccatttcaaaaaaagaaaagaaaagaaaagaaatgaactacagatagatgccaaacactgaatgaacttcaaaaatatgctaaatggaaaactcacttacggaagaccccatattgtgtgattctatctgtatgaaatgtccagaataggcaaacccacagagtcagattagtaggtgagtagttgcctagcactaggagttggggaggggaaacaaggagtgaatgttaatgggttcgaggtgtcctctggggatgagattatttcagaattgggttataatgatggttacacatacaactctgcaaatatattaaaatcttttgatagcatatttttaaggggtgaatttaatggtatgtaaatgtatctcagtaaagctttttggaagataataacacattacagagtgctcctctggaaatgggtggctgatgggctgtatccagcctctacaagtgtttgatggatcattattgacttatgagtaaacagagatattcttcaggcttccccagtccacacttgtctgttgtctatatcaaggttttctttcatttcatttcctgctttggcccctggaaacatttgagtctgtgcctccttccaagggaagaaagtggaaggaatcattctacatggacagtgaagttacctgggctgtggaggggcctttgggagccaatattgtgatacttttctacatatccctcaatagttgaacttcttacaaggaatatgtagtatatctgggttgtttttttaactcaaaaaagtaaaagaaggaaaataatatagagccagaaaaatacctattttctgtatgaattatgaattttatgaactttttcataaaaattcatgtttaattgttttcactttgtcttattcactttttaaaatttgggattgtgctatatataccactttgcatcctccttgctgccctttagcagtgtagcaaaaatcattttcccatattttcaaaatctcatcataaacattattctagtttctatgtactattccattggatggatgcctcatcattcacttaaacacccagcttccctggacatttaggaggtttctaatttttgtattcttataagcaaagtgaaaacccttgtatgtgaaatttgtatacattattaagtattttcctaggacagatgcccagatatgaaattaccaaatagtaaaagttattagtatacattgacaaatttctcctcaaaaatctttaaccatttgggaggctgaggtgggtggatcaccaggtcaggagatcgagaccatcctggctaacacggtgaaaccccgtctctactaaaaaatacaaaaaattagccgggcgtggtggcgggcgcctgtagtcccagctgctcgggaggctgaggcaagagaatggcgtgaacctgggaggcggagcttgcagtgagccgagattgcaccactgcactccagcctgggcgacagagcgagactccgtctcaaaaaaaaaaaaaaaaaaaaaatctttaaccagttttcacgagccatgtatgggtccctgtttcatcaaacacttgccataactgagcaatatcttcatttttcttaatttttctaagttgcaacagcatccctcaaccctgtagctccttcttcccctatgcccagccacccactgctgtcaaggggtgagaaatcccacaccaagaacacaattgccccacctcaaaactgtcttagcttcatcccccttttcatcaaaaacattccttgaaacagaataaagaaacaacaaacagccacacgtatgtgggtactgggtctgctacggagggctcggctgatgggtggcactgggccactggacatgcatctcgaggacaggggccagccagcacggagggctgaaggagaaggagaagaaatcagactccacctcttgccattcaggagactcagcttggggttgattagacttaaaagttaaaggcaaaactgtaagacatttagactacaggtgattattcttccaggtctcaagctaaaaggatttttcaaacaagactcagaacatattaaacacaaaggaaaagattggtaagtttgcctccctcaagataaggacactctgttcattgaaagacaccaggagagagtgaaggcaagtcatggagtgattgacgagaattattcctagtatgtgaaggacctacaaatctttaagaaggggagtgtcattcactagaaaatgggcaagaagtttgagtacttactgtacaaaatataagcagcaagtatacaaaaggtgttcaacttcattaggactcggggaaatcagaagatcacagtgaactgctgctactaccacacatatgcccccagatgggcaacacttcaacaactgacaacacctgagtattaaagaagatccagagggctgggaacactcatataccaccggcaggaggacaagttggtaagacctccgtggaaaacaatttagcaatatgtcataaaactgaagctacattataatctatgacccagaaatcctatagtgggatccaaatttgtgtgcatgtgcgcctggatactcacaacagcattactcatgatggccaaaaaatggcaacaactcaatgtccaacaaacagtagaacagacaaattgtcaaggaaaattctacactgcaaggaaaatcaacaaactgctgctaacatggacaaacctcactgacgcagtgttgaaggaaagaagccaggagcgtgtctggccaattcataactttggaatgaaattgtttagggaggtgtgtcatagcggaaccttaaacaataacaagaaaatgattatcataaagccgaggatggtcattaccggggatggaaggagggttgattgggaaaggtgggggtgagggtacggacaatgttctgattttttacctggatggtgttcgtacaggtgttttgtacatttttctgcatgtgtgagtgtgtgtgtgcatatatacatatccatacatattttatatattctatttcccaattgaaaaatcaaaaataaaacttacatgccattagcatcaagtgtgggagagtaacctgctgtgctgtgggtcatgttaagggtttataaatgtgtgatttgttttagagtatttgtgcacaagcctctcagctcaggcaccatatgatgtgtttccagacttccatacctggtgcagtgcacacgttgtgcttgagctctgcctcccatcccaaagggctgttgtttctatgcttcttccttggcttccctccctgtttcagacacctatggcaaagcccctgcagccagttctcagagcacttctggcctgtgaatctgggttaagataaaatgcccataaaattcatttaatttgttataagccactaacactttagtatgaattagtggggctctaattagactttgctatctactcatctaagataacacaaactagcccaattatctgggagctacttaacattatcataatcttgcagcagggggcttctggtgagatcgtttccccctttcttagatttaatcatttttttcttcctccttccactcatctgtccttttcagaaaccctcctttgcttccgttcaggaaacactgaactttgcactgtctgcacaatcttggagttcctctttctcagaagatttctcaggcttccagatcagagtttggaagtaaagcaatgactaagaatagtccacactatgtcagaaagctggcgcttcttgcaggccctccttactcactcagccacgcagggagaaggagaagcagacccaggtcatagcccacagcttgtgctctcccactgtgaccacatctgtctgtgttacatgcacactcacacacagcagtaaatggcaaagtgtaggtgtttgttaatcgatataatttaatctaatcattatgtgacctgcacttttcactcatcactaagtattgaagaggatctggttgacacagatagatgtggttcatgcagttaacttcttcatggcatatcagtatctgaataacccatgcgctcgtccgctctcctgctgatgggcaggcgggctgtctttaatttctagctgttgcaaaccaagcgacagtgagctttctcacacatctctctgtgctctcatggaagagttactgtagggaatattccaagaagtagagttgcagggttgcagaccacgtgtttttaagctttctagatattgctgattgttttccaaaggcattctgccagtagacaccccagtaactgtttctgagattcactgtttccctgcatcatcaacacttcgcatcttcagatgttttcattcttgcgtgtgaaatagtatctcatatattttccccttcttaaactgctactatttcttgccttctgggaatgcaccataatttacttagccattcccctattcactgacgttcagttcatttcccatttgtagatgtgtttgtttgttttgggtattgcagtacaaacaatgctgccagaaccaaccttgtacaaacatcttgatgtactggtgctttaattaatggcagatccatttccagaactcagattgctggaacaaatcagcattttttcatcttaagaaataccgacaaaaatcctttcacaaaattgtatcgtaatttgcggtcctaccagctgtgtatgaaaagatacttttgcccatccatacatttgtcagtacccgatgaccttgtttgacagtctaaaaatccctaagaccttgtggttgttttagtctgcactcccctgaccactaataagcatcactgcattgcctatttataagctttttttccctattgttctttcaattattaatctaaaggagctctttctatatcaggatagtatccgtttgttacatatgtatagcatttattatttgtcttctgttgcttttgccacaggagattttagttctttattttattaactatgtattgtttacatctataacttttgggtttcctcctttgcttaagaaaaccctttccatcccagtgttacacaaatacttcccccgtaattttgtctaatacttttataatttcccctttgagtttagagctttcattcatctacctttttttttttttttgagacagagtcttgctctgtttcctaggctggagtgcagtggcatgatcatggttcactgctgcctcaaactaacccaggctcaatccatcttcccacgtcagcctcccaagtagctggggctacaggcgtgcgccaccatgccccactcctgccacgtgttttcatacatacctgggtggaactctcccggtagcattcgttcctgacttggatgacagggatgatgtctttcctcctgacttggatgacagggatgatgatacccacggtacaagctggcataggatggcagtcatgagctctggattcgagtgtctgggctcaactcacacttactggcactttctccagtcctgtgaaagttgtttaatctgtctgtgcctcacttccctcatctgtaaaatgagggaaataacagtgccttccttttaggggtttgagataataggttaaaccatgaaaacacagagaatagtagtaggcacatagaaagcactggataagtgttggcgagttttgtattatgtatacatagtctctgggtctgtttccgcactttatgtgttagcctatttttctactcgagaccccagcaccagcttttggttatcataactttctaataaatgttaatgtctgttacatatctcactgttctttcttaagtttttcataatgagaattactttgaacttcacataactgtgttatgtgttggcattttactgagattcagtctttccatccaggaacacagcgtgtctttccacctctctagatcctgtgtcaacgtacttccatagaatttctagttttcttcatgcaggtccttcacctttctagctactctacatttagcatttgctgttctgagtaggatatttttctgtttgcaaaaatattgctgggataaatgtaaattacttgtttcttacatttactgtgtgttggtcccttactgaattctttcattggttctaatcacttgtttttgtttgtttgttgttagtgagtctggttagttaatgtgctcatattatctaaatgttaataattttgtctcttactttccattatctacaccactgatattcttttcttattccatgtctggaattcccaaaacaagtagtggtagtagtgatgaacatccctctcatatttttgtttctttgtttactattatatttgctgtagttttataatgcatattctttgctgtatttaggagtttattgattcattctaatttaatttttgttcagctgaacttgttcaattaatttcctcagaaggtccatgtgtagtgtaagatctgagtctgtgcttgtcgtcctgtccccctacccatcccctcaaacaaattcccctgccctcattgatgacaatatgagaggcttagatgacgatctaaaaaaagtgtgtatacacttcagtcttcccattttcagaatgacagaggagaaatctaatgatagtttgtttcttttcctagagtttctatctccctccctcccccactttcttcctctctcgttcactctctgcatctctttccttctctctgtctctgtttctcctgtctcttggacattttaaaatgtattcagtatatacctaggtgtatctttttcctttttttttttcccccccacctaggacttgtcattgagaaaaatgacgagacaagtctcaatcattttaggaaatttatttgcgaaagttaaggacgcatgcccgggagacagcactatgcctttctctgaaggtgattttgagggctccaaatttaaagggaaaagggcgggatattgagaagtacacaattttcatgtaagagcagggcagggaaaaatagttattcatgcctttctctggctcagtgaatctgcattttttttaacataagatgacataaacaaatgaggcagaggaaaaatgcagggagtctgcattttacataagagaacatagataaagtaaggcaggggaacaatcagatatgcatttgtatctggtgggtgactgcacttgtaaagataagctatcaatttgcattgccatggtgaaattttaacggttcactaggaatttccttgtgagcaaaatatggtggagacatgtagcttttcatcatagccatcttatttaggaaccaaaagggggaggcaggtttgcatgacacagttcccagcttgacatttccctttggctaaatgagtttggggtcctaaaatttaatttcctttcacagacttaagatattgaagtatttttcagcttaaaggagttcttcttttatttctttgatttttttcacttctccatatattactctctctccttttggagcttttactccttgcatattacatctgtatctggctttcatgtctgttaatgaaaagagtcacactctgtgaaatatttgaaaagacttattctgagccaaatatgagtgaccagtggcccatgatgcagccccaggagatcctgagaacatgcacccaaggtggttggggtacagcttgcttttgtgcattttagggagacataagacatcagtcaatacatgtaagatggacagtggtttggttttggaaaggtgggacaacttgggggaggggagcttccaggtcataggcagattcaaagagtttctgattggcaactgcttaaaagaattattatctaaaaacttggaatgtctaggttaagataaggggttgtggaaacaaagttttttatcatgcagatgaagcctccaggtagcaggcttcaggtagaatcaattgtaaatgtttcttatcaatcttaaagagtctgttctaatgggcttaacatctctgtgttgatgtgaatgctgatcagttgtgcctgaattccaagaggaggagagtacaatgaggcacgtttagccacccattcctatcatggcctgaactaatttttcaggttaactttggaatgcccttggccaaggggagggtccatcagtcagttcaggggcttagaattttatttttggtttatgtctctcatagtttcatttatggcttccatttctttgtagtttcaccctgtatttgggttacatgttcttctattttgcacaaagcacttcctggcacatagtaggtgctccataattagttgtcgaatgaacaccttctctcttctaggtgttaatgagtttagcttaaacttttctccttacatattttaaattcagcctaaaagtttctctgtacatagtgaactgtaacctaactggatgtgtaaacagactgtcacctactctcatagcaagtaaccaagtctcagccaatcacagcggccagacttcagccactcacagtggccagctgttcaaactgggctcaagtaaggcaaatgctgagccatcaccaatctggctgtttctgtacctcacttccattttctgtacatcacgttcctttttctgcccataaatcctatccaactatgagacagcatcaaagtcactcggagcctgctctggtttaggggctgccctattcttgaattgttctttgctcaattaaactgctaaatttaatttgtctaaagcttttcttttaatacaagagaccaaacatctcacagtgattattctctttgtctgtttctctattgaagtcttcattcagaaatcatgtttgtggttacagaaagtctttttacactccaattatactaactgcatccccttaggatctctctgtctgtctgtctctctctctctctctctctctctgtctctctgtctctcttgctttctctctctctctttctctctctctctctctctgtctctctgtctctcttgctttctctctctctctttctctctctctctcattttttttccaataaattaaatgcctttctacttctttgttccttctgcctgggtgttccacttggtcttcctcaatggagtgggattccatctccaccagttaatgtctgtggccatgcaggccttcggctcctgtgcaggtcagcctgtcagggtctcttaagcagcagtgacctgcagtggaagggacataaacatttggtttcaggggggcagtagtgaactagcaagcaagctgtcctgtctccatgtgctgtgaggccatcatcttctaaccacacaagtggggcatttctgcccattggtgctgccaccctccatagaccagggcagggcatggggcaagaaggtctttttggtgctgaagaagtattccacatccgtccaagtggactattcacttaagaaaacattaatgccatttgctggcacagatgcccttgcatggctcattgtttacatactgaaaaacatctagctccactgagcttttaaaattaactagagcccttgaactgtccaggcaaagagaaaatcatcagtaatatttaaattgatatgactaatgatagctaattaattgatcattactaccagtgaggctactgaatggctcaattttagatatatattggagatgccttgagtcattttccaaaacaaacaaacaaaaaatgtgtagacttgtccacatttttatccttgttaatatactatcattggcattaatacaaacagcaaaaatggaaggttttcttaaaatctgaggacgtagaatattctaaataaaccaacagtgagaaatgtaaggtgccacataacagaaaacacttgacaaaatgcctttgctgtcagaaggatcatacccggtccctgttcacttcttgtgatcctaaggagaggctactgggccaagaggacactgtgacagttgggatttggggaaagtcaaagcacaagatcatattaaaataactcaggacttttttaagacccaaaatctcgatattttactttcctctcaaaagaaaattttaaaaggaaggagaattaggaatataaatgaaaaagctaaaaccctaaaatgtaaaatctggtttttaaacaaacacaaaatcattctccctccccaaagaaactaacaggatttcattttgtttttgttaccagaaaggggtcctgatccagaccccaagagagagttcttggacctccacaggaaagaattcagggtgaatccataaagtgaaagcaagtttattaggaaagtaaagcaataaagaaaggctactccataggcaaggcagtagcatgggctactcgactgagcatacttacagtcacttcgtgatcatgtgctaaacaatgagtggattattcatgagttttccaggagaggggtgggcaattccaggaactgaaggttcctcccttttttagaccatatagggtaacttcctgacattactatggcatttgtaaactgtcatggcactggtgggagtttcttttagcatgctaatgcattataattagcatataatgagtggtgaggatgaacagaggtcactttcatcaccatcttagttttgttgggttttggccggcttctttaccacaacccattttatcagcaaggtctttctgccctgtatcttgcatcaatgtcctgtctcatcctgtgacttagaatgcctaacctcctgggaatgctgcccagtaggtctcagccttattttacccagcccctattcaagatggagttgctgtggttcaaacacctctgacattttcacaatttaagtttactcaataagtaaacaaaaaagcaaaataaacatttttcaaaaacacaaatgcccaatgccacgggatacgtttcaaggatgtcaggatctgagcatgtttactggatgcagtccgtggcttgtctttggggaagctgttttgattgtaataatctctaaagctgctattggccagcaggtgagagagggaagccttttagccatctgtgcctgggtccctctcccaggccacctgctgccgtgtcgtcctattgtgaaggcagaagaactgtcccatttccccaaatgccacatgcaggacatgcacgcagtccagggcacacactgatcaagttggcagaatggtggatgtccaggttgggcgtggctgggcagccttaataccttctacctccagtgactggcaaggcaggcctctactgttcaatgtcacctctagtaagtgaggtctccctagactacctacagaactttttatgcagtggtgcacacctgtaccactataagcccagtctcagggttcccactctgatgctcagggcacagcaaagttggtgcgactggactttggaagaggtcccagaaccttactggacacagggtcagcctatgatgtgttgactttattttgagtacatcaatctccctgtgtaacatcgtctgacagtgtgggcggccctcagctgagggggcagaccaaaggctggcatttaactcaatttcttctcctttctcatgctcagatggatggagtggaaccctggcttccccttgagcatcgatgccaaatgccacaaggatttaccccgtgatatccagtttgatagtgaaaaaggagtggactttgttctgaattactccaaagcgtaagtttacgagaactgagggactctgggcagcccctccagtggctggtgctgggggtggaaccctcactcctttcctcatggggtccttgggttgggggaacagcctagctgagccaaacgctttgatgatatgttggccatagagtggattctcaacgcacaattgcaggacaaccggtatcttaaaaaaggcataaccagaggactccagacaccagacatacatgtgtttttggcccaaagcaggggtctttagttggaatgcctcctccccatccatatctcatgctctctatggccacttcaaaggtgtgaaggctttgtgtccaggctgtcaccaagatggcaggtgctatggtaagaatggccaaattgccagtgctgatcccaggacatatgtcccctgttcctccgtcacaaccccacgagggagccacagtcatcatccccattttacagttgaggaactgaggaatacggaggttgactaccttccttgcctaaggcccccagctaataaatggcagagatataggttctgtgcacctttgtttcatccgaatgtccgcagggctttttaaagcttgcccaggctatcgggagactctaggctgcttgttaaacatatggatcccccgaccctatcccaggactactgagtgtagggatctttaaatctgcacattgaccctatagggaattttaaaaatcatgtcagtttggcgaaactattccaatcaatagaaaaagagggaatcctccctaactcattatatgaggccagcatcatcccgataccaaagcctggcagacacacaacaaacaaagagaattttagaccaatatccctgatgaacatcaatgcgaaaatcctcaataaaatactggcaaaccgaatccagcagtacatcagaaagcttatccaccatgatcaagtgggcttcatccctgggatggaaggctggttcaacatacgcaaatcaataaatgtaatctagcatataaacagaaccaatgacaaaaaacacatgattatctcaatagatgcagaaaaggcctttgacaaaattcaacaaccattcatgctgaaaactctcaataaattaggtattgatgggatgtatctcaaaataataagagctatttatgacagacccacagccaatatcatactgaaggagcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgtagatgacatgattttatatctagaaaaccccatcgtctcagcccaaaatctccttaagctgataaggaacttcagcaaagtctcaggatacaaaatcaatgtgcaaaaatcacaagcattcttatataccaataacagacagacagccaaatcatgagtgaactcccattcacaattgcttcaaagagaataaaatacctaggaatccaacttacaagggatgtgaaggacctcttcaaggagaactacaaaccactgctcaacaaaataaaagaggacacaaacaaatggaagaacattccatgctcatggataggaagaatcaatatcatgaaaatggccatactcccaaggtaatttatagatcaatgccatccccatcaaactaccaatgactttctgcacagaattgggaaaaactactttaaagttcatatggaaccaaaaaagagcccgcattgccaagacaatcctaagccaaaagaacagagctggaggcatcatgctacctgacttcaaaccatactacgaggctacagtaaccaaaacagcatggcactggtaccaaaacagacatatagaccaatggaacagaacagagccctcagaaataacaccacacatctacaaccatctgatctttgacaaacctgacaaaaacaagcaatggggaaaggattccctatttaataaatggtgctgggaaaactggctagccatatgtagaaagctgaagctggatcccttccttacaccttatacaaaaattaattcaagatggattaaatacttaaatgttagacctaaaaccataaaaaccctagaagaaaacctaggcaataccattcaggacataggcatgggcaaggacttcatgtctaaaacaccaaaagcaatggcaacaaaagccaaaatggacaaatgggatctaattaaactaaagagcttctgcacagcaaaagaaactaccatcagagtgaacaggcaacctacagaatgggaaaaaaattttgcaatctactcagctgacaaaaggctgatatccagaatctacaaacaactcaaacaaacttacaagaaaaaaacaaccccatcaaaaagtgggcaaaggatatgagcagacacttctcaaaagaagacattcatgcagccaatagacacatgaagaaatgctcatcatcactggccatcagagaaatgcaaatcaaaaccacaatgagataccatcttacaccagttagaatggcaatcattaaaaagtcaggaaacaacaggtgctggagaggatgtggagaagtaggaacacttttacactgttggtgggactgtaaactagttcaaccattgtggaagacagtgtgacgattcctcaaggatctagaactagaaataccatttgacccagccatcccattatcgggtatatacccaaaggattataaatcatgctgctataaagacacatgcacacgtatgtttattgtggcactattcacaatagcaaagacttggaaccaacccaaatgtccatcaccgatagactggattaagaaaatgtggcacatatgcactatggaatactatgcagccataaaaaaggatgagttaatgtcctttgcagggacatggatgaagctggaaaccattattctcagcaaactatcgcaaggacaaaaaaccaaacaccgcatgttctcactcataggtgggaattgaacaatgagaacacttggacacaggaaggggaacatcacacaccagggcctgtcatggggtggggagaggggggagggatagcattaggagatatacctaattaggagttaatgggtgcagcacaccaacatggcacatgtatacatatgtaacaatcctgcacgttgtgcacatgtatcctagaatttaaagtataataataaaaaaaaagacatacacggaaaaaaggaacacaaatccacaggaacagttggtggactgtgcctttttccgaagatgtctttaagggcatcaatatttaaaggagaacaggctggaaggaagaaagggagggcatggtcacgttactgaatccacatgttgcaaaagaaaaggagcaggtaggggaatagtcagttatgtattcctcttgcgcttagtacatcagcacttgataaggtgaacaccaagagctacctgtggaggttttcaccttttatctgtagctatcttcgtttcttgcatcactcagctttcagcttaatttttcccttttggcagagtgaattggggtccaaagattttcatttccttttacacctagaatcctctgaggagcattagcacctgctagtgccaggccaaccccacacccacagatgacagtctatgagggtgggaccctggctttgagtctgcacacccagcaggtagacgaggctgagaacccagccagacttcaaagcttaaaataatattatttatttctaaacattgtgtcggtgttttggggggtacaataatctattttaagcttcatggccatcctgggaggtaaataatattattgaccatttctaggtgaggaaactgagtctccaaggggtcaaggtcaaggagtttgcctaaagtcatttaggcagaaattggcaaaaccaggatttgaatccaggtctgtttgtgtccaaagctggggcatttttctcctaccacaattggggtctactggagagaaaaattaaaacctaacatctggattagtaatgcagcagtatccaccatctccctggaaacatcacggcagttaggggctcacttcccttcccctactctgggattgggattgttgatcaaagccatgtagctttagtgggataggtcccagaccaggatgggacaggcaggacagaaggcccttgtgaaagagacagtttggagggaataataaggatggtgaggtagtgaggtggagagtactgccacccagtttggagggaatggaggaatactggacagatggacaatcaaaccgatggacaggcagatggatgggttgagggatggatgatgaatggatggatgaagggaaggaggaaggatggaagaagaggtggatgggggatggatggagagatagatgagaaattgatatacggatggatggattcatggatggtggatggatggatggatgacagatagtgagatggatggatggatagatgggtggatggattgatgggtggatggtgaatggatggtggatggatggaagtatagacagagagatggatggatagatggatggatggatggatggaggaattaatggtggagtgaaggccagactgtgcctttcttatctctgttcagtgtttctgaaggtcattgtcatctctgtatctcaggagcctctgtatcttagcagctgtcacagaataggtgctcattaaatcctattaaaatgaaagtgtgacccacctggcccctgagtgcccctgagtgccagctgggtcacagtccattttaacagggtttaatgagcacctatcctgtggtatagaaggtaactgtgcacctccttttcatgtatccccatcatggctaacaacagcctagacatatggttctcaatcctgtgtgtttagtgttacagactccatgctgcccactctgcacaaactgtggaaccaggggaagtccagcacagttatattttagggctactggtggattccagtgtatagccaggattaagaacactggcctgtaatgcctttctgggcctccccaccccccacatatggttgcatctatttgctgagtcaagtccatctgctgggtcccagggagtgcctcctcctctcccagctccaccatctctcctgagtgagggcaggagcatctttccagctgcctccctgggctccatctctcaagacagtgggagggcttattctcaagtgcttgtataatttgttggaggctcgctctaaaaagtaaatataatttcttggttggctcaattgcaggtgagagcccagatgtctctgcccagaaatggagatacatccatagggacgcacccgcccctgccatctctcaggtcctacatgcataggatgctccaccgtggggagccagcagggctttgcagagcatctcttgtctctgacctagctgtttcctttgccacacccaccctccccacttcttggccaagacatgggtgaggggccccttcttgcagaagcttctagaagcctctggccccagtgaggtcccctcccctgtactccccagtgccgcccaccctgcccttggccccagaagtgctgcagcccacgtttctccacatcgtcctgtcattagccccttgagtgatggcctattggcaggagcagagcgaaggaatcctgagaggggcccttctgcccctcctggcccagcaggctggacagtaagcttagccccactctgagcaccgcctctgtgctggcacagtggatggagacccttgagttctgcgggggagagaagaggtgtccctgtatttgaggagctgagccaagggggctggaccacaaggaagcagcttagaggagcctgtgtggggatgaggggtgcctgggagagggccctgggccggtgggggttggggggaccctaggaaagtcgtctaagttccctgagcctcggtgtcctcaaatgaacaatgagacccggccccagctcctccccagggttgtgagattaaaatgggatcgcacacatcagcccctcagggaagtttctccctaaagacagcctttgtcttctccattcttggttcaggccctctgggaccgcgtctccaccatcacacaccggcctagggctgcactcttggaagggcccctgcgcttgcagggtgggcaggggaccctcgcttcacctgggcgtcctctctgatggggcccaggaaggctttgcagccgggggccatctgaccaggtcttactgggcccaggcagaggtacgtggggcctggagaatggcacagggggctgcagcggagagagactgtgggcacaggtgtggcgaggccaggccgccgagagccaagtggtttgcgaaatttcctggtggtgtggagggaggaaaagctgatgtgttcacctccccactcgctgtttgcagcctggaagacgattgcagggggtggcagggctgaaaagacaatgtcctcattaaaggaaattgagaaagagagtttccttcccagtggggcgggacagtgcagaaatgcggccggtcctggaagaggtgggggcgaggggtcgggggctcacacgccctgcgatttcctcccatgagaatgggcgggggcagctccgggaagggtggcggatggagccgccctctccccaggaccacaggggcgctttccagtgaaggcgccgtaggaaacgccagtctgtgccgcagtgtacgtagaggcgctatgagcccgagtttcccacgtccagggacaaactgggagccgtgactgtcaggccgcgcggaggctgccctggccgcctttgcggtcaggtgaaggcgcagaggcagggaggccgggcgagcgcaggcgggcggagagcagaccacgcggaagaggccgagagagaaagcggggcacccggccgggggggtcatttacaagggacgctgggcacgaaggaggctggggcgaagatgagtccaggggttgggttgagagcgctgcgcagccgggctgagaagagaagctgacgagtgactcccgacaagggacgggggagagggaacctgggggcaggcagaggcctagggggtgggctctgagggcagccactcccaccggccctcccccagccccgcaggccagccacatgccccgtgctccagacgacccagctacatggatggcagcgtcctgaagggggatgatcggtagggagtgggtgcggaggctcacgcctgtaatcccagtgttcggggattcccgagcgggaggatcgcttgagccggggaggtggaagctgcagtgatctgcgccactgaactcccgcctgggcggcagagtgagaccctgtttcaaaaggcaccaggggtgtagggaaggagcgatatcccccaggcaaggaaggctgcggaggggccaggccaggagagaagggccctgagctcagtggacgggcagggtgcctgtggaggaagggagggacgtagcagcaggaggaagggtgaggacccaggctggggatcgggagaagtgatggcggaggaaagagaggccggaagaggagggggcctgctggcctggcactggaaagcaaagcgtgggtttgtatatgggaagaagaccacatcccctcttatcgtcatcccaactcagaaaccatttggccccaagtcaccaaagcactcataggaaccacttttcctgtgacacaagtaggattctcccacttttaacttcccaaatgctacccgaaagcctctgaaatccttggaaatttaaaaaataatccccttctattaactgatgcctataaaacatattgactttcattaaattttgttatgaaatcagggatgtgtcccattgtaaaataaatttgtttggaaaatgtagggtggtatcccatctaaaaatcagacgaggctagaaaatttcaattttatttgctaaggtagcatcatgttgttaaaaatgcatcataaaataagaccaagagttaatacaaagcatgaagtcatgtttccctcaaaaaaatgatttgttctgtagtcaaattaatttggaaaacattgcaaactcttcagcagtggttctcaaagtatagcttgcgtcagaatcccctggggcccttgctaaaatctggatggctacactccccgcctagagtgggttaaactcagtgcccactggcaggaaactgaaacttggctgaagtcaccgaggaggccttccccgttaaacctctggctggcgacagcttggtttcctcgccgctgcttctgagtaattctggcacgcagttcctcctagccacctgctgtacctggaagggggccagccctcctcagcaggctttgctcctgccctgcacagcacaactgtggcgtaaaaaatggaaaagctggtagcagaaggaaagagcagggagacagaggttaggtgaacctcaatggcctcattaaagcaaattgagaaagagagtttccttcccagtgaggcgggacagtgcagaaatgcggcccgtcctgggagaagtaggggcgaggggtggggggctcaccgggcacatggccaacagctggtgcccagcctgggccacagtttggcacaggagaaagctgaagatgcaggagaaagctaggtcactgcccctaggccaggtgatcaaggtggctgttacctgcctgtgtggccttgaaaaagcctggtgccctctctggcttgcagggtccttctttttacaaaagcgggtcttcgaagccctgaatattccagttatctgtaaggatatagaaatattttgcctctagatgacatgtaaatatgttcctcctaactccacttcttcctacatctgtggcttcttctgagaactaccagacccaccctgttttcagagtaaacctcctgttttgaggtcaaacagacccagctgggtaattggtgactcactcctggttcctccaaagaacaggggcaagggaccacccgggacctcaggtgccccagcacaggacctctttctggggcaccctctggcactgggccatcttcaggccctacagggctctcggggcctgcgtaggcctctcatctcccagaaataagttcttttccccacccagactgacaccagatgctacagtgaggtttacccctccagcttgacaagcattcctagcccagaacactcagctgacgaggggtgctgggggaggaaggaggcagcaaggctgaaagaagcttctctgggtattccagtgcctggctgctggtcgtagccatggtgagaccacagcagcctccctggaagcaagcacctgtgtaaaagcccctccttccccacaaggggctggatccaagtgaagaaggtaccagaaggactggaagatgatgctggtattattcgacagctccagggtgctgtagcactgagcacctactgtatgcagcccatcacaaagccagccacactgcccaggctgtgccatggcaacttccagcagtacaccctctcggtcacctgcaggctccttgttcatcctgacacatgaggagaaaaagacagtactcacaaaggcctctagccttgtggccccaggaccctctcctgagcatcatggcctcctaggagacccagggtagccaggacaaaggagagaagcatttgctaagctaagaaaggatggaaggggattgctgttctgcctggatgcacccctagacctggcagggcaggcaggagagacccccagtgtctcttgcttatcctaggagttcccccctgtggttgctccagtttgctgccttcatgcatgttcacagggtgattcccctgagacaacagagctgggatgtcaccaagccctgtgtcccatcagccaggctctccccagcctccatcctctcattctgctggatcaggaggatgtggggaggtccctgactccccagctttccccatgacaaggtgtgtgtctacagctcagacccagccatgctccacctgagaagtgggtccaggcagagcactgggtcctggccacctagggctgcctcctcaggggtgggcaggaaggggagccactggaggagtgccccgggcacagtcccctgcaccaggtgaggtcacctcttagtccatgaggcgatgctgcatgagcccctctggacactagaaggcctgggctcaatgctgagtaaagtgcaggcatgactgtgccctcagcatgcatagggcagcaggcatagattcatacacgtgagtttgcacttaagctgcagtaagagctacagaggaaatgaacagagacagcatcactccagtgagccctccagatacaccccatgtgcgcagtaagagaatggcatagtctattgggacagccacatcaaaataccacagaccagatggcttaaacggcagatatttgtctctcacaggtccggaggctagaagtccaagattagggtgccagccaatccacttgctggtgagggccctcttcccagcttgcagatgtctctgtgttcccacagcatggtcacgtggcagagagagggggacagggcatgaataagccctcggtgccttcctcttcttacgaggatgctaatcccatcacgggtaccccaccctcgtgacctcgtctaaccctaatcacctcccaaaggccccatctcctaatgccatcacactgggggtcagggcttcaacacatgaatttggggagcacaatttagtccacagcagaaaagaaaggggcacagagcattccagcctgaaggaaacagatgtgcaaaggcccaaggcaaaggcctgagctctgaggggcaaccagagtcaaggctgaagagtgggcagtgattgagcactgacggtggagaggcaacaggctatcttgttaatctcagtcttttgtgtgccagagagagaaactgaggcacagtgtgtcatggtgaacactgggcagcactcccacgctcctgtcctgcactctgcagggttatggaggaagcctgggaagtctctcccctcttttccacctttcctggacccatcccacaccctgcctcctccaggaagccctggggattgctcatacactcacatctcactccttagtacctgcagcctgcattctgaatttagcaagctctggccttgggtttctattttcttgtcctgtgcagtgagcatttggaaacttctcctcagcaccaaacacggagccatttagcagaaaatacatgagttttcaagtcaattgaactgttcatcgccccaaaagccaggcaacacggtagagcagctggatctctgttcgtagaagctttctcagggactggcccaccgagtgggggactgcaagtgcccgatgagtgaatgaatgaacacatgtgtgaatggaattcaaggcactgcaggctattctggagggtactggcctgtctcttcgacaggtgaggtgcagtagaacagcatcccgtatagatgccagtttctgacctggttctgaaaagccagtcacctacctctgcagagctgcctggagggggcgggggttgtgaggacccctgagagcttggtgtgaaggggctctgcagagggaggcatggctagtgtgcgcaaggtgacctctctcctggtctgcaggatggagaacctgttcatcaaccgcttcatgcacatgttccagtcttcttggaatgacttcgccgactttgagaaaatctttgtcaagatcagcaacactatttctggtgagtgtgcctctgggggcccaagtggtgctggggacaggggatgctgctctcctgtctgatacttgccgggaaattgacaagggccttcctgcctgctgcagcatgggggcctcgctgccaccatgccaccctggacagcaccccctacactccacaccttttaccatcactgtggtcacccttgtgcccagaggtttctcctcctcagatattcaagctcgagcaccctcaacctcatttcactatcaaaagtctcaaaagtatcagaactttttcttggcacaaatcaatcatttgtgcttctgaacagagcaaaggcagaacttggcttgtgttttaggtatttacacaaaagcaactttgggttcctttggactaggatgtgtttgatgagagcactagcttcatagtggccagtcatggcatgggaaggacgttaggaaggcaggaatggctggacaagaagaggtgctgaaatcaggacatggggaaccaaacttggcaaactgcccccagggactctcctccacgccctccttcttccatcctggacactccatgctgggctgaaggacctgagtgctccaggaggcttctgagccacgaagggccagctcaggtatgatgagttggtgccacagcctgacccagtgatgggcagggggcagcagttggagctgtgcccatccagggagcactcgggagaggagaccaagcagggactctgctcttaggtgaggtcaggagggccatggccctggctgccctctactcagagctcagggtgggcctcgcttttctcctggtagagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccaggtaggggttgatgggctggggaagtggccaaggtcacagtctgtcaggtggaagccagttcctcctggccagtgctcataggccaccaagacgctaactgcaggcccatctggcctacagcagccgcttccttttcctggcagcagtgtcagccagggtcctgggcattatgcagactgtcttgtgcaacatcagaggaggaattgcggggaatgtttctccatgatgctcgagtctgggaacataatgtcaatattttcactatcagtatcaataattacaggagctacccttgattaggggcctgtggtgggacaggcattgtgacaggtgctttacacacaaggtcatcagttgtcacccaccttgcaaaggggagaacactggagaaagaagcagaccttgtgtgagaataaaaaaggggcacgaggagaaacccaacagaatggttgattttctcgttagaaatgctgctgcccatgctcctgtcgcaccctcctccccaccctcacctgcagactcagctgcctccggctgcaaggctgacctagtcttgagacagaagaagttcaaaccaactccacctggatctggtggggctcagcaacaggcgctggcccatcagcctgcctcttccccatggatccagcgtgatggggcctcctgccacccaggccctgctgcctatccccaggtgtccaggtggcctctgctgcttccagtcttttgagctcagcttaccctgaggccctagttggagagggatggttggtgccctttagagataaacctacagccccagtacctggcccacctgaatctagagggccacccacccagctgaagtccctgggcaagtctcctgccccagtgcaggcagtgtttcctaacctcctcctcctcctgcacccaaccaggcccagaacacttcctggtcatgtgaacagctgacagttacaatcccccacacactgagagagcatctgtgttcctgagtggactgaattgctagatgtagtaacattgatttggtggctataggtttcaaacttcaagtcagagatcatagaactttaagccatatagaatcctagaattggaagactctgagcagccatctctgcacccagcagccaaggagtggccatcctcagcacctggcagggcatcagcctcccactgggagtcccggccacctccagggcacgtgggttatgagtcacctttcctttgagctgacccacccctcactgactagactcttaaacacacactgccccgtctaatacacaccagcatgattcttaatccccacagtcattcacgctgcccatctggcagcaccttaatgatctacagcaagcttgtggcctactaaaaacgcctccattgttttttaaaatgtgcagttattttccggatcatgaatagagaaattgtatccctgttgttggtattgattcagtgttccagctcaagtttgagttcttagactttatatttggattctttggtttcaaatcacaaaaatcaactccatctggtttaatccaagaactctattggctcaggcaacagtaaaaagcaatgctaactcatttgggaccagggctcagatcatcccctgcactgtctctctctcgctccatgtctcaatcctctgcctctggtgattttttccttaggagggtttccttatgtggaggtaaaaaatgatcaccggcagcttcagatttaccttccaccagcttagcaaacaccacccactcccagcaagaaagaccctgtttcccaatgctcccagcagatgtcttaggccatcctcgggcctcactgattctgtgagccagtgcccacggccaggagaatggaatacactgacctagaggggacagggactctagacaggcaaaaactccactgtcagaagcagaatcctaaaatgtcagaactgaaaggtaggcccgcccctcgttttccagaaatatgaaagggaggcttgggataacagagaaatgctgcaggcattggccccaaatctcaggcctcctattcccagtatcaccttcaccagcctgggtggtctcaagattggattagcagccattccttctgggtagagtctgatggtcacttcagctctcaaagtccagctatccagccatagtcctagaaggcaagacatcactgtgcccgaccaacccaagggtctccacctgcccccctcaacacaaggtgccctgagtgcctccgcggggatagtccccgtccccacccctgcttcccccgcccatcgcgacagatgctcagagctcatccctggtgtcacaccacataaaggaggagggcggtggccaggctccgagctcctgccgtcctgggtgggtggcttctgtcctgcgtgccgccgggcagcccgggggtcctgcgcgcgggcgcggtcggtggagctgcaggggggcgctctgggatgtctccaggcagagtagatactgacccctccgcagccgggaccctcaccctttccttcatcactcaggaaacagaaaaggcttcagaaggagcggccatgcccccggcctaagcgctgcgttcccggcccagcaggcctaccctgcacctggcgttcctaggggcccctctgcgggacccactgcgcggctcgcagcggccgcccgcctcccacttcaccggcacgctcgttgcgtgtcgaggtgtgttgactcctacagcaaagggcacggatccgcgggtcagcaagcccgacgaatttacaccaatgacccgccgtgtcgccagtctcagaccagggcacaacacgccaaccctgcagaccacccccacctccccagccactgcagacccttccccctctgcttctgcagcacctctcccgaaacacgctcattcccgcccccgcagaccttccctacctcctggagacccccctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtgaactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccatctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctccgcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagctgtggactaagctggagaccaagaccactgaggggcaccatgggttctggggtcaggaaccaggccagtcctggtatgccacctttgatgatgatgtgagttcttatgtccaccggagatgaggcaggaggaagagggagaccctggaggaaaggcaggcgggcacagggctttgtctccccctgttcctggcaccagcctgctgccaggctgggagctggtgtgcagacagcaggggccaaggccaggactggactgggcataggtccctgggagtagggaggaactgcgcagaggacaccgtgggagactggcagatgagcattcagcaaataatgtccatgaactggaccttgggagctgtggacacaatagcagctggataggtcaggcaccagccacatgccaaggctatcctatgggttaacctgcacagtccgcaatcccttaccctcgattctaaatctaaaaaatctgaaaactgctgcatatttcaaaactgtgcagcaaattcattgtttgtaaacaaaccttctttgaagcaataggtgaggttatttagaggctttttccattcaatgtgatatgtatgtggatcactgcagaaatactgctctgttcgattgtaaaatagtatgttgccctagactgggggtgggagggggtatggcacataatgaagtatacccactgctaaaatcctaaaaattctggattctgaagcacatttgaccactggggttttagataacctatctttatttgtgtaatcatcaccacaaccatcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactgaagcagcaggtaaagggacaggtgacctaaaagaagacaaaattgctgggagatccccggagatcccaggcaccactgatggtgccttcaaaagcttggctcagagatctcttggagcagcctggagtcaggggcctagcttaaattccagttcagccacttgctagcaggctgtgggaccttgagcaagccacagaatgttcctgggtctctttcttcttctgaaaatggaaactttgcaaactataaagactcaagcaaatgaaagccagaggatagtaaatccaagatctggttctttgaaaggtccaaaaaataataataataacctcctcatgaggctgatggaaaaaaagagatagaaaaaaaaaatgcaagattcggaataaaaaaggaatcataaaaagagtaattatagccaggcaccatggtggtacacaactgtagtcccagctacttgagaggctgaggcaggaggctcacttgaggctgtagtgtgctatgatcacacctgtgaatagccacagcagtctagcctgagcaacatatcaagaccccgtctcttaaaaaaaaaaaagaacagtaattatgattacatattttttaaatgagagtaatatggcaaaaatttgaaaaattagagaaatggataaaaacctaggaaaagataaattagaagaaattgtagaaaataggccaatttccatatagtgattggaaacagacctacacagcgagcagctgagtctcacccagccactagacagctgacatttccagggctctttatcagccccaaattgatcatataaagctggtgtaagcttagttctgaaactggatacaggcaggcttcaaaagaaggctgaagaccaatccaagtattaaataaagatttaaaagaaaactaaaggtgatattagcgaagtgagtgcagcagtgtattaaatgactatatgtaataaccaagcagggtttattccagatatttcaatatcaagagagctaccaccataatttattatacccataaggataaagtttatgattatatcaattcacactaaaagggaatttaataacatttaatagccacaactaataaaaattaataggaggaaccttactttatatgataaagatagctaacatcaaaaaggtgcaactctaatgccatttccattaaaataataagaatgctgatatcactgtttttattcaacattattttagaggtcataccacatgataaaacaggaaaacaatcaataaacatattgtcaaagaacagggaagatgatcttttctggtaatgctatggtagacctagaaaacacaagagattctaatttttttaaaagctactagattaataaattcatttggcaaagtgtttagataaatatatttctcaaaaaaatcaatagcctttctccatactaacaataaaatataatgcccatataaggaaaaactataaagttatttatttatttatttatttatttatttatttatttatttgagatggagtttcgcactgtcacccaggctagagtgcagtggcgtgatctcggctcactgcaacctccacctcccaggttcaagcaattctcctgcctcagcctcccgagtagctgggattacaggcacctgccaccacgcccagctaattttttgtatttttagtagagacggcatttcaccatgttggccaggctggtctcgaactcctgaccttgtgatttgcctgcctcagcctcccaaagtgttggcattacaggcgtgagctaccgcacccggccaactataaagttattttaaaggatatacaatgaactcttaacagtgatttgatattggggaggaaactgtaaaaatgtcagttctaccaaattctattataaaaacttaatgcacttccaagtaaaatttcagccagaattttttatctttcttggtgggggtgtggtggtggtgaagaggaactaaaaaggagagaaaacaattaaaaaattgaaagattcatatggaaaaagaaatctagcatagtcaaaaattttttgaaaaaaattaaaaccacatagagaggcagggcaaccaagtgagacctcatgtcttaaaaaaaaaaaaaattaatagaaaaaattaggtatggtggcgcatgcctgtaatcccaactgctcaggaggctgaggtgggaggatggcttgagtccaggagtttgaggctgcagtgagccatggtcgctccactgcactccacactgggcaacagagtaagaccctatctttaaaaaaaaaaaaaaaaagtaaaagaaaacacagaaggaacactttccttgctggatttgtaaggttactgttaagcagacactgtgcttgaaaacagagagaattgggggacagtatagagtaagatccagaaatggactcccccacagaggaattcagtgtatcacaatggaggtttttcaactcagtgaaaaagggatattattttaatgatgctatcacactgcctttgcatgagaagaaaattaaattggactgctctgtcatgccatttacaaaaataaatctcatcatgtagaggagttgcttagaagaaaaagaaaaaattcagatgaagtaaaaattaaaatgaaaaaagtaaacgaatttagaaaaactaattacgcagacactcagaagacttttagaaggaaaaggaaaccaagaagttataaggggaaagctaagcatatttgattatgtaatgttttaaaacttgagtgataaaccataaacaaagccaaaaagcaaaacagagattagggtgagtaaccataacagaagtgacagctaagagatgcctatctatgatacacaggtagctcctttacattgacgggaaaataccaatactccagtggaaaaatgagcagagaatatgaataggcaattcacaaaagaagaaatgtaaatgggcaaccagcatatggaaaaactcctaacttcacctgtagttagagaaatgcaaatgaaagttaacaatgagatatcatttctgacatgcctggttggaaaaacaaaggggtaactcccagacaccagcaaggacggagccccatgctctgctcatgagttgttgcagcctggcagtgttcacgggataactggtgggcctgggcagcccaaggtcagagcttcggccagcaccggagcaaggtcagagcttcggccagcaccggagcagatcccacagcgcctgctgtaccaggtgcatgttgcagtgggcggtcagagggtcctggggttgaggctgtcgtggcgaggacagttgtgttaccgagctggactgggatctgcttgcccagtgcagcaaaaccaaacactgagattgggatataatctacgagaacacaaggcatttattgcggggaccaaaaaaggagaattgggcagctcactcttaagaccggaactccctgatggcttgcaggtaagggtttttaaaggcagagtgaatttcaggaattgcagaagttaacaggcaaaatcattaatcaatacatggagggtacacattggttttggcctaaaagggcgggatatcttgaagtgggggtgggcttccaggtcataggtagattcaaaaatttgttgttttgaaattggttaaggaagagaagtttcatttaaaaatttgggttaccagaaaggaatgttagctgtggcttgtgggcgggacttcccccaggccccccaggaagaaatttagaacaaagagcctgctcagagttcagtcctcagttccgtcttatctgaggtctctgtgccagtggatcggtttggtgggggtctgggtttctgaaaaacaactcagagacacatgttcaggggttctctttagtttccagagggaaccaaacagcccaggactctggcttccttggctgttgttttaggctgctgttaccctcttgtttgtcaagttgctcatttatttctcagggctagctaggtgcctggaacttcccttcaaggaactcgggattttccttcatttccatgccctgttgcggggctggggggctacagtgccctaagaggaggcccctgccccgtctcaattggaggagcactggaggggactttattgtttaagtgttctgacagccagtagcactgaacaggtgtgcaccaggagagtgaaactgtctgaggaacagtagggcaggcactgtctactcgaaaacatacccaaacccccaaggctcagccttcgctagcagccactcagcagaaatgaaagcacaaatgtgtgtgggtagcaacaggagcatagtttgtgatggggaaaaaaattgaaaacagtctgaaggcagaagaggattgagtgagtgagcccttccatgtcctcaccataaaatgttgaggcgtctttgaaaggaatgctttggttcccttccagctgacctggaggggtctccacaatgagttaacagtggaaaaacaagacacaagggaccgataaaggatacatatctgtcgtatacaaatagctccttcaaactgctaaggcaatgggcatggtctcacttatgtaaaatgaatgcaaggatgcagcaggcctactgtgccagcatggggacacaaggacgcagtgtcaccaggtaggaacacagtgatggcccagtgggggacaggtgagcaaaacaaagagacagatgttgattataatcatattcagttgatggaaaattggacagataaatgtgcacacatgcaaagacctatgaaaggaggctccccagaatttggtggttatccctgggcgctggaagatgagatgatgttttctttctcaggctctcctgtcatgactcagatttctttttacgataagcacatattcttttctaatcagaaacgcaaagctacttccttacccaaaaaacaaatttaagaaacacaaattgctcagggcaagttctggcatcccatggcaggccaaaatcctggacaggagtgggaggatgtgaaggatgggttggggaaggcccagctcagtggtacaagagctcaaggagatgggcaggtgaggcccggtcaggccgggaggtgaagagaagcagaagggagagtgatgggctgaaataggcagagcactgggcccatcctcattcagctctttttttactggtcagaacagtttttttttttttaatatataaaattttagattcaggtacatgtgcaggtttgttacatggttatattgcataatgctggggttaggcttctattgaacccatcactcaaatactgagcatagtacccaatacccagtttttcaaccctttcctccctccctccccttcctggagtccccagtgtcttttgttcccacttttatgcccatgtgtacacaatgcttagctcccacttataaataagaacatgcagtattcgattttctgtttctgggttaattcacttaagattatggcttaagtgccaatcctaagctgcatccatgttgctgcaaagaacacgatttcattcttttttatggctatgtagtattccttggagtacatgtatcacattttctttatctggtgccactattgatgggcacctaggttgattacatgattttgatattgtgaacagtgctgcaataaacatatgtgtgcctatgtccttttggtaaaacaatttcttttcctttgggtaggtacacagtaatggggttgttgggtcaactggtaattctatttgcagttctttgcaaaatctccaaactgctttccacagggatggaagtaatttacactgccaccaacagtgtgtaagcattcccttttgtctgcatcctgccaacatctgtcatttttttactttttaataatagccattctgactggtatccctttgtggttttaatttgcatttctctgatgattagtgatgttgggcattttttcatatgtttgttggccacttgtatgtcttcttttgagaagtgtctgttcctgtcctttgcccactttttaatggtggtgttttttcttaagttcctcatagattctgggtattagtcgtttgtggatgcatagttgcaaatattttctctcattctgtaggttgtctgtttactttgttgatagtttgttttgctgtgcagaagctctttaatttgattaagtctcatttgtcaatttttgtttttgttgcatatgcctttgaggtctagtcataaattctttgcctaggaaatgtccataagattttttcctaggttttcttctagaatgtttaaagtttgaagtcttacatttaagtctgtaatccatctagaggtaatttttgtatatggtgagaggtaggggcccagcgtcattcttctgcatataggtagccagtttttccaacactatttattgaataggatgtcctttccttattgtttatttttgttgattttgtcaaaaatcagttggttgcaggtatatggctttatttctgggttctctgttctgttccattgatctctgtgcctatttttgtaccagtataccatgctgtttttgttactgtagtcttgtagtatagtttgaagtcaggtaatgtgatgcctccagctttgtatttttgcctaggattgctttggctattcggctattttttggttccatatgaattttaggatttttttttctaattctgtgaaaaatgatgttgataatttgataggaattgtgttgtatctgtagattgctttcttccaacccattagctgggatgtttttccatttttttgtgtcatctatgatttctttcatcagtgttttatagttctctctgtagagctctttcacctccttggctggatacattctttggtattttattttgtgtatgggggactattgtaactgagatcaccacgttcctgatatggttctcagcctgaacctgaacattgttggtgcatagaaatgctactgatttttaggccaggcacagtggctcacgcctgtaatcccagcactttgggaggccgaggtgggcagatcacctgaggtcaggagtttgagaccagcctgaccaacatggtgaaaccccgtctcaattaaaaatacaaaaattagccaggtgtggtaacacctgcctgtaatcccagctacttgggaggctgaggcaggagaattgcttgaacctgggaggcggaggttgcagtgagctgcgatcacaccactgcactccagcctgggtgatagtgagactccgtctcaaataaaaagaaatgctactgatttttgtacactgattttgtatcttgagtgtagaaagtcaaaagttttttttttgttaaggagtaaattatgtgttagaaataatagttttttctaaagactaactttttttaagccttttcgctttgtgctaataactttttgttaagccctatcatatgtagctgttagatataagggaatgagtacattctatgtccttgtactttaaccaagatatttgtgctggacgtgctcacaggcatgtcccagcttgcagcccatgccccttccttatttggaaatgttattacttttctaagtcctttcataagcaacttcctcttttcctttgtctttccactgcttttacctatttagaaaagttttaagttattagccagtcgggttttagtttagactgtgaggtttggctccagccaatggagacaggacacggtagcagggacaagctgcgtaaggaataaaaattgcttctctccattattcaggtgtgctctcgccattgttccatctgcgaggagcaccctttctgcagaaagtaaaattggcttgctaaaaaaactttttgtctaaatgctgatttttccttgcagtaccgaggaacaagcattctgtttctaaacaagcattttacttataacattgagactttactgaagttgtttatcaagtctaggagtcttttggaggaatcttcagggttttctaggtatagaatcatatcatggatgaacaaagataatttgacttcctctttttttttttttcatttggatcccttttatttctttctcttgcctaattgctctgactaggacttccagtactctattgaataggaggggtgagagtggacatccttgtcttgttccagtttttagggggattgcttccaatttttgcctgttcaatatcatgttgccggctgagctctttacctactgtgtgacttgggagagctgctaaaccagctggagcctcagtttccccccatgtaaaatgggtacagcaaggaatatctgccttgcagggtcaaagtgaggattaagtgagatagcatgggtaaagcccctagcacacaacaggggggctcctcggccccagaggatgtcaggaacatgtcagtgtcccagagccatcaggaacatgtcagtgtcccagagccatcaggaacatgtcagagcatgtggggacatgtcagaaagtgtctcagagcatgccaggcagcccagcattctagggcacagatcaggtatcagtggcccaggcatctcatgcaaacgggtgtggcagtggggaccctgagagctgggactctgtaaaagggacaagagcgtagttctgtgagaacctgggtgcagagttctgagaccttctaatttttcaagaaaaccaggtcattcaaatttttatgtgaaactgtctggtatttaaaagcagccaactaatctcaagtataaacagacaggcacgcctaatgtgcaagtcacactctgctctccctcctccctcccccctccttggtcctcagggagtgctgaggcttctggggtctctctgaccagggtggagccactggccaccagggctctggagcacttgggatttggctcgtccaaaccaaaacctgctgcaagtgcaaagttcacacctgatttttaagacttagaataaggaggtggggaatgtgaaatatctcatttaatagttttagattggtttcatgttgaagtgataatattctggatatattgggtaaaataaaattatattattcaccggcatttcacctgtttccttttatttttattaatatggcttcctgaatatatacaattccatgtgtggggtagcattatatgtctattggacagcactgttttcgagggagagacgcccaaggaccccaccttccacaatacttatagcaagtgacacagctgtgtgctctgggacagttctccctccccagccatgaccactgtgctgcagtgacactggtctttcccagcacctaaagtctggccatgccccttcctggccgctcttggctgcagccctgccacccacctcattctttctgtcaacccctccaataccccatgtcttcatgtaaaaatgggcaatgccagcacctgctgccggctcccgtgagaactcactgtcgggtgctgaggctgtgctgggctctcaataagggggcaacgtgcagggctgctggcatggagggacctggggctgggtgctggtgtgggggcacgaaagtgaggctgtgtgtacagaggcatcagcaaccaggtcaccacagagcttggggattttattttctggcattaagaggtgattgaggaggcagttaacatgacatgatttgcattttggaaaagaaaaaaactcaccttgtcccagtgtggagtggaaactggaaagggaagacaggtccagcctctgctacaggaggtgcctggccacaggtgtgggctccaggcagagctcaagctgcagaccctgatctgggaggctcagtaccaggagggccccaagcctttaaacaggaggagctgacttagggcaagaaaagaagacaggagcaccagggcagaccctggggagctccagcatttcagggaagaggagagggaggaaagtatgagagaccaaggagaggcagtagaagagggagcagggcaaggagggaagagggggacagcgatcctccccctccgctgctgggccttcggcctgcccgctccttccatgctgccagctcctgagtaactgtgagccgagcgatcactgtccccacatgacagatgctgaagccggagcttagaaagcccagtgtgtcatccagagtcatgcaggttgtaagtaatatggctgggacaggaaataccaccgcagggccctttaccccctccaggctcttctgattccaaagtcactgttaaagaaattcagatacttctggaacttcccaagaggcgaagttctccaacaactatactctgaagtgaaatatagcagtgtgtttcctttcccccaatgtatcagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtaatgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagcacccagccttcacttcctccctgcgcccagcatcatcctatagggcaggcctgggtgggggagctgcgggtccctgaggcaccaggtcacctgactgggccccctctgaggcctcctcctctcccctccccagctgctggtggcacacgtgagattcaccattgcaatcaacaccaaggcccgtgagcagctcatctgcgagtgtggcctctttgacaaggtgggtgccctcctaccctacttgttgcctggaagagcccagcctggccgccttcactccctatctgagatctagacaccctttcaggaggcctggaagggtgaaggctggagtctgctcagagcactggctccagcatcctcctgatgtctccagcccgtgccattcagccaggagcactcctccaggcgcaccaccaggtcttccttctcactgatggctcctggtcccctcctcccacccctcccctctcccagcctctgggacctgggtgtagacccccctctggaacacactccttatggccccctgacctcctacgcaccaggaacctgtgtctgcctcttaatctgccacacccctgccaccctgacctggacctccccagcactctgcttcccgggtcccaaccctcccaacccactgtctcctgcatcggggactccaggccctgcccagccctcgcatccctcaggtagcaccccacctcgttttgagccctctgtagccttaccaagcttggactctcacatgggcccttgccccaaccttcctcctttccccagcccattagtgaccaggccagatgaccactgaagttgagacactgtttgggctgcaaatgacaaaacccaactcaaaccagctgcagctggacaagacatgccttatctcaaatacctggacacaatagagggtcgggggcctcagccagaaatggatccagggactcaagcaatgccccagggtgcatgcacactggctccctctttctgtctctttcacctgtgttggcatcacactctcctgctgcagacaggcccccatgggagagggcacaggagctcatcatagtagctccacctcaggttctcatgtggccattatctcccagccgcatctaaacagaaagtgctggggggcagctctggttggtcctgcttgggctgaatgcccaccgtggaccaatctctggcaccccagcacccaagtccttcttcaaaacctctgtggcaccgacagcccagccccctgggtgtatttgcatgtgtgtgtgtgcacgtggacacacatatgtgccagtgagcttgtgagtgtgtctgcatcactcagaagccgggatcgggatcaggaccaggatccctccttgtgggtctctccagccctcacctgagcacacaacaggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcttgtactctgcagccccacggttcagtcccttgcattggattgggcgggaggctcctccctagcacctctccacccggctgcccttgtcattctctgcgttaaacatccctcccccatctcacaggacaagggcttgcacctctgcctgcctggcctcctcgcctcccctggcacatttcctcagggatgggtctggacagctgtgggaggagccacccgctcagggcactctacctcccactccaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgtgagcgcccgcggggcggtggtcctgggggaggagccgggacccctgcctgactacctggggcgggcctggcccctccaccgctagcgctgaatggggacggggtgggggagtcccagcgtccgtgagggggttgccgccgggcaccgctccgcagacctggctgggtcgcccaccccggctgcgccccctgagccaggttcacggccgaggtggtagacatctactacgagggcgaccaggtggtggaggaggacccggagctgcaggacttcgtgaacgatgtctacgtgtacggcatgcggggccgcaagtcctcaggtagggcctccgggacgtctccggacccggctcccccgcagtcggcagcgctggcccctccgccacccctccggggtgtcctgcccagggtgccctccggccttggggcagggaatccgggcacggggtgggcgccgggccctggggtcctcagggactgggcctcagcccgccggtggttccaccctaggcttccccaagtcggtcaagagccgggagcagctgtcggagtacctgaccgtggtgatcttcaccgcctccgcccagcacgccgcggtcaacttcggccaggtaggcagggccgggcccgctgggcagggctcccttctcaaggccgctgcctcctcccccgccccggttctgcacgcgtactgcaccctcggacagcctcggggcctggcacgggacttgcaggatggattctgcccgctcagccaagggcgctggccgcggggaaagaggatggacggactgcagggcccgctggagttggggggcacggggaggacggggcccagggggcagctgggcagcagggcttcgggggtgcccacgcttgctggcggtcgtctccgcagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgaggtgaagctgggcagggcggggcacagccccaggtcaccccaggttaagcggttcctcagcctcagggctttgtgactcgggccccaaggctcacttggagcaaaggaatcctgacttccaaggctggaagggcccagaaggctgcagccgccaccaggtcccccggcctcagcctggacagagctcagggtgtgcagggcaggagagcacacagcccaggctttgctcactgtcaccagagggtcgtgtgtgacgccccctccccccagctattgacaaagttcttgcacatgtgttttaccctggtactccagagggaatgaccaagagtttcctgggttccttccggacacgtgcatctcatttaacctaacaactgaatccggtgtgtcttcgtggatgcacccgctttggggtagctcagtactgcatagaatggccggaccagtccaacctgctccagactgctgggtgtctgagttgttcccggccaatgtgttggtccctcactggacatccttgtttttgtggctttgcacatgtgttcagtatgaccgcacacattcctagcagacaaattccttggtcaaagaatattgatactgaattgccctccacaaactaaattcaaaatcccattatcaatagcctatgtttcttggacctttccagctcagaagctttgtgatcttaatccaatacagtatttttttaaaatgatatctagctctgccccgcagacatctgtgtgagaatgcaaataagcacaggaccccaacagggcagccaccccttcaggctccctggcccgctttctgccttcctgggctggagaggccagtgctggccccagcgcccctgatgggaggtgagagtgctgcgcaggggtggcccaagacagcaggataccatggctgcaaacaccagcagcccccagcttcatctgcatcatctcgtaaccacttggcagcaggcagttattttcccacttatccatgaagccccagccctggagccttccttagagaagcaggttggaggcgacgacacttgccttcccgaggccctcttgtcaggcagcagagggtgaatatggggaggtgaatagatgctccctccttcatctcccaaacggtggctggccccttgggatgagacaggcctgtcagtttacacgggtagtggattgacctatgtgtgtgtccatgtctgggccctcagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcatgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatgggtcttgttccatgtgttatattccaatcaccccaaacagctcactgccatctcccacaccaagagaaaaaaaaagccatagtcaccgtgattttatcaaggcaaaagcctccccacccaagtctggatagaaggtgctttttccctcaagcagtgtctactctctttggaacacatcccaaatgtcaccacctctgggaaggcatccttggttcctgtctctaccctggatttgtcagaacctctgttcttgccccctctgtggtctctcccttgggacacgagcccctggaaggacagaaaacccactttatttatgtctgtgccccagggctggcataaggcaccagcactcagctgttctctccttttcctcctggaagggcacctagctaatggatattaggcattgtcttgggagctgggggcttattttttcctgaggcagggttcttaacatgacataaaaaataaaaatgggcagggcgcggtggctcacgcctgtaatcccagcattttgggaggccaaggtgggaggatcatttgaggtcagaattcaagaccagcctggccaacacggtgaaaccccatctctactgaaaatacaaaaattagccaggcatggtagcaggtacctgtaatcccagctactcaggaggctgaggcaggaaaattgcatgaacctgggagacagaggttgcagagagtggatatcgcaccactgcactccagcctgggcaatagagcgagactctgtctcaaatagttaataaataaataaattaaattaaataaaaacgcattctctttccccagccccaagtagcagagcccgctctgagcctgggcatggtgacccattctcctcgtgctcacatgcccaactcccagccctccagcccctggcttcggaatcatgtcatcagggtctcccatgtctctggaaggtgcttccagtgtggcaggccatcagctcagtgtctgggtaaaggcttctacagggccagcatggcataggggggaggtgtgcatgcgttcctgaagccacaaggtcttctgaggagacctgactattggggtggggactagagactgaggtccagccccttaatgccccagactccctgccatccctcggagaatttcccaccacacttatgaatgatcttcgggacaggtgacataaacatacagctatggtagaggcattcagctccatgccactgtgagaatgaacataccaacttttaggcaacaaggccatgtggtcaaggagagaggagaaacgaataggagtaggcaggggtggtgaagcaggtctgacattggcaaaagtgacagagaaggattgggttggaagggcttcagatggcagagaacctctgaaaaagtctcatgccagctaatgaagagtcctcaaagtcaccatcacagaaatcttacatctggcagaaatgacagcaatagtttggcatgaaccccacagtggatccaaacgtgtggcagctgagatcgtcagttaattatgttctctgcagctggtccttctggttccctggagctgggtatctgagtagcacagctccactgctaccacaggagagggagaatcccaaattctgtgcatagactgtctaaacctctggatgacccctaagacacatgtacataaggcaaactgcaaacagcccaatttaggataaaacagcctgtcttactctgtttgtgctgctataataaaatacctcagactgggtcatttatatagaacagaaattgattcctcacagttctggaggctggaagtctaagaggaggcactggcagtttcagtgtctggtaagggagggatcagtgtctgctcccaagaggatgccctctgtgctgtgtcctcacccagcagaagagcaaaaaagggcgaacattctcaaaagcctcttttataaggacatcaatccattcatgagggcagaaccctcaagaattaatcattt

SEQ ID NO: 11852 - DNA, 321022 bp, Human
  misc_feature (1)...(321022): n = A,T,C or G
gaaaaggcctcaagaggcaaggctttagaccaggagttctgaaagtgacatgtgtacttgtgaatttcatacatgctccttggatgggctagtttctttggagggaaccgtcttctattcccttcagattttggatcagaagcagccataggagaggtggcccaggccagctttatattgttactagaccgtagggcgatttctcgcctctccagtctccaaaaacaaagcacaaaaaaggacaagagcctggttgttttcatcctcacggaccagacaccccctcaggaaggcctctggagagtcttctgtctggtccccagtctctctgcccaggtgccccccaacaattgaggatgactagtgtgttctctttgggtaaggagcaccttcccataaacacttatttttcttaattcacgctgagcttttactttattttcgctttaaagtcactgttctgaaacgttctaaaacgccgtaggaacatgcagataggaacaaaagcaaataaatcgaatcctgtgaagtaacaaagcagacgcccttctcctaacaggcagcacaaagctaaatgaaaaatatcagtcatccactagataaagtattttcccctttagacaggagctgccgtttgcaaatctcccccaccctaaatccaagccagcgaaggtatcaaaaaataaactactcccttcagctcccagactggaggcaacagtttcagcagcaccgtctatttccttgaacaacacgagcggtttgaaagaccttggctttgacttccctgtacctgcctccaaacacacgtgggggcggggtggggtggggggagatattgccccccatccccgttgccttccgcgacgccaggccaggcgcagggcaggggagaagatggggggcgccctggattcgcggttccagctgcaggcagttacctggggtagtgagtgctctctacagacccgggctaccccaacccccccgattccagaaagggccggagaaaagcagggggcgcctgccccgctccggagcagccagggagcccggccgagccttgacgaggatgagctcggagaccgcagcagctaccgcccgctagcacctgagctcccagggggcggggcctcctccaggtgtgcgcagaggaaggccggcgcggagtcggggccggcgcgggagcccgagctgtcccccagcccagaaatgcgcggggaggagcggttcatccgcaccccagcgccgcgggagacactggcgccgcctgcctcctccgggtcccggggggagagcgcaccgtgcggcgcggagggggttaaccgggcagcccgccgctggagcgcgcttaaccctttggagcccgcaggtcagccgggccaggctggggtggcggcaccccgagtcccacgcgacggccaccccgagcgcgcaagtggtgccgggcagaaccgcgcgccgggctgcagacccgccggggcgcggcgcgcgcgggccgtgggcggctcggggcgggcggagggcgggggacggcggcgggcgcgcagcgtcgccagggcgaagccggcgtgcggcgcggcgcggcgggcgcagagcgagcgggcgggcgagcgcctccgtccccggatgtgagctccggctgcccgcggtcccgagccagcggcggcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggtttttttttaaaatcaattatccttattttctgttatttgtccccgtccctccccacccccctgctgaagcgagaataagggcagggaccgcggctcctacctcttggtgatccccttccccattccgcccccgccccaacgcccagcacagtgccctgcacacagtagtcgctcaataaatgttcgtggatgatgatgatgatgatgatgaaaaaaatgcagcatcaacggcagcagcaagcggaccacgcgaacggtgagcagccagagcccgggcacccgctgccaaatccgatcctgtcatggtcctccagccccctcccccttccccgcggcgctggatgggttgagggggttggagagggtgctgccagctcggtgtcgtctacacagagaggggacatgcgtgacagccactccgcgctcccctccaggccctgaatgtcagagttaattctgcatttgtggggtgggggcggccgtggagtgtgtggagcgcggtgcagccggaggggcggcgagtcggggtgattcgggttcagtgtcctcgggctcaactttccttcaacgcccccgagcgatggcaggagggccgcaagtcttcagccggagcccccttgccagcctcttctcgccttccactcctcccccgccccctcgttgactaggaagaaggtccctggtggcatccggaaaattctaggattgcccggtttcgccctccgcgccggtgggtgaagcacacccatcccctcgcgggggaggcccggcctcggtatcggggaaaggggttcgggtggagcgtgcgttcccgctcccgtcgccggctgtgcacacgtcggtaacctagcaatgcccggggagccgctgccgctgtggggctcccctccccagctctggcccgggcaccacgtgcagcttccacgccggccggggctgggtcgagggaggatggagcagctcctggccagccctcccctttggagaccgccagtgccccccaacccctgtcggctggaagcctttccgggtgagcgctcccctagggagaagcttgacatgactcgactcgtccccgctccgattgcccgccgctcgcccgctttgccctcttctcaggctttcagacccgtgcttgctttgactctttacttagcaataattggctttgcaaacgcccatctctctaccttgctgtcacctctctcacttctgcttcagtgaggagactgtggcggaaggcggcaggtgcctgggagatctgcctgggagatggcctgacccaaagctggcgggggcttcgcatagggagcctccttgagtttctgccttgtgtgcacctggataccaacctacacggagataattccctcttaggcctggaggcccctggcataatccagtcagtctatcctaggtgtaggggtgcaggctgactgccttgtctgtctctctggatgctggcttggctgatgctgctgcaatttaaaatgcaaaaaagccctaaagatgttttctgttttcggaagcctgtggaggaaatgagtcccaagcatcatgaattttcatttgcaggaagtgtcagtgcataatctagatatttgttatggggtttttggtattgcctgggtgcctatggaagattttttttcggtactgaaaaaaatgcatttgtggctgtggaaagatgttggagtaacactctgaaaatgattaagactattgaattattggtactgcctttttttttccccttggtgatggtggtagttatgttagagaaaagctgttgtatgtatctgttactcattagagatagatgggttttacaaatcagagatgcggagtaaatgtgggaatgacctcagttttgtcagaagaaatgcactaaaagaccctttgtgaagacatgatgtgaaggagtactaaccccactgggtgtgatgcagcggtgatcctgtgtgattgacactgagaccagagctcgtggacttttcttgactctccagctgactaaagcccagcttgtgaaaaatagcacatgagattcaaaatggaaacataggagtgaatgattcccctgttattgatgggagacaacctttgatttttttctcctacccactggatcctcatttaaaaaaaaaaatctttgtttttctccttctccccagaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaagtatcctttttttgggggaagtctttctcattttctcttttaccatctgttttttaaaaggatttgctttctgaagtgacacaaagctgtagcagtctggaatgcgagtaacagaagttgtatataaggggtttcattgtatataccttcctgtctcttcgggttgcagaggggtggctgtacgggtatatttagcccactgtctggatgtgtgtatagtagtagtagtagggggagggagtgacagcctgaaacttcacaggggcagataattaaaatgtgaaaccaacctttggttattggacattagatggttagttttaaattcagtgttgtctttgggcaatagcatgcattgaacctattgcaaacaaggtatacagattagaaaaaaagactgtataagactctgtttgaagggaatacatttttgacctttagtagaatcttctcattctgatgtttgaaatttgcttctgcaactacaattaatgctaaggttgcttctagtctgacatttggtgattctaattattcaggtagctgcagatatgagcacatgcttcctagggagagattacttttgattttttttctctgatcagtgctataacttcctggaatttccttttgacaagttccaaagaagcatttggaacgtgagcatgagggagccagtgaagggagaggctcgtgtgtgcctcttcctcctgggcccttatgagttatagaacagccttttcagtggaggaatttgcagttgctgcctttataaaaaattctgtctatgtccttggactggaggtacatttctgggtgtctcctttgtatttttaaaattgaactccaaatgccccagaatggctgtcatgtcccagatcttggaaaacgattgtgcttcagcctgcttaaccccttccctaaatctggaggccaacctccagttactgccactcttcagagaaggttgactgaggccttctttctgagcaaatggctttttaattaggcagatgattcattggtctgggtaaagtaaagcatttcctttccccagaagtgtgtttggaactgtcaggggccttagaacagttcctaactataggaaggggtgtgaatgtaggaattccctccaccaggcccagaaggatggaggggccacaccaaaaagggaggatgttggcagccagctagaaagtggagctgaaatccccttataatttgaggatctagctcggcagctatttgcatgccctctgtctttagctggctattttctgtgctaatggacaggagttaaaatgaggtaactgtctagaaagattttggagagagcagccaaatgctagggtaggatttgaggggttctcatgtgctttttcattttgcagcagatgtcccttctctagagtgagttatggtgtctctcacatagctggggttgtgtgtgtgcattttcttttgaagttctctagtctgagaacgaggagggagctcggtaagccagcatgtggcccagtggcattgctagattcatgacaatggctgtaccttgccaggaagacctcagactggcttgacacgactctgagtaagcagagacctctttgtggggtcactacttttgtgtggagtaggtgggaggcctgatgctgtttctctttgtgcacggtaatgtgtacatagcaatttttgcatgcagagtgaattcctggatcacgctgctgtctcccttttccagttgccagacacatgtgtacaggaattaggggacgtggctgccaattcagggagaagcctgtttacaaatgggacagtttgtaaaatagatagacccttaagcaatatatgatttttttttctctttttttaatgacagtttccttctaattcagggagcaggctatagaaatcctttccaccccgggcagctctgtcaaggccccatccgcagtgggagagcaagggtcaagggtcatttgtttttacagacaggcatgacagagtgtcctgccccctggaggagtgagggatgttctccttatcagaaggaattgttaggatcagacccatctatttctctattgctctgttctgcttcacttgtgaaaatcttatggcagtgagatggtatccacttgtacctggagaccaaaactggaccaacataaagaaaaaaaaatacaacttatatttagtcttcctgaacagtgttagtatttctcagatgtgctggtttatcatttaggtattgggaaattgaaaaggaagaatacctattacttaggtattgggaaattgaaaatgaagaatggaagaaagagggagggaagagactgttgtgtttctatggagaacaacattggggcccttgactttagatttcagtggggacctacaaaaaggaaaaatggaaagggaattctgaagtcttaaggtgggctatctgaaagttggatccctgggtgaaaaagattttataatattagatgagttgagagaaccaatgtgaattaaagctgactggcttaaaaaaaataaacccatcaaaattagtaagggaataatgttattcattgcctttttttcgttgagttatgaaagctcttcgaagatgaaggttttatgaaactcaagatctctccagaggccgggcacagtggctcacgcctgtaattccagcactttgggaggctgaggtgagcagattgcgagtccagaagtgagcagattgcttgagtccaggagttcaagaccagcctgggcaacatggcaaaacccctgtctctactaaaaaaaaaaaaaaaaaaaaaaaaaaaaaattagccggcgtggtggcacatgactgtagttccagctacctgggagactgaggtgggaggatggctggcttgagcctgggaggcggaggttgcagcaagttgagattgcgccagtgcactccagccttggtgacagtgagaccccatctcaaaaaaaaaaaaaaaaaatgatatctctagagaggtaaagagtatttgtttcctgtggcatttttggatttcccagaagtatgtcaggatgaatggagaatagtctgttcgtatgctccagttttaagtaccttgaagtgtttagttaaaccatggccttgcctcttgtgggtgagtgtataggcgaagcactgtggtaaaatcaagcccaggaattgcagatgaggctggtgctcacaaaaccttgtatttggaaaggctgaaaacccaaagaagaaaaacaatcattttggcagatgtcaaattttgtgttgccagttttgacaatgtctcttaataacaccagaatgtttaggtaagtatctcttgaaggctgatctcaaagtgattcttccagacagaccaccaagattgagaaatgttaaagcctactttgaacgtgtctggtgctgatttcttatggctttttaatttaatttgtttacaaattgagcacagtaacagcatattataaactgagctccagtccggctctaatctgaaacagttatagccatcgattcctctagcagagaaagcagaggcgggagctgaagcctggctcgctgctgatcacatctgaggtattggaatatgccatgagaaagttataggtagaatgagaaggtcctggtggcttggcctggcccagtccagacaggcgatttaggctgaccctgccaagaatagcccctgagaaaatggctctaacacatggaggcaaggatctgcggaagacatttatcccatgatgatttctctgtgtctaccacagccgggaacttagtaaggctcttgtcacttttaaacctgtaagaagcagaaacctagttcacacagtgccctaattggatgtacttttaggttttaatatgcagtgtgcagccgaagaatgagtgtaacatgatccttgcaacagaagaaaaggacacggagaggtcatttggtaggaggctccactgtgagatgaccaccgatgattacttctgccgaaaacctagcagtcacagcagtcagccgaaataggatttgtgtatgtcattttccttttaaaagtgctttgaaagtggtgtgatcgggagtgtgatgagggacatggtttatgtttccataacacatatataccttaacacattttttcagaccatttgacatatttatattattggctatttttgccaattgtgtggccttagctatttacatcccattccctgaagatgattctaattcaacaaatcataacttggtaagtgtccttagagttcctgctggtcctggtatatggttatcatttgcttctatacttaaactggcagctggccttctgggtggttgaagtttatagctatgcatgtcgtgtttcttggagctttgcaacagtggttttttgtttgtttgtttgttttaacctgtattctcaaatttatactgactgaaagtatttaaagtcatgaatcttttataaatagatatggaatttttatggaagagatttggagcagattttaaaataactgttatctccacataagtttttgctaccattcttttcctgataatattagcttttttcttttctttttttttttttgtttttaatctagtgttcttgggagtggtgggtactttggtcagttgttctggtaagtagagaattatcgtagactttgtacatgaactatttttagagaagtagaatataacaaaactaataaatctacatagagcataatttggagaataatacatgatattattgaatacatgatataatattaaagtttctactccacgtcctatgaaatgctccaagagaaaatgattgtatggttaaataaatcaggatgcttccatatactttgctgccttcttaaagatttatagtgcacattagcttagtaaaagctttgggaagttctgcagttaaaaaacaggtttccttttatttaactcagctagtccctaaaagtaatcagtcatgaattctttaaacattttttttttttttggcaaaagactttaacatcatggaaccagtggtccatggaacttcctttgggaaaggttgatatagttttttttttaaaaaaaaagcactaaagagtactagactgggactaggatcttgtcccactcacctgtcaactagctgtatttggggtcatttctcatacctttctgcattgctgtgcagccacctggcaattaggaggattgggtaagaagattgctagtatcgtttttacctctgacattctgcaatctttctttgatgattcagaagccatttcaggatttttctggtgctgcagcatccttcttgcaaggattggttctttgcaatcagaagccatgcagaatgggagatgaaggggagcccattctggataacaggaaactctattgtttttcttctcttctcttagctggttccgtttgtttttggcttctcatgttgaagctctattttagcagggctggatgttcctaactgagcgagcgttgtaaaggcaaacacactaggctctcccttgtgtgggagagctctgctggcttctgaagatagtgaaattatgctcttgtgaataagccttaacgatttatgtacaggatttcatgttacatttaaaatgttgtggcacatttcagatgtaatgtgatgtctatttgtatgtgggctttagtagtttgatatctagagaattttctaaaaattttgggaattgatgctgaaaatacaactataaatgggagtcggataaccacataaacactggtagtatatatttggacaatgccagagatcatttgtgtaactttggacattttatgtagcttttgatttctttgtagacatgtgacattagatgattgttttaaagaaaaagcagaagtggtggaaagcctcccatcaatggagatagatcatcgtagtctaggccacagatggtgttagccttgttaccaaatttaacgacgtggatggtgacccagattgttacttttcgtagctcaagagaacatgattaaacaaacttagaaaataaatacctttcagaaaggcagattaattcagatcagtggaataattaatgtagctgcatgtgtaagccaattaatattctgaatttttcccagggaaattcagggcactgatataggcactgtcagaccatttggatttctcagctaagaagtcaggaaataaaatacaggaaatggattaatctttcccttttgcaccccttctccagtgaatcttttcttgactattcttaagctttgaacttttttttttttttgtggggggggatttggcagtgtgttaatttggtgggcctttctaaaagccaacgtatattcctttgacctcttcatatagtattctgaaactcatggcattcaactttgtgtcttgctttcacttgggtggtcacatggccagatgaatttttactctgcttgactctttaaatacttcctttcccactgtgggaagggaagatctttgtggatttccttctgactctaagcaaggtcccatgccatgttggtcctcccatgagggagctggttttttgtttttttttttttaaatacatttgacccaatttgtactagagtgattgctctatttttgggattggtttagaggcagctgaacgaaacttatttttcatctgtagtaaatacctttcatttaatgtgaatggtaaaatcaaagggcagacgctgaaatgagttgcaaggctgcatgtatctggaagctgctggttttctttgcctgatagctccatgggaaagatgcagttgagcgatagagtgagatccagggccagctttatgtatgatgtttctgcctgttaccagttacctagtaaaattatgactttttttggggaagaaacgtggccatccccattgatccaatgtgtctttgttctagatagtatgtaactcagctagttttgggatttggagactaccttggggggcagaagttttcccagggatagtttttgttctttatttttttaaaaatataaacactctcaagtttctctgcagctttcgtttatggacttgcagggctagtggaggctggagtcatggaaacggtgcaactcagttcccacagtaatagccctcctagttcagtcaatagcagtatttcctcagttccacttactgaaagcaaataccattgattttattattattttttttttagcacagaggaggggaatgcctctgtatcaagtgtcagagtggggatgattacaatatcatacttcactgtgatgaaaaatgctttatttcatatcattcagtttcttataagcaaaccgacatggttgaacagttttgagtctgtgtaatctgttcctggtactcttcctcccggtgctacctcttacttctctggagtgtggaactgcttgaaattaaaaatgtccagaatggagatcttcatctgccaagtcagaccttctttgatccctactgatggctgcactcacctctaagccatctctgaaccagcactaagcgcccggaggcaaaggcccatggcccatgtctctctatccccttatctagcaaagtgcctgatgtaccaggtgctttttatttgtttatttgtttttttttttttttttttttgaggctctgttgcccaggctggagtgctgtggtgcaatttcggctcactgcaagctccgcctctggggttcatacctctctcctgcctcagcctcctgagtagctgggactacagacgagcgccaacatgcctggctaatatttttgtatttttagtagagatggggtttcaccgtgttagccaggatggtctcaatctcctgaccttgtgatctgcccgcctcggcctcccaaagtgctggaattacaggcttgagccaccgcgcctggcctatatgcacatctttatcctctggagcgtcttcaaaatacagttaatagtgaagcattctgaatccccagccatgcctgatgcagtggtaggggtatacagtagatgttcagtaaataagtattgctgatgtgcaccaagcgaatgactttcccaggagaagcgccaccatcattccttcctctgagccatgtttcagattttcttgggtggcaggtccctttgtggatttcttgcaggtccttagctgggaatgagtgggaaggtgtacgtgttattcctgaaaagcttagggtctgcggcccttcttgtgcacctctgcttaaaagagcccacagtgttggctttcatagcagagcagtctaggaaattttgtactctggttccagggctcagagtagcaagagtgctgggacctgtctgagaagcagtgctgggctgtggatgcttgcctgtggcaccagatgccttacagtggccaggaatgctgcgggacagtctactttgattgctttctttcctccatggctgagatctgagtgtagtgttaactgggcttaaaaatcaagtccgttgtatctgcatggtcacgtagttcggcatctcatggcttttgcacctagaggtgtgaaccataatacctgaaacacaatttcataacctggctccttgggcttagcctatatggtggaggttaggtctgtatatcatcaagactgtgtctttgcatggttgtcattctgttggaattgaactttcttatttctgtaggcctaggttctgtctattcttctcagacagctcatatgctgcttcttcccttcagccttctctgatacttgtccactccccgcctgcctacatctgagtacttgctttccctctggacacccctgtgcccagtccaactctcctgtacagacaccagcccctttcccctggtttataactgttgtgggaagtggcgtggagtgtgatggtctgctcatgggctgtggggtctgacagcctgactctttggctgattagctgagtgactttggatggaactagaatatgagttcctagaggctgagactgcagtctgatttgggtgtatagccttgtgaacttaatcctgtgcctggcacacaggaagcacatcaggaaatgcacgtcaaatgagtgaataaataaatgaatgaccatacaaggactccatggtatattcttgtagatcattagttaattatcaacaattggctaatgattaatgtttgcctgagaggctgactttttgtccattagtaatgacatcccaggaaacacctggcagagttcgtctttaatttcaggagtatatctttctttcttggcaaatttaactattaaagagagaagaaagacaagtacttgatactttttgaatctgtaagttataaacctgtcttctgtattcaatgttgtatattagccacattgcagatgattctatttggatggatgtgtgactgtcacctttcacataaaaattgattgagccagtcatagtggtatgtgcctgtagtcccagctatgtgggaggctgaggcaggagtcttggttgagcccaggagtttgagactgtaggggactatgagtgagccactgcactctagcctgggtgacagagcaagactctatctcaaaaaaaaaaaaaaaaaaaaacaaaaaaatgtggtagaaggggagagagcctcaaaatgaccagagtagatggactcgtgtagtaaaactttacccaaagttggtttcctaatgatataatgtgaaacagtctatgtgctatacaaataattatatctcttttgttaagccttacgtcattttgacaaaggctttacttgattgagtattgacggcttttccaaaataaaatccagctcttaattgagatttgtggctgggcatggtagctcatgcttgtaatcccagcactttgggacacttagcagggaggattgctggaggccaggagttcaaaaccagaatgggcaacatagtgagattccatgtctccccccgccaaaaaaaaaaaaaaaattagctgggtgtggtggcgtgcacctgtggtcccagctactcaggaggctgaggtggggggattgcttgtgcctgggaggtcaagactatagtgagctgtgattatgttactgtactctagcctgggtgacagaatgagaccctgtctcaaaaataaaggaaaaaaagaagaatttaggttttttactattaaaattccataagaggaattccagtgggggtccttgctcatttggtttgtttttttacaatgtgaatatcattattttatagtcataccttatacaacgaacctccccatctagacccttcactagtgagactaccttagggtgaggatatttgggtatattagagtattagccagaactctttgggttacagattgtgggaatacaactcactcaaattggcttagctgaaaaaaaagtgcgtatgtatgtacaatttataaactcagttaaccaaagagtccactgggtagaaatggcatcagacacagctggaaaggggggggctgaaaagatgtcaccagcattctatccctgccctgcaccctcgggtttctgagccagagtctgactgacctctagtaggtcagcctcacgttgcctatgtgtacatcttcctcagctcattttgaggagggcatgtggggacgtgcatttctttctttttttcaaattttattttattttaagttccgggatacatgtgcaggatgtgcaggtttgttacataggtaaatgcatgccacggtggtttgccgcacctatcaacccatcacctaggtattaagccctgcatgcattagctatttatcctgatgctcttcctcccacatttctttttttttgtttttagcatttattttaggtttgggggtacatgtgaaggtttgttacataggtaaacacaagtcgcacaggtttgttgtacatattatttcatcacccaggtattaagcctagtacccaatagttatcttttctgttcctctctcttcccccaccaccccgcaactcaagtagacccagtgtctgttgtttccctctgtgttcgtaagttcttatcatttagctcccgcttataagtgagagcaaggcatttctttcttaatctcagcttaagttcggcattttaacaatgattgcatcagaaacagagacctctgtagcagattggtgggtagttttctttttttttaaccttcctcattggtgtttgtttactttttaactgtctgacaaatgtgaaaagtacccaatacagggtgacagcatgcccagcagtagagacacttgggtgttaaataccagtggcggtggggacacgccccaacagaccccaacagcttctcaccaaagaaagttcctaaaggaatggaagaggttctagaattctggaggtggggtgtacagggagggaccatgtgcactgttactgttgagtggacagatgtgcagaagggaggggtgtcggcgggtgtccctgccccagcaagggtagagggctggttagcagttgatccaggagtagatgttagcatccccaccatgcagctacaggatgtggtcctcaagtcctgtctgctcatgtgatggaaataaggagagtggtggaggcgggggccttccttttttaattcaggtgagattggtattctcccagctggggttcctgtgggctgtaagggtgtttggctgggcaggcaaagccggaaatgggtggtatggaggaagaaacagaatagctgaagatgggatgaaggaggaactgcctgaactgatcagtgagctccacagccccctctgtgtgtgtgtgtgtgtgtttgagagagtaagagagagctcatgctcatgagtgtgtgagttaggggaaaggtggaggtgggcattgttgacacaggccttgcaggacgaagccttcctttggtggctttaattaagcagggccccagacactgcctgggctggagaaaatgactttcttctccagaacttcaaagcaattatttttgctaattttttccttcctccctgttaggtgagtggtagttttagaaatcacaggacatctgttgaaattattgaatgagtgaacgcgaggtgaggctggagggaatcaggggctgacccgagggagggcggggaggcaggtgcagactgctcagtgagtgtggtgggatcccggtcttggctggccctgtaggagcccagccagggaaggcaggaagaggtggcctaggttagctttgcctggggattcaaaggggccaggcgagaggctcatgctctttctccttccctttccctgccatgctcatcttctgagggctgacgctgaatccttttcctgtgtccgtcagggattcctgcataacatagactcacagatacttttttacagctataagaggacgtatttataagaaaggaaattgaggcagctttattcaacaaatattgattgagacctcctgtgcagagcacagcagccctgtgtttctgccttccagcccgctgctgtggctccccatgccttgttgtgaaggaaaacctacagtgtggggttggaaaacagccagatttgttttcatattttgcattcttactataaatcatcactcaaaattgacacaagtaatacatgaatacattgtttcaaataattaaaacaatacagataaagtaacaaacccctttacctacccaactccttctaattacaatgatcagttccgtgtgtcccttccgaattgtttttcacagcgtgtgtgtacgtatgtatatatcacctgtgcattttgaaacataaatacagtttgagtattttaaatttcgtgcaagtgggaacatgcattctatggcttcctttttcccactcaatagaccttacagacctttccatatctgtatgcagaaatctaacaacttcatagttggtgtaaaatattccatgtatgaatgtaccacagtttatttgttttctttgtgatgaacatttagggtaattccaaaagttttactgtttcaaatcatgctgcattgaatatccttttgtatgcttctttgtgcatgcaagaaaacgtttgtctgggatgacaactcagaagtaaactctccgggttggagggtatgtgcgtttttaatatccatgtttattgccacatcattcttcactaagcctgtactcttttacctcacaccacatctcactgcctcagcagtcatttcactctgcagagtgacctcatgtgttctgtatcttaggctgtacaaaaggaagtcttgggggttgggtctggcctctctctgggatgttagtagcatctggagcatctggttagagtagaaagtccacaaacctgagccctagattttaggaatctattttgcaccagtgaccagataaaaggcaccaaaacttattcttgtctcccttgctttcagtcccaggtgcttagatactattgtttcttttgagtgaaatattcattccaggtagctaataggtaaataagttcctaatacaaaaactgagtcttattttggaacgtttgcttgctacggactggtttcatgacaaatactgcctttatgtccctgttagttggggaagaagaatatccaatccggtatgtctctgatgtcccgtgttcttattatctgttttattttcacacacagtaaaatctcgctattattatggtgtttagggtttgtgcccttcttatttccgaaatctctgaggtggtttagaaaatagaatttgatgaaagtgggacaatggggaatggaagcaaagtctacttgccagggtgctcgaggggaactgattgctgacacctggacatggaattggcctcaaggtttcccagcagcggcggcgaaaaagagtacatcctgacacacagggtttttatcctttcgacaaagggaagcagccacgctcattcacagcagcactttctaggaagcacatccaaggaggaatctccagcgcaggtccttgtgtaaggtacattgttggagcacaatgagccatgtcttcgccgtgcttttgtcggggtcagaaatgccgcgcaagcagatggtccctgcattcatgtttttcaggggtcagggtacgacattaaactgtggtataatgaaaatggaagtacttctcatttctataaaaacgctgctttttgattatataaattagtataggatgaaagctgggaagatgaaaaaagagtagtttaacatagccattatttaatcattcataaagtactttttaaagcatttattacgggtaaaatatagtcccattagacacattccctctttgtgctaacttggtttaactcaaaatacaaagggatacaggaatttatgcaaagaacatcctcccctgcccccgtaaaaccatatttgaatatatgtggttttattattttactctaatgtaatttaaataaatgaccaatatttttaaaaataagaaatccttgaatattcttcagtaaatagataacaacagggtataatgaaacactgtttatatttaaatgactgctttgaaacggtgtgaaagcagcttaaatgggtaaaatgctgcccttttatgtcagtaattagccccttggtcttttttcacgataatgcaaaattgtacttctctgtaggcttacacaaattctgaattattgaaatataaattaatggtgaatctttctaaagctcttttcagaatttttatctggtgggagtgaaattaaaacatccaaaattctaaattagaatgtggcaaagtagagacagccagctagaatttggtaaaagacaggtgtttaataaatcttttcctagacatccatgggttggtactagtgtggtggggtagagaaagctttggcgtgttttaggttggccaaatgaatcagttaattgatgttattaaagccaggtgggacaatagtaggttagaccgcctggttttgattgaccctgaatgaggaatcacagacatgatgaggttgggattggagaggacatcagaaacctccatatgggtctgttcctttttcagacccgccagcatgacctgccctgggttacacagtgagagacgaaccgcatggggatgtagggcagagcatctgtctcccaatctgttttcttcctacccacctcagttacaactatgactccaggttgaagttgggcatctcctatctgaccaagggacagggtctaagaacagcaggggcagtgatgacaaaagattgtctctttaaagcaagctgggcattgagtcaacttttcattatctcttcaattattttctttgtgtagtattaggtcggtgcaaacctaatgacggtttttgccataatacatcttccgaaagatagtttccatcacctctccctcccctgcttaatttcataaaatactttattgctttcttcatacataccaacctgtagaaatcatttgaccatagattgccacatttattttatggaaatagccagggcacaggccagcggatgtagtagggcaggagagaatcagcagagctggctaacaaatgcagtgggtctttcctcagtttcttgtttttgtgtggttagcttgccctgtctttctgactataactggaggcacagtggttattgcctttgttactagctgacattggctgacattgctgagctaggtgggctttctatatagggtcctgtgctgaataacagtgtttcagttcatcagccaagatcaaagtcggtggtcccataagattataatggagctaaaaaattcttgttgcctagtgacatcgtagtcattgtgcctttgtaacattgtagcacaattactttattttaaaaataaatttggtagccaggcgtgcctcacacctgtaatcctagcactttgggaggacgaggtgggcagattgcttgagttcaggagttcgagaccagctggtgaaacctcgtctctaccaaaaatacaaaaaaattagctgggcgtggtggcacacgcctgtgattgcagctactcaggaggctgaggtgggagaatcacttgagcctgggtgatggagattgcagtaagccgagattgtgccactttattccatcctaggtgactgagaccccgtctgaaaaaataaaaataagtaaattcaatgtagtctgagtgtacggtatttataaagtgtatggtagtgtaggctttcacattcactcatcactactgactcactcagagcaacttccagtcctgcaagctccattcatggtgagtgccctctacaggtgtactgtattttggcttttatacagtatttttactgtaccttttgtatatttagatacaactggtgttataattgcctatagtattcagcacagtcacatgctgtacaggtttgtggcctagcagcaacaggcgatcccatataacctaggtatgtagtaggtggtaccatctaggtctgtgtaagtacactccgtgttcacacagtgatgaaattgcctaacaatgcacttttcaggaccctgttgtttatacctgttgttaagctatgcatgactgtaatctcctctaattcccatttaatctttaccataaacccacaagggagatactgttaaaaaaatcctcattttacaggtgaggaaacaaggctagaaatggttatattgcttgcacgaggccgtgctcctggtaattggcagggccaggattcacacccggacttctgactcaagcgcccacgctcaagtactaggccatgaaagggagtccaggctcacaggctgatgatgcctaaacaccaagcggaggagggtatgaccaaagggcagagccagagaggagaccatgggggagctgacggcagaaccttttgggggcgtggggggtgggggtctctctggctaggcttcacattcatgcttttgattagtgattggaaccaaggtctggggactggcatagaaactttccaggttaggattcagtcccagctttgcctttcactggctctgtgactgggtcaagccctttctgcatctgctctttctctgtggaagaggaaataaaatggctaaaggtgttatcacaggccctggctcctagaaagcactgtgctgtgagccagaggtttaagatgggcttcagcctcacagcagtcctgtgaggtaggtgtcgttagccttagctgtagatgaagaaactgaggcttgggaagaccagccggcttgctctggggcacctggtgaagagctggctggatggaggattggatagtgatgggtccctcctgccatactagaagagcttcctggacagtttgcttggattggagtttaatttctaaagccatttttttaggtgttcttaccagactgagctagtgcatctgtcccaccgaatagcctaagactttagtggtcatagagggttttgcagcggatctggtgaagaaatgaactgaaaatgagcctgctggccataggagggcctagacctggaccataccccatcatcatttagacaataaagggtggttaattcccttggaacaccaaggacagagagggggctagtttaatggtcaggatctgattctgctgcagctagaagactgaagcctgcctctacatggtggtccggggtaaaaagttcaaagctcagcacactacccacaaggcttggtggtttctttacgtgtgactttctcagccgacttgaaatccaccaggtgtctcttgttctctgcttggcccaggtgggagcccctgattgtctcttgacttaaatgttgctcagaagaggaaataaagcaggagctaaggagcacaacgatgtcagggggattctggcccgatggtcgtgcagttcctagatttggagtcgtgaaaacaatcactaacacctgcgtggtcagggacggcctatacggcacttcatcatagggtctgatttttatcctcacagcagccttgtgaacattgctgatatttgacacaccaggcagccaaggtgtggggcagttgaatgacttgcccaagagcaaacagcaagtaagcagcagaattaggatgtggacctctcctgccctttctgccacactgtgttcctcgtgtcatggagtcctccctgcaggtcactcgggtaagagaccaaggctcacagatgggagctggcttgccagagctagggctcctcaggacccaggtgatgggcttgcttctctgacatgtggtccctgacctctgttttctcacctgtaagatggggatcatagcattattaatagtcatgttgttgagaggattaaaggcgattttgcaagggaaccctctgtgaacaacagatgctggcccattgatttccttgtgcatctagtcccactttctcaggcatttaggctctgccctgctctggctctctctctcttcagccttccaccgtatcaggagagtggagactctggaggaagacagatcttggtttggtttctaggtttgatgctgactgactgggtttgggaatgaacaaatgatctcacctcccttggtctggcttcctcatctgtaaaacagagataataattctcatctcacttttcatgtgggatctttgtgaggagtcaatacaaataatgtgcgagggagctctcatttaccagaaggcattagttaactggtcaagaatagttcaagagagtcttacctcccagtgaagtttaaggtttggcagtatctgagcactgggggaatcttttcctataccccccttgaagtgccatagggttttgagaatcagtcacacggcacacctgttaaatccctgtgttcttccatgattgctgcctttctttgccttatgattttttcccttattgtggcctagtccacggaggttggaaagaggagtgtgcccttcccttcccttccctttcctcagcaaggggctagtttctactcatagctcagggctcacccacagcatagcgctgtgtggaagcctggtgggggcactgggtgagtggtgctgcagcagaaaggcctcctgctgagacgctgaggtcagcattttcagcggcagggagccctgtgactgaaagcagaaagaccaagtacagtgtgaggactcgggttggtgtttgtggccacattgatggcttcatggaagtatgttcccctctgtgcaatgaactagtagggcctgtgtcttggggcctgcaccttttgattgcaggcaccaggcccagcattttttctgtgttgcctatctggacgacaagccatacggtagttactagcgtccccattttgcaggtgaggcagatgaagctaggaggcgttaacttaaatgactctttgctgagggaataaacccataagatgacaaatgaggtctgtggtcactttcttcactgttgcagtgctgtgcccagcactgagtgtgagggatgtcatggagagaatgctgaatttggagtccggtggcctggctttgagtccctgctctgtaactttacttcgttgtgaccctcactttcttcattggtcataaagcaggaggtaaaaatttaaatgagatctgtgtgaaagcgttttataatctacgaagctatatacacatgggcggcatcatccttatggctgtctgttgagagagggcctcgaggagaggacttggcttcatcttgccttctaatccctcactgcaaggccctgaatcctaatccctcactgcaaggccctgaatcctaattccactccatctctccatgatgccagtgccacatctgggacctacgcagaagagtcatacctgccagcacagctatggtgattgtgcttgggaagaagttgaagttgcagaaggaaggtggtagagagggactgaaagagccaaccaggccagagctcgacaggaccctccctccttccctacccttcagacaggagctgcatcaccattttcttttccttttctttctttctttttttttttttttagacagagtctcactctgtcacccaggctggagtgcagtggcagtatcttggctcactgcaacctctgcctcccaggttcaagcgattcttctgcctcagcctcctgagtagctggggctacaggcgtgcgccaccacacccagctaatttttgtatttttagtagagacggggtttcaccatattggccaggctggtctcaaactcctgaccttgtgatccacccatctcagcctcccaaagtgctgggattacaggcatgagccaccgtgcccggccatgcatcacgattttcaaaggccagcttcctgactgttccttgaactccttgagataggtatttactgtgcttgtgacatgcaaactgcaaataattcttgcctcataatggataggcctgtaacccagccagccctctaggcaagcaaatgttatttcctagttttaagtgtgagcttaatatgtgaattaatttcacatcttcatcctcttcctaaatctgtctttgttttgtctgatgaataactgaagtaatggatttggtcacaccactagctgggtagccacctgaggctggagttctgatatgtgggtcttgcctgctttctctgcactgtggctttgcacgtcgggtgctgaagctggggagctggaatcagctggtgtgttctctgtagaactgagaggactagcaccctggggtggaagcagccctgccttctgaaccacagacttgcttgtgtttgatcttatgctgttttcttactatttctgataagaatgtgaactccttgtgagcagggacccagtgtcccatttctcttaaatcctctacagctgctggcatgggatgtttggtaaataatagaccatttaatgaagcatcactctgtctgtaccaggcaccttgaagttgctttgattgctttgcctgttttcctaataggtgtccggtggtctctctttccaatgcaggaacagagtgctggaggtagagactgtgattgcttaatgaagatatcagaacttgcacaacccacacatagggctcccatcaaagcagtagttctagggctgcaacctcttcccaaagatgttgcaacacttgtcttcagagccagtttctgcttttcattttcctttgcttctggctaaaaatgggatcctgttgtcactgaccttactccccgtcttttctttaagaaactcttgagtatttgtaagaaaatcaaatctatcttcaaataaccaagttttcttatctttgagaatcttgagtgcaatgtgtcatgggctctgaaggtcttacgttgaggaatggcaatattatcagaattacgtgtccagcttcccaagcttactactttgaaggaacacatatttacacaattctgatgtgtttattaaacaaacagctttaccacttcgcagtcacgcttctctaagtctgcagtctcgtctggcctgactttctccttgtgccaagaattccttcaccttttctctttagcctttggccccaggaaaatgggaaagtaagatattttactcctggccaatgcctgatttttagaagccttcctcactccctggcaaggcacattttcctgttacctcagagtaaagagactcggttctggggttctgcatagtgatgctacatgcctgacccttgctagggtttgagggtccttgggaactgatgcaatcgtagaagtcacagctgtcattcaggttatttacagaagtagacagaattgcttcacttgccagcagggcgtcttgagcttgactcagaaggatatgtaagtttctgctttttttttcttgcctgtttcaaaaacgcatttttgataccaggaaagttagacaatttaatcttatctgtagcagagggagcttcatccttgctgtgtgaagctgtgcgagacgacaaagactgttgtagaaagaggcctcttgcttataattgaagcatctttgacctgagtcagtgttctgcagccaggatcagataatcagcactggtcactggcacctggcattgggacctggaggcaaagaataacagaattaattggtttccagtaagtagcagggatcatggcatgttcatactttttaaaagaagccttattgagattgagatataattcacacaccctatacttaactaatttaaatcatacaattcagtgttttttactatattcactgttaagcaaccatcatcaaaatcaactttagaacattttcatcacccaaagaaaccccatacctattagctgtcaccccattttccattctattccccctccctagccccagccctaggcaattgctaatctgctttctgtctgtggatttacctattctgaatatttcatataaacgggatcatacaatatgtgtcctttttgcctggcttagcataatgttttcaaggttgattcatactatcgtgtgtatcactacttcattcctttttatggtagaataatcgtccactaaagggacataccacatttatttatctcttcatcaactgatgaacatttgagtgttttcccctttttggctattatgaataatgttgctgtgaacattcatgtgcaagtattttgtgaacttaagttttcaattctcttggctatattcctgggagtggaattgctaggtcatatggtaactttcccattttgagggactgccaagctgcttgccaaagcagctgcgccattttacattaccaccagcaacatgtggaggttccaatttctgtacgtctttgctaacacttgttattgtctatctttttaattatagccatcatagtgcatatgaagtggtatctcattgtagttttgatttgcatttctctgatgactaataatagtgagcatcttttcatgtgcttattagccgtttgtatcaaatcctttgctcatttttaaattgaatttttaaaattattggtttgtggcagggcatggtggctcatgcctgtaatcccagcactttgggaggccaaggcgggtcggtcacctgaggccaggagttcgagaccagcctggccagcatggtgaaaccctgtctctactaaaaatacaaaaaatagtcagacatggtcacaggcatctgtagtcccagctacttgggaggttcaagccggagaatcgcttgaacccaggaggtggaggttgcagtgagcctagatcatgccactgcactccagcctgggcaacagagtgagactcaatctcaaaaaaaaaaaaattattggtttataagacttcttcatatattctgtataccagttcctttttggatttatgatttgcaaactcctttctttctttctttctttctttctttctttctttctttctttcttttcttttcttttcttttctttttctttcttttctttctttctcctttcctttcctcctgtcctttcctctctccctttctctttcttttccttttctttctttcttctttttttctttctttccttttttcctctctctctttccctatttctttctcttttcttcaggcttttgccctgctggccatactggagtacagtggtatcatcatagctcactgcaactttgaactcctgggctcaagcaatcctcctgcctcagcttcctgagtagctaggattacaggtgtgtgccacccaacctgtgctaatttttaaaaatttttgtagagatgggggtcctgctacgttgcccaaactggtcttgaaatcctggcctcaagcgattccctgcctcagcttcctaaagcattggtgttccaggcatgagctactcactgctggcctcttcaatttcttgatggtatccttcaagcacaaaagtttttacttttgatgacgcgtaatatacattgttagaaggccatagctggattgagtcttcaaggttgcctgttccaactcccttgtcggagtaacgggaggcactgtgatcagagaggaggggcctttctgagggtcacagacccacaaaaccaggactggagtataagtctctggactttcaccttgggacattctcagtttccaccccactgtttctgagggtcgaaaggtttgggtgtatatgtagggaaagataattggtaggctctgaagcacacagttcatttgtttttcaataaggaagagtcatgttagaaattttgtcctttcttccagaaggtacactatatagcctggagccacactgtccaaaatggtagtcactggccacatgtcattataagaacttaaactaattaaaattaaatgaaatttaagattctcagtcataaagctgtattttggctaagcattgtgacttatgcccataatcccagtattttgagaggctgaggcaggattgcttgaggccatgagttggagaacagcctggaaaacatagtgagaccccatctctaccaaaaaaaaaaaaaaaagaaattagccaggcatggtggtgtgtgcttgtagtcctagctagctacccaggaggctgaggtaggaggattgcttcagcccaggagttcaaagttgcagtgatttgtgatcatgccactgcactctagcctgagtgacagagcgagaagctgggggaaaaaaaaccacatttccattgttccttatttatatatggccaccgtattagacgacatatgggttgtttccatgattgcagccagtcctgttgggcagcactggctatacccactggcattctgtccactcctgacccagtggtgccctagacacccagctgtgatctgtcttctgtgggtccctcatctacctgctgctcaggcttcttctttatgtagttgcctctgggcttcctagcaagccccctacccagactagatggtctgtgggccctgcaggcagagacacttcttctgcatagtttttggatgtggttgccagtataaaggctagtgcctttcctcacctcagccaataggtgtgacttgcagaaatagagctgaaagatgcttgcaagaagtgtgttctttcttggagaggttagctcctaaaagtgaatgctgaatgagtggatgaattgatctactctttggactaggggaagatgttgaagaattttttatcgaaaattttattgatatgtaataattgtacatatgtatggggtacatgtgctattttgatacatgcctgtaaggtgtaatgatcatagtgggtaattagggtatccgccacctcaaacactatttctttgtgttgggaacatttcaaatcttctattttgaaatatacaataaattattaactattagtcaccctactgtgctatcaaacactagagcttatttcttccatctaactgtgtgtttgacccattaaccaacctctcttcatccccctccagcccctcttctcagcctctgataactattattctactccctgtctccatgagatcagcttttttagttcccacataagagtgagaacatgcgatatttttctttctgtgcctggcttatttcacttaccgtgatggaagttggagtactctcgagtttagttcttttggctgcattggttggtggtgttttgggtgggtacttcattttagaggcagtcagttccaagaatttgcaagatgctgagtgaagtggggcaagaggcaggagttggaacactgggtgttctgagacagtgacatgagggagatgggtgtagtcctgctgggtgccctgtgtagaggtttcctttatttcaggttcctgtaaccctgagggccatctgagccatcaatccaaggtcaacaggctatggaaaaaatctcaaaactgctctatgtaaaaggatgttttacccacatcttagtgatgggagatactgtagtttggaccaagctaggatattatagaccagaaatgagtctggggactatctcagacatgagaaaggattgaccaagaatcatagcaaattcacagtggcacaactgagactggcatccagggcctctggcgcttcgccataggcacattccaagtgccatggtgtatgtcttcatttacacaaggacaggtacttcatacacacaaacaagcaaagcaacttcttggagacattgcccaggcttagattttaatttatttaacccacgttaggcactcagtcctgccttcaggcccccctttgccactctcataattagaaggtattaagaaacctttcaattacggcaagatcaccagggttctcatttctttttcttatctccagcctatctctagaatctattttttgcagggaggactgtccttgactttaaagaaagcattcagaaacaaagagacttgttatttttgaggtcagcctcctccaccagactctgagagccttgagggcaaggacagtgttgtctcttatcactactcaaggactggtgcagagtgttcatttggtgaatatctgtaaaattctcatttttaggagaactcccttttgctgggcttctcaggtatgaggtcccttttccatatggtcctgaaactttatcaattccagtttagaagtagcgacctgaggaaatggaataattcttctgtccatggtgaggggaggatggggggaaggtgctcattttgcctttgaacttgataagagcagagaacagtcaggtttgtgctgagaatgtaagggttactttttcctgaattgggcagtgggtggatggagcccaacaggacatcctgggaaggattcccagagcagggagagggcaagcacagaattgtggaaggaattccgtgccataaacacagaatatcttatttaacagtggaacttttttgctgtcttctttagaggtggaaaacagttctttccaaagacaagcttaatgactgctgtgccaacacacaaaactacaagatacatttaagcatcagtttagcaccagaaatgcagtttacagaagatttgcatgaaaatcttaaaaacaggttgaaaatgtcctaggctcagctagtgcacttttaagttagtaggaacagggctctagggatgagatgatggagcagggatgtgacataggtcaggggtacatgtgtacctggcctttgaagcctcttttggggttcattttaattaatttcttgttcagcttttaccatgggcctaagtttctctggttggagcagagtaagttttcaggctgaatttcttggatcattgcctttgttttctttttcacatagcctgtggatgtctggccttttcagccaaggaaagaaaatggaaatggttttaaacactcactcacttgagccatgaatttcaaccatatattaattttgcttatttttggattttcaaatcttctgagaagcaatgaaatgacacaggggcaggccactagggtgctttggaggttctgcgtggcctggagcagtggggagaggctcgggagagtggaactgtgccctcccactcgtgctacccacacagcagcctcctccctcactctctccttcatgtatgtgtgtttgaggttctgcttagcactttatttggggaaaataagttttctgaaaacttattttgtaggcaatagaggagagattggtgtatgtcttatccttactcgagttggcaaggactctgggccgaatatttagggcttggctcttgctccctctacctaggtggattatgcagtgagatctcacttgcctttaactcatagttattgcttagctcttaggagcagtagaagtaaaaatcctggtatcgtaaatgagcacaatccctgtaataagtgatttctgtgtattattggtagcttgaaaaatattaagtgttacctccattttttaaatatgaaataaagggctagatcaggacatgaactcattcctgttgtcttccagagctattttactaaggaggagatgacccagtggtgaagagtaggtagcagcatgtcaaacctggtagctttgcagtaggggaggtgggcagtacagtgggaataagctagaactaataattcagtgatcatatggggccttgcaggtttttgttattttctgcttgggtgtaggttttgctttgcaaagtctgaaggtgacctatataattcccatatatttggagctctcaggatgtgccaaggatcagcccaattctctgaacgttaactgagggagtcaggagtccttcctgacctcaagaagctcacagttcagttggggatagatggccttgagcttgtgttttagagctctggtcccaggtagtgagctcaaacccagcacagactagattaagccaaagaggaatttattggctcacattgctggccagtccagggataaactggagtcagctcaggcgctcaaatgatgtcaccaggatctggtttctctctctccagcctggctccacttcctgtatgttgattccattctcaagaattctcagacacgacctccccttgtaattgcaggatggctgccaacagtttctaggcctacgcctttccaccttccagcaaaagagagtgtgagagtctttgtcccagtccttccagatggagtcttgtttcttcccattgtctcagattgggtcacgcgcacatccggaaccagttgcaaggccagggacgtgtgcagcactgctgacgtggggccaggtcatgtgcgtcacccctcgacctggggaggagccaactctaccctaagttcctgggctaagaatggaaagagagtcaagtattggttattggggaaaggtaatgatgtaggcttgaactctggcctgacccattgtcaggacagcctgaacttggggctgtattcccacctgacatagccttaagtcagaatttattccagtatgagtacagcatcttgttaccatgtggttttagctgcactgtggatttagacaccaaatcttgtcttccctgagaacattgtccttcctagaggtggggtggaaaacttatttcaggtaagcattcggaccttgaccctaaccttaatggtgattactgttcgaggtttttcaaacacatagtgaataaggacagctggtgcaatggcacgccctccaattggctacgttacacagataaacattcttaatctttctgaggttttgtatagaagagtggagaattgtaccaacttttctccccccggttgtacatcttcactttgtcaccaagcctggattcctcatctgtaaaatagtatcccctcagagttgctatgagaaataaatgaagtgatttgagtaaggcatggcacctggaacatagtacatcgtgcataagaagcagctattgttattatctcctaatttgtcaaatgagcagggcgtattgccagataagctctttaaagttttaatgttcacattctataaatctaggaaaatctttcctccactgcccacccacacttggattttgagaactgcatcttcattgagggtaacgtgttagaaagctctcaaacattatagccctcacagaatgtatagtacttcataattcaccaagtactttcgtgtccattctctcattcaatcctagaacaatctatgatgaaacaaagcaggtatcacaattcctgttttatagatcagaaaacttagggcttagagagatcaaatgacttacccaagggcatagtggctggaaggttgcagggcaaggcctattgccagaatcttctcagatatcccatgtctgttggagcattcttctactccagtgtggatttgcctttctgatggctttgactggagaactgtattgggtagttcatcaaaataagaagccttgagttcatatagtgaaaaataagatcaccttttccctttgttcattggcttgatttattaggattgtattctcaaacctttcctgctattaaaggaaatgaccttagtttgtgttgcatgaaatagcattaagtcaagtttacaacatttcaaagttatggtcagtagcattccaattagaacctaaaaagcttacctagctgaggtttaagtcgttgatcttggaaaaggtaaagacttctcagggaggttgggctgctgtgtatgacagctagaccctcagttcttggtctgttagcatgtggcccatttcttcctatccatgcccctccataaagctttgtgcgctggtagtatttacagtactggatgataattatggcattaattatttgagataaatggagtgtgcccagtagccaatagactattgttagagtattattagtatttttataggtcttttggatagcattctatttcaagacatttgaaaatgtagaccagattagtcaaaagcattgtacatgatctgtccatgagtgtaggctctcattagaacttctggaatcattctgaaatatacccagctagataatactaagtcataccaattaaaaggaaagacttgagtttgagttatagaatgttggagagaaatctagtttattacttttaatattgaagtcaaattttgatttttcttttatggttaatattacctgggtcctaagaaagattgcaaacatgttttcttaccttttttcttgtagaagctttatatgatgttagcttttgcatttaggtctgtggtccatttcaaattaatttcttttctatggtatgaggttggggttaagaggttaattccagccacctcccttgtgggtatccagttgctccagcaacatatgttgaaaatgctttcctgtcctcatttaattgctttggtacctttattgaaaatcaatggatcacataaatttggttctgtttctagggtctctgttctgttccattgacacatttgtctttatgctatctctgtactgttattattactgatgctttgttttaagtctaaacattggattatataagttcttccatttttgttctccacccctcactacaagattgtattggctattctaggtcctttgcatttctatctaaattttagaattaacttgtcaagttctataaaacagccctctggggttttgattgagatgacgtcgaatctataggtcaatttggggagaaggatagcttaagaacattgagtcttctaatcactgagtgtgatgtatctctttagatcttctctaatttttctcagcaatgttattagtatagaggtcttacatgtattttatttatccctaatttttatattatttttgattttattgcacatagaattttaaaaagaatcttctagttgtttattactagtatatggaaacatgcttgatttttgtatatgttgccttgtacatgccaccttgtcacatttacttattacttccagtagtttttgaagattctttagaattttctatgaacacaattattttgtgaataaagatagttttgtttcttccattctaatacttatttatgtatatatgtatgtatgtatttttcttgccttgtaacattggctaagaccttccatatggtatagaatagaaatggtaagagtgtagacattcttgccttcttcttgaactcagaaagtgtttattctttcatcactgagtacagtgttagttggaggttctgcataggtgtcctttattggttgaggaagtttccttctgtttctattttcctgagagtttttattatgaaaggatgttgaattttgtcaaatgtcttttctacatgtattgagataatcatatggtttttctcctttattttattgtggtaaattccattgaattttgcatgttaaaccaattttgcattcccaggacgcacctcacttggtcctgatatattatcctttttatatattgagggatttgattttctagtattttagcataggctttttacatgtatgttcttgagggatattgggtctgtacattttctttgtaatgtccctgtctggctttggtgtctgggttgtgctggactcataatgtgagaaatagtgtggtaccagttgctctgtcatgaccagcagcagaagtctagttttctttaagtgtgtagagtgatgactgttaggtaaagagttagaattattttaatgatcagccaagagtctctgctaagtaacatgaggtatctgtgaaatggcatacataactgttgtgtatgaagcagtgcatcagagaggctgggaaatactttaagtgggttgagcaactcataccattccttatgctaaaattgtacttatattttattagcaaaatttcttttatcactgagagaatgaattatctatctgattgccactcataatttatggagttatcagttaataaggttttattgtatgttaatatgagactcatttttttcctttctctcctctttgggttgtatttcttccaagtaagagcttaaattcatgggtcagctagtactgaccagcatctgttgagttattttgcataaatttggttacctggcctcagataagaatgtttttttaatctgtattggtggcattgttggttgctgatactgctgtagtttgttcttgcaagacttctgtttaaaagaagggttataaattcagtgtaactcagagcagaggtaaagtatagaatggaattagaagaaaacgaagcatcaatttcagtaaagtagaaatcgtttattaaataagcggtgggtgacagggaattgggagtaaccatcctggttcccatagtgatggtgcatccaggaaaaatacagggaaaaagggaatcattatggaagagttttgggtgtgtgttgtcatgctttaggaaacttgccaatttctacacctctgtcttcagattgtcgtgtttagacacacatcccacacaaagtgctcagcagtacttcttgtgctcgtctttatcccctggaatctagaggatggcacctctgggggagttattgtctcacatgatttagaaagacctccactattttctttccaagagtcgaaggaaggtgggtgagttggcctggcacctataagcagggacctacaacactgcttgaagcacctggtgacatctgcttgacaggcttcccctccccactgttgtcaccacttccatgggtggtgggtggtgttgcacggtgcccatggggtggtgtgcatgttctccaatgccacctgccctgcctcagtgctgcctcctgtaacagtctcatttgtttcgctggagtatccttatcgaaaaggtcttggggaccatttgcctaaaatgttccccagcatgaaatgtcccccacacttgctctgcacccgtgcacatcctccttttctttttttttttctgagacaaggtcttgctctgttgcccaggctggagtgcagtggcacaatcagtgctcactgcagccttgactcctgggctcaagcaatcctcctacctcagcctcccgagtagctgggactataagagtcccaccatgcccagctaattttaatttttttttttttttttgtagaggtgagggtctcagtatgttgcttaggctggtcttgaactcctggcctcaagcagtcctcttgcctcagcctcccactgggattataggcatgagccactgtgcccagcctcctcctcatttttgtagacatatcaagtctggcctccttcaggaagccttccctaactaactaatcaagctccccgtgtttctttcctttaggatctattttttggatgtgtatggtttaatatacccttaagaataatgcgtttggaattgtaattgagaagacaaggtttacgttagcagattatagtctaactctgatttttagaaaagtgatatagaatagagacttaaaaaaaatgacattctcacataggttttggatatttggagataggaggaaaaacatgtctttaaaccacacaatgggaagtgaagtgtttgcaacaaccagaacatttaggttataaagtgtcagagcagataatttaggctaaaagaaacaaagttaaatgatttggtgggggcttgatttctctggattgacccccctggactattggctgtttccttcacttccagactgtctggtaagatttttctacagaggtaccttcttattaatgaattcttcccatcacacccactctgtttgaatttctgaattaccttctccttttggtttctgtatctcaactttcttcttattgagtcttctctgacagtttctttgagggtattgctatcagagtcagacatgcccatgacaagattccaggctgtgtaatcttgagcaaatcaatcttgctggtctactttttttcttaaaagaacaaggaagcttgccttgcagggtggttagaatttgagacaatgtatgttgcatgcccagcaggtggcaggtagctaataacaggtgtgtgcttgctctacaccagggatcccctcggtctttggtctttgcatatcatagatactcagtaagcgctctcccaaaggattactgacttaacaggtagggtaatgtttatagccaaggggaggtgagtgtcatcaggcccaggtttgtatgcctatttctactgaattgtcgcaaagttatgtttcatcctatttaccaagttgtatttacagaagactagtcctgttataacaaagcccattgaaacaacacccaggaagtagaccacaagaagtcagtgggtatcttactctgtgtcctgcagggggatctggaaatgaataagggagagagaaaatgtggagtgcagaggatgctgcctggaggtgagactttaaccacatgattattctcagttatggagcaatggctttgttccaggcattgtctccaatagtcacaatcacaccatagggctgatgttttttctatcccactgaggtgtaaacagaggccccaagaggttgcatctggaggtgcgtgagcaaaatttggagagaagtaccaagtgggcacttcacaacaggtgaagagaatgaagagatggataaagataagtgttaagcactttttggtggtactggaactttatcatgtctcttgatttttaagaaaagtggcctattgactagaatttgagactttcattatattgttcagttggcttttgcatgtatattgcttttatgtttttgatgcgttttttcaaaaccctttaaattagttggattttatgttgttcttaagtttgatgaggtagacacttttttagctgggaggaatagagaggcagtgagtgtgttaacagaacacagcaacctcagactccagcccccgctctccttttatccagcggtgtgacgttgagcctgatgcatgacatcttggcagcagaggtgctggtgctctgtcaggctccgggacccctgactgaacatgcctagggtcatgaggaggtttttgttcctgtaacattggccacaactgcacagccagtgggtgaggatgctgagatacaaactgagaattttgcacttcgacctaggctctttgctagatcaaacttcttttgatgtcttagccatgatccctctgagatatctctctccaagttattaatatatctgtgtttcccatcatgtttccccttttgtcttggcttcaaagaagctcagagctaaatttattgcttgattatagttgctggattggccaaggtttaaaatttatgtttttaacttttttatgtgattccctccccattttcattttgatagtcttattgtttattgtatatcaccttaaatactttgagaagtagatcgggtctacgtttaaaaatcgcgtatgtgggaggagagggccattcggcaaatgggaaagagattggggtgactttggccaaaaaagtttgggatagatttttgtattctcttgtattatgttattccctatcagatggtctttgcagctcatttttctgtcttcttctgtgtggtcagaatcaggggagagtttttctttataaaaatgatttgttttcctgatagaacagtgctggtgggtaacattcagttctgaccttgtaggcagacctgggattcccagagggtgcagggaccgcagcactcactcttctttgtgacaggcctgaggcagcttccctggggtccccagcctgcctcctccacggctgctatggccgtgggcgctgagcacgtgcagctgctgcctgatgctcctggacagggaaggatagattttgggcatagttactaggtgtcactgtctccttttttcagcctggcttttacaagtagttgtaatttacttgacaaacacttatttggcatttccttcaatacgctgggtactgagatggttactgcatttttaggcatttaacggggataatagcatcatcgttaataattacaaatatgatcgatccatcatataggcaatacatttcagaagaatattattaaaaagactcatagtagtgggtgtatgcagctgtagtagaggagctgaagccactgagttaccccggggttcaagatggggagcagcattcccatctgtaggttgtgttcttgagtgggaaggcctccttggatacctctcgacagtaattccaggtacttgagctcacaaagaaagtgtctggggccctcagccctttggtgtggctcccagggacgcctgagttatttccagaagtggcgtggtgggtagagtgtgagggcaggcctcgcctccccgcccctctcccctgtgtggcttttcctttctgtaattcaactgattgcttttccttccaaattgctggcttaagctttatcttatctaattttatctcctccagccttgtacgtccagagcatcattagggcctgtgcccattctgtccctcccacttctcttggtctccctccacgtcctgaggggatagaaagacggagtctgcataacctccgcatcttcctgcctgggagggcggctagggtggtgcctgcagcctctggaacctctccattctgtgtgcccctcaacctcatggacatactggcgtttcaggacctggccctgctttctctgtccccgtctctctctgcccactggtttctgtgacccacgcccttcccaccccattctgccccttttcctcacttgcttttcttaccttctgtcacattcacatgctcactatttctttttactccaagcatctgttcctctaaatcatgaactgtagttggcataattaaatatgtaatgtgtttattttaatatcaatatgtcttttcatacacatattagtaagagacttggctgtcagcgccgggccagatcaccatttgcagatgtccactcacgccagctcccccacggaacgtttcttatgcacctcatcagttctctttctccttgtctctctttctgtctctgtgtctctttgttctgtgtacatctctctgtatgtccctggcttcctctctaacacaaattgctccaataggccggcaccttttcctctccgtaaaccccagtttgtaggtacacacaggcacccaggcaagggtagagaaaccaaagagcgcttgttcacacttgctcacacaaggaccagcagagacctagagctgcatgccacgtctttattatccttgctgctagctcctctggtacagcagcactgtgacagtttggaatttgagcctgggcactctcccctgagtgcatcggtgacgtaaaggcaggcaggcaggagcaatcacagcctcccgtcgcctgtgtgtcccaagtgagccccctccccaaagggatgtagggaagccagtccatctgcaaggtatctggagtggagtgacaggaagcagaggatccagtattattggaatagattacatggtatgtgcttgtcacttccgtttaaaggtaaatacaaatctgtctttggcttagaattctagcctcctgacctggggggtgaatattgactggcaggctttacctcccatgtagaaaagagttgcgtgccagggttataaattagagctctgcattggatggatcttcttaatgttttctgtggagtggaattagaacatgttgtttcttttgaggttgcaaaaagcaaacaaggatccctttcctcccagactagtgggaagtagactaattacttgaaatcctgttttatcagccataaaactgagatgaaagctggggcagttatgaagatcctgatatatcctagaccacaaatttctattccttttctggaagagaaaaactgcattttaggtttagataatttggtcaaattttttaggctatcaaatgcaaagattaagtttctagagtcttgaattttagcacagagatagcatcacttaaccttcccgagtgaaaattcctgccttctaggtggtggggaagatcaaacgagctgtggatgccagcatacttaatatgtgttcagtagatattagtgacagattcagtggatatgacggctgaaggcctgggtggctcttctgggcttgttggttggtttcattataatgtatatggttggacctaagataacccatgtttgtgcttctgtggacactggtgctttcagggtcttaactatattgttttcatggaaactttgaaaggactcatggctccaaaaggggctgaaaagttttgaatttccttttttctttctttgcaaaagattttacagcttaagtcatgtaattaataacaggggaggttaagagtcaaagatttttctcttaccctggtcattttcgaagctgcacttggcatgggttgaagcaaatttgtgtcttcttgaccatttacttttttttttaactgagaaaatagattctatctctaatgaagtaattgtaaacagccttgttaacatatggtactgattttttcacagaagcattgttgaaatgcatgggaactaccaggttaaaagacataaaaatagacaatctatatagtccagatggtatctccaaactaggggatccaagtggcatgagaaactgtctagagcaggagtggcaaacacggcccccgggccaacacggccttatgcctctttttgtatggcctgtgaactaagaatggtgttttacattttttaatgtttgaacaaatagctgaagaatagtaatatcttgtgacatataaaaatggtacaaaattcacatttcagttaccataagtaaagttttattggaacacagccccactcatccatttacgtattatctatgggtattttcctgctacaatggcagaaatgagtagttgcctaagatatttgctgtctggtcctttacagaaaaagtttgccaatctttggtctagatggtgaggaattttagttctcctatgtgttaactgatacatgatttcgttttgaagttcagcttttaactttcggttatttttctttctacttttattttttactaataaagacagaagaaaaccatggctggttagtctcactgctcagactatgccttctaatgtttttgataataaaagttaaaatgcacatgctaattttatttcaaacagtataagaaagcaaaatctctctcctacattgtcctttattccaattcctttacccagtgttaacatttaatagttaacattccaaaaaatgttttgtttatactagaatatatattcttttcaaaagcttttcttaagcttagtttactagtaaaaatactcttaaccttttactatgaaaaaaattcaaatatgtacagcacaagacagaaaagtgtaatgaaccctgtgtacccatcattcagctttcataactcttcgtcttatagccaatcttatttaatttgtggaatccatttcctgtattattttgaagcaaatctcaggtatatcatttttttctcaggtatatcagcaaatctcaggtatatcattttatctgtagatatttcagtatgtatctctaaaatataataacttttaaaaaacataaccacagtctgctaacacatgagaaaaaaataataattccttagtgtatatttgagcactgagtattacctataattgtctccccacacccacagttgtcttttaaatgtcatagtttattttactctctttgaattaggatacaggtaggtttcacacagtgtgacttggttgttgtcctttaagtctattttaatctgtctgttccctctgtacacactcttttatcctccttgctacttattttttaaagaaatgaggttacttgttagaggttttacatccccatagtattgtttaatatgttcctctctcctctgaatttcctgtgaatttggtagttggacctacaggctcataacattcaagttttgttttattttattactattttttagctaggctacttcactggtgacattgagtccttccaagaggaggcacttagtatctgattgtccttttttgtgatgttagtactcattgatgtttaatgtgtagatcaagtcattccttatgggttgtaaaatgctggatactcttagttctatgatttctgtgacatttattggcttaaatgtttgatttttctccatatttaccagtttttgaagttttttttttttttttttttttttttgacagagtctcgttctatctcccaggctggagtgcagtggggtgatcttggctcactgcaacctctgcctccacagttcaagcgtttctcgtgccttagcttactgagtacctgggactacaggcgcacgccaccatgcgtgccatgtctggctaatttttgtatttttaatagagatggggtttcactgtgttgcccaggctggtctcaaactcctcacctcaagtgatccgtccccatcggcctcccaaagtgctgggattacaggcgtgagccacagcgcctggcctgtttttgaagttttgacttaacttattagtaccctttaacagtgactggtttgttttttggtttttgtaatttttaaaagtatgatatattttagcatatttactgtgttctgctgaagttactgaccctcagatcatcccccttgtggtagtgtgaaccttctcacattggtccctgtgtctgtttggcatgacctagtagtctctgatagctttctctctttctggtacaacaagatgttttggattcatcttacacatttcttgccctggatctggaatcagccattttcttcaaggagtcagtcctgctgctttttagtgggagatagtatttcagaactaaattttgggttcagaggtacatatccataaacaaacagctttttatagtaaaaacacatacagaaaatgcatacagtacaacaccaatgtagcctcaaaaaagaacacagcagagcaccgcaggggatccctttctgaacacagtcttctcccacttccctcagtcaccactcagtgtttatggtaatgacttcctcgattttctttcctgtttgatcatttaagacaaaatacgtccctaagcagtatcacttggttttgtctgttttgaattttatttaaatggatcatgcttcctgaatttttttttttgttgttgttgttcgagacagagtcctgctctgtcgcccaggctggagtgcagtggcgtgatttcagctcactgcaacctccgcctcccgggttcaagcacttcttctgcctcagcctccctagtagctgggattacagatgcccaacaccatgcctgactaatttttgtatttttagtagagacaggttttcaccatgttagccaggctggccttgaactcctgacctcgtgatctgcccgcctccgcctcccaaagtgctgggattaccagcatgagccaccgtgccaagcctcctggattcttttatatcttgcttctttcattcaacatgagattcatttgttttcattttctttgcaatatgatactccattggatgagtagaccacaatctatccattctgctattgatgtacagtcaagttgtttctagttttgtgctgttaaagaattgctgctaaccttgtatctgtctctggttgcacatgtgcatatgtttttgaagggtatatacatagaagtcgaattgctgggttagatgctatgcatgtcttctttccaatgtgtcatgccagctgatatgctcaccaacagcgtgtgagcattcctgttgcttcacattcttgcccacacctggaattgtcagactttaacatttctgttagtttgttgatggaaagtgatatctgactgtgactttggtttggtgtttctctgattaccagtgaggttaaacacttctccatatgtttgagtattggacttttctcctttatgacatttctattcaagttgtttcagtaagtctttggttcattttcccattgagttatcttttattgattcataggcatttttatatgtattgggtacaggttttgattggttgggtgtgttgcgaatttcttcttccactctggcttatcttcactttctttatggtgtcttttgatgaacacattcttttttttttttttaaacacaaatgctatttatttgtttgtttgtttatttatttttgagacggagtctcactctgtcacccaggctagagtgcagtggcatgatctgagctcactgtaacctctacctcccaggttcaagcgattctcctgcctcagcctcctgagtagtggggattacagacatgtgccaccatgcccggctaatttttttttttttttctaatggtagagacagggtttcaccatgttggccagcctggtctcgaactcctgacctcaagcaatctgcccaccttggcctcccaaagtgctgggattacaggcgtgagccaccacgcctggccacaagtacttttaaaattttattgtaggacgtcttcctccactttgttgggatatgtggtatatagtaaagatttcaaatatagtaattattattatatactatttagtattatatgcaacttatatatgatcttttaaaaaaagtcttatatctttgcctttctatttaaatttcctttaaaaaaaattgacaccaaagaaataatagtgtcacattgtttgcaccttactttttcacatacaattttattctggagctctttctacattatccatatgccagtcggcttcattctttgtcatggtggcatgatatatgtatatatttttttgagatggagttttgcttttgtcacccatgctggagtgcaatggcgtgatctcggctcactgctacctccgcctcctgggttcaagcgattctctggcctcagcctcccaagtatttgggattacaagtgcacaccaccatgcctggctaatttgtgtatttttagtagagacagggtttcaccatgttggcccggctggtcttgaattcctgaccttagctgatccatttgcctcggcctcccaaagtgctgagattgcaggcgtgagccactgtgcgcggccggcatggtatttcattgacagaattaaggttgtttttcttgtttaaaattgtgctgcaaaaaactctggtacataatcttgacataattttgcgagtacatctataaagcaaattctaaacatgggaacttctgggtcaaacaatttgattgttttaaatattaatagacaatatttactcccagttaattcatgtaaaatagcagttcatacagcctaaattaggaggtctaactggccatattcagagaaattatctggatatgaagtaattttttgttaggtctaacctgtattaatgacaatatgattacagtattttcaaaagattgacacttagccattctccatgtttcaaaggaataaatgctaatttagccaaataatagtttggagcaaattttgtgggagagcctgcgcttgtgtggagcaaatcccctgtcgtgttgtgaaatgggcgcggagaagcctgttctagtgactgtcgatgctctttgtgacagctaacgtgagggctctccggctcctgagtcatcctcctccccaaatgggggactgaccagtcttttggatctctgattttgttaaagcggaaatgtttttctctcccattccagtaattctttgagtatatctgtttttcttcagatgtttcgtgagcacctgtgttctggggaatagtgaacaccgtgaggaaggtggagtgttgactatgccatccactgtttgtcttcaagcagattactgtcgcgtaggggagttgtgatgtagtgtatttgtataacggtcttttaccataagtgggtattactccctccaggacatcatttaagtcaaggcagctgagacaatcacaaaagaccacgtattttatgattccattaatatgaacatcccaaatagggaactctatagaggcagaaagtaagatcagtgattgtttcaggcaggagagagtggggtgatagggaggtgatagctaaaagatacagggtttctttttgaggtaatcaaaatgttctaagattgaccatggtgctggttgcatatatctgtgaatatattaaaagccattaaattgtgtacttaaatgaattgcatggtatgtgaattatgtttcaatgaagctattaaaaaacattaaaaacaagcaaaaaatgcaggttttttttttttctcagttgtctcagtgaagttttccctgtaggtttcatagttactttaattgaatggatggtaaagagttgtctggtctgggctagatgcagtggctcgtgcctgtaatcccagcactttgacaggccaaggaaggtggattgcttgagcccaggagtttgtgaccagcctgggcaacatatggagactttgtctctacaaaaataaaataattagcagagcatggtggtggtgtggctgtagcactagctactcaagaggctgaggtgggatgatcacttgagcccaggagttcaaggctgcagtgaggtttgactgtgccactacattccagcctgggcaacagagcaagaccctgttgcttaaataaataaataaataaataaacaaataaatattcaagaattctcaggtctggatgtagggttagatgccagttagatataagtgaaatagccggtttacttaccaatagacaggaaagtagtcttttgtgattcccttctccactaaatacaaatcagtgctactcaggggctctttaaagaaggagttggccaggtgtggtgactcacgcctgtaatcttagcactttgggaggttgaggcgggtggatcacctgaggtcaggagttcgagaccattcctgaccaacatggagaaaccctgtctctaaaaatacaaaatcagctgggcgtggtggcgcatgcctgtaatcccagctacttgggaggctgaggcaggagaatcgcttgaacccgggaggcggaggttgtagtgagccgagattgtgccattgcactccagcctgggcaacaagagcgaaactccgactacatgtaccctaaaacttaaagtataataataataaaattaaaaaaaaaaaaaagaacagcagcagtaaaaaataaataaagaaagaaataaataaataaatgaagaagtcaatcggtaccataagaaaggacaaaaaccaaaacaaacccaaagcaaaaccaaaaactccccacaaaccagcctcccctaacccttttaactcaaagcttcgtaatgtctctgaatttataattacgattttaaagagcactgtttctcatgccccatcccccaacccatttcgggagtaaaccttttctgtcagggtgaggagaaagtgggtaaaggacttcagcatttacagttgagttagtatttgttgttctccaaatgtgcaggattcagggccctctctttggtaggtgtgtgggaatctattggtatttattgggttcttaatgcctgcctgtccttgtgtaagacactctggcagtacccaggaatacatcaaccagctgagacaaacatgaagaataattattgtcctaataatagctaacatttattgattgcttactatgtgctaagcctctaaattttaaagttgttgtaaaagcaggaacaaagcctgtgacatgtaccattgtcttatttagctctcagaatcacagtggtagaggcactctcattattttacaggtgaggaaactgagattcagagggcttagatatctcgtccagggtcacatggctggtaaatggtagattcatacccagatcagcctaacagatctgaactttttcttgttgggggagaggggcaatggaatttttaacattttcattgcacaaataatgcaaattaggcaagaaaagcacaaagaagaaaataagaatcatccatatttctacacacagatttgctcatctttaatgtttctgtgtgtttccttcgtttgtgtttttatgccttctgatttatttttatatccagtcaatctctgtcagcccatcagtgaaggccattgctaattcattaaagaccttgggactgaggacatacaaatcataatcaggatatttcatggactggggattgtgggtgggggaaggatgcagatctgacaaattcatgctgtggtctaactcagagagggtcatcttgtcccaaagtgtcccctcagtctttctctccttccccaattaagactgtcttgtgaaataattaaaaatatctataaaggggcaaattttgcagcacatataattatagaaattatatagtacaatatggacaaatgcagggctaacagtaattcttagggctttcacagatgggcaaggttgggggtagggaccggctggaggcaaagagaaggcttcctgagacagaggggactggggctggctcccacccagatgaaaacctgcaaatctcagggagaaagcttcatgcactatgaaaaggtcacaagaacctccagtcctgggatgatgcaggcaagggaaaaatcaaatgggactttccccattgagtcatcaatcatttgcctggtgattggtgggagtcacctgtgtgttgtgcctgttcccagtgggaggttagagcttcatctctgaattaatatcaaaagaagagctgtctttacaaatcaatatgcttctcacaaggggatggcatatttagatgcagaggttggcatggcgaatcggatggtttgagggtagtggggcatctgggttaaaggccctgatgttctacagacttgggtttgaatcttagctgtgctactctcaagcgctgtcacctggcaagttgcttcgtccctcattcgaggaagtggggccactggagcgtctacctcataggcttacaggtggttgggaggattaaatgagatgagcacatgcagcatttagtacagtgcctggcatagaataagtgctccatagggattagctaatgttttataattctaaaggggaggaaagatggatattaaggttggagaactatggatccttcccattgtattcacaaagaaaaccatgccatgaggcttttttggcaagtcactttaactttttgggcctaggttttcttaacagtgagatgctgggtggttctaaatgatctttcaaattctgcccatgactataatcctatgattctgcagttttaaagagcatcttaatgaatacaaagtacttgccagaatattttcttttttgattctccccacaacagtaatgggccgatgatgattcctgccattttcccagaccaggcagcagagctggcagacatttaatgactctccctcacaaggccatggagctcgtgagagagcataaggccaggttccctttacacacatgtggtgtgtaaaacggatgtacctcgattgggcttttgcccttgtcatggaactgagcccgaaggaggttcttagaggagcggggtgaggatttcaggagaggtgattcccaggggagcttcaggccaggactgtcatagtagagcagtaatttatgggcttctgacagcttgaaaaggtcatggtgttcttctttacttataaatgaaaacaaagtaatttgggggtcagggaaagacgaaagggcttgtgcagactgacctcaaaatccctggtggttatcatgtaaaaattcgatttgtttgatgcaattagccaaacctggacactttcttctccttctcaaagcaattgggattcagggcacaggataaaacagagttggggcagggggcagggaggaggcgctctggcaacagtgggaagtccagattgtttctattgtgcgtgctgatgtaattctttttctgcaagccctctgtggtttatcactttgccttcatgcacccttcttataaagcaattacagaatcacgggaaaataggcagtagcagtgtgaatcagtgccttttggaatggagaactgatacaaactgggcttcagtttgcagagggttgaggaatgtctaaggctcgtggatgggggaaggagaagtgacaagggatcacagatattgtatattgggcctctttggccaggccctccagtccccgaggcccttctatgctgcttactggctgcatgagggctgtggctgtggccgtcgccgtgtcagctgagcttgtaatttagatgttaccactgctcaactatgaaaagtcaggatcagcagctttgtcctagtgctgggagggaggtgtgggccctgggggaaccggcagctggatttagagtgtgaccgattccaggaacccaacagagctgcactagggccctcctcacctctgtgggtctgaatttggggtaggggttccccaaaccaaactgtccagacttttctgtattgacattgagtctatagtcattagtgatcagggttccgattaatctgtgtccttattttagagtagcttttggcttagggttctggtgaccaactggtcacaaccataatttagcttctgaaaggccataagagtcagaatttgtctaacaggaatctccacagagatcctgctgcatttataattgggcatttcctctgcatttacttttgccccttgtctcctactccaagccacccccatgtgcttgaatgttgaaagttttgggttgccaggctcaacttaccagcatggttccatttctgtgattattactaactgcattgcatcatacacagagcaagtggttggaaaatagacctgcgtcctagcagtgggcaagagactcgactctcctgaatctcagtgtttttacttttaccatgggagttgtaaaatatccagcccagtataacattggctggatgtaaaacagcctagtatacaacatgggctttgtaaagtgaggtgctgttggaaagttgtttgtagtaaattgtattattacatactatacttatatagtaccaaacattggcccaaagagttttattttgttacttctttttgatctcatcaaccatgccatgcaaaaaaagaggcattttagaaaagagggaaatggaggctcatgtatgttgagtgacgtgtccaggattatttgctgaataaatgtcaaaatcagcagtacaactaggtgtctggaatcttagtccagtgcacctgtcattgtgtgctgggtgcaaggcattaaggctcactggttgtggtcctaagtgctcccctgcctttgcctgcttgccccccattcatttgttcattggctattatgagagcagctgtaagccaggccctgtgttaggaatgctgctaacgagggcaacagggctcttgctctcttggagcctattgtctagtaggggagacagacttaaaaaaatattatggcgtcaattgattctctttattttctgcatcctgtgaatgcacaagggcccagagtggagagagacttggtcccctcatcttgggctttgtcttactttctctttccttctagaaagttgtgagtcagttctttagatgggtgcgtcagggttctgccttcctgtatttgaggctttgtgtacttggtagttggagatgatggacgttgcatttgtgtgggctgaagagaattaaggaagaaacgaggcagggaagtttctccgaggaggcacattttgaacccgctgttaacgattatggcagtggccctttggaggcagctgcctctcttgctgactgtcatgacccaaccatggcaattttcactgagactgcaccttctgtttgtgatgttttagttcaggtttacattatctgagtagaactgggaatgacaaggctatgaggtcctgcctatgcccctctaacatcgtttccccaccagaagttttctcctgaggatgtattaaatgccgactacttccttggaattgctggatagcctttccagcgtgagcaatggggacagctccagaagagtggcacatcaggccagggaggattatcccagattttacagctgggtaggtggaaggcaggtctggcttgtccccacttccatcaaggagtagaggtgatttgcaaatttctctgtggtttggtttacttctttctcttggtcctttgattctttccgccttcgtctttcctttttctttctctttgcacctttctcccctgaaagatcacttggcagaatggttagaaagtactacctttgtggcttagttgatggtgcacaaaataactgaagaagaaaacataccttggctttgcagattgtatccttctggagagctgaattttccagagtgctaaagctgaattgtatccattgtaagcaacaaagcttttttttttttttttttttttaaattatctttaaagaatccattttaaaaggaaattctctgaaaatacattacacatttaactaccttcagaagcagccggctgagaacttaacccgacattctctccatcatgccgggtcactgttaggaacatccaagattctgctgtgctcgagtgatggtgccttcaggttgcttgcccctgcaggtggtggctccagagtcttagacttctctggttcttctttcttttcctgtcccatctggatcccccaaaccctgacccctcagactgttaggtattatttctgcttgtattatctctccctttctgatttgtgtgttaagaaacaagacagcaatttatttagaaatataagaacagcatctgccatgtagtggttcttattgtagatactgcaatagtttgcataaacgttcccatttaacgtccacacagatctgtgaggtgagcagcattgtgatccttattttacagaggcagacgctgagtggtagagaagatgaccacatattctccttgcctggaatacaggaaatgaattcaacattcattcattggggacttctattgtacttgttagatatcattagttaaaaataattgatgttgggggtgttgagcagtaacagaagagttaaaaaatagaatattctcatagtctggttatgtacagggcttcacaaatctttgtgttgttttacagcacttagcgggccttaagaatgagagaaacagtctgcaaattaaatcacaatgcagatgccatcttctcactgctactgtggggtttagctctacagatcagaggatggctgagtatagtaggcattttctttttgtcacgtactgatgtcacaatactttgtgttcttttatgtggtctaattgcttcaaacttgaatgtgctttcatttaaatccatttatgttgcttttgtcaaatgggaatgatttccatatgaatttgaatttacatactcataggcccttgagaccgtgtggatatagtgaacccaactcttggtagacttgggctctatttttgcctcagccactgacttgttgacttgctgaagggccttgaacagaaatgattacttttctggacttaacactcctcagctgtaaaatgaggtaggaaatctgatgtgatttctagttggggacattctagaagattccatattgtatctcaaatgactgttcagagacacagtctttaggtgctcactctagagaggactgtgataagcataaagcataataatgtaaaccctaacttacaagtttctttaaaagttgactcttaagggtattacacttgctcatattttaaatatttaaaaacaattaaaatttttttccttcatattcaccattggcttttcaagcatgcacagaagtggtgtgcagatcgtttcagatcaatttatcataaaatctaagttgataggtgttctcttaatgatgttcttatactgcctgttcaccttgaccctttagctttgagtagattagagagtgtaggggaaagatctttttcccttcaaatactcaaaggatcatgtgttctcttgagcagttctgcaaatccatataggacaacaggagaataaggatttaaagtgaaagatttcagtcggctgctgagctgctgggaggaagagatggtgtgtggtgctgacctgtccctgattgcccctcatagaaagcgaattggctctccccacgttggctcccatggaaaggactgatgggagagagagtgaggagagctggggatgcccttccagaatgctgaccagggcacgtgggagcagtggtgctggctggccttcaagatccctttctgcacatgggagctgaaccagtgagatacagcacctggatcaggcagcgcagaggagcagtgtggttctcctctgtggtgtgaaattaccctggaaccaccaagcagggttcaacagcactgatccctcccatcaacccaggtctaggtctcactccctcagcaccatctcgcagcttctagcacccctggaggctctgtgaacctctcaccctgcattccttgactcttcatgaactgtcggccttcctgtgtaagtgggtcaggcaccatgtgacctgctcactgccagtttcttctttgaatagatgtttatttcatggatcattttgaagattctccgtgggtgtgcaacatggttttagaatgttgggtaatttctcatgtgttctttgagatggatggcttctcagtcgtctttgcagtcagccactgtagacttgagtttctctcttgctgtcttcattttattgctccatatctgaggaaaaccatgtgaaaaatccctagacacataggagccctgagaagtggtggcagggaatgcttgggggacaaaacagattttagagttacgggtattttaattaaaaaaagagagacccagaattgtttttcacttaaatgagcaattatatctttaacttggggatggaaatatgttgtgaaatttgtttagtcagctccctctgaaataaataaaattacagtgatgatatcattcttgtttaaaatgtttgaaaaggtatcaagacaaagtgattaaggcctaactgtttgccaaattttctttaaagctccatttttggggtatttctatgccaaaaaacatcttaaactgatgaacatatagttctccgcacttgtattggctggtttttaattagatgactgttttaatagtggaagaaatacatttaggttgggcctaagccccagggtgccagatttcaatcccagaaaaaaatgttctctctgtttagtgctaatgtgcacttaaatagcacaggtgtgagtgcttttccctggccacggtcacacatgactttcccaagggctgattggttatggggttggcaggtttaaggtcaggttccccggcttgccctccacccagaggagccaggactctcaggctccctgtaagggaagaagttacccagatcatgagcctgttttgtctgggtcagactgacttgagccacagggagtgggtacagaagcctgggttgctgccgggtatgacccgaccttcgtcttgtacccactgtctccttccttttgtgagtcaccagctcacacatctacatgcctgtaaatgaactatgaggtatcgagtatgtgctacctaccgtggtggatgctgggaaggatgaaccatgcattttcctaaacccacacttcgaggtttacaaagataaaatctcatggctctttgccatccccttctcaagaaccttcactggctctctttttagttaggaaagaaggtccaaagcaaaagaaaggaaacacagggtgtgaaggctggactcctacctaacacacctgtccattccaaacaaactggccgtgcctcctcctcgatctcccacttgtgtgggtggctgtgtcatttctgtgcagcagctgatggtgaggtctttcacttggctccatggtgaatggggaaattctcccaggcactcttcctgcctcatctgtgaccgtttgtcttcccctggggctatagtttgagtactaggtggtattttcagtcttgtctttgccctgaggatgcagaagtactctatggctatcccactcctgacctatgcccaggccccctcttccctctgggggtggatcccacttgtacgggcaactcagtgcagtaccctggaaaatggcagacctggggtatctctggtctctgccactgtctcccagtgtgtgtggaggggctgtatgcttgaggcattattttactgtggcttacctccttggtgttttctccaacttggagcttgggtgagaatgctcagggcttggttgacacctcttcattgtcccagaggtgtaagggctgggtcggaagctatgccaccagaagccatgctgccctttccaccagatacttctgtttctcttctcgacatagaccaattccctttctttctttttctttttttgagacagagtctcgctctgttgcccaggctggactgcaattgcacaatctcagctcactgcaacctctgccttccaggttcaggcaattctcctgcctcaacctcccaagtagctgggattaaagacatgcaccaccatgcctggctaatctttgtaattttagtagagacagggttttaccatgatggccaggctggtctcaaactcctgacctcaagtgatctgcccgcctcggcctcccaaagtgctggggttacaggacatttccctttcttgtttgatttctcctggtatcttctttctttctctttggactttctttcctatctcatatttattttgcttggcattgtagtagaaagataacatgttaccactttaccctccagtctgaacttggaactgctgccatacactaaaaggatttactattcttaaggatttccttccatcctaaactacaaactttttcaggtcaggaactacattttattttgtgtattcccactgtaccttcacctgctgagtgcttaataaacccaggacagaattgaaggcaggctgagcctgtataggagagcagttgctttcaagttatgttaaaaactcctgggcgggagcattcaaaaattactcatagataacaaatccagctacctgcacgtgcatgaaagcagggaactagagccactttcagacagtgacttcagcttaggaaacaaaaggttactttaaagtaatgctgttttacttatgtttaaccaattctagttgacacacttattcagaatggccttactgccaattagtggagcatgttagtgaagtttgtaataaagtcctaatttccgtgactaatgaagctttacttgtgttcaacacaatccctgctctcagttatgaagttataaaaaaatgtgtttatgctgttgctgccgctgcccgtctgtctgcctccctgcctgcctgcacagtctttaagagcactgttgctctcctcctgttcctcacgcatttcaagcacaaatccctaccattcatcaaaggcatttgctggtggtggcaggggaaatgtcacagcactgctgccactactgccaggtatctttttaaaatgtaatgtgtgtgtatgggtatgtgtgtgtgtatgacttccaccatttctacgggaatgttttttgattagaaaaagaaatagttgttacatttgcaatttgtaaccagaaccattttctttccaatgcagttgtaacagtgtaatgataagtagggtctttatccaaccctatgacaagtcacatgtacacacgccagacataggctccagattctgtaatatttagccctatacagtcaacagatttgattccctggcagtcagtctttgcattggaagagagagtaaaaattaggactggtgagttcaaaggttcttctaaggcctaagcctttgcagtaggagctttccatactagatatgttacctagagacttgtgttaaagtggaaaatcatgggctgggcatggtggctcacacctgtaatctcagcactttgggaggccaaggcgggcagatcatgaggtcaggagatggagaccatcctggctaacacagtgaaaccctgtctctactaaaaatacaaaaaattagctgggcgtggtggtgggtgcctatagtcccagctacttgggaggctgagggaggagaatggcgtgaacccgggaggcggagcttgcagtgagccaagatggcaccattgcactccagcctgggcaacagagtgagactctgtctcaaaaaaaaaaaaaaggtggaaaattatcatacaaatcatatttgtgtcaatctttgtgagggtgtcctaaactgtaagtgtgcctatatgtgtgttttaaaaccagaatgtctagtattgtaccacagaaaaaagacgttacaaaaatagaaattgtgtcagtaatttgcttttactgctatgaacaatcatatgcaattcctacaagtcatgctgtgtctagcctcacagccccctcactctccaggcctttctgccaaactcagcttctctgtgagcatgccctgatgagttcaaggggctcccttcttcgtgccaccacctttgagtccacaacaggatggctgttgaattgaacatgcacttagatttcgttaccgtttcctaggtctttttcaaatacattccgcttctctctttagttactttttagtctccctcaagggtagggattagattcttctttgttccctctcccatagcacagtttatgtggcttttgctgcgtgaggttaaagcacattggtggcttacatcttatccatttgtaaccacccagggaccagcacatggccttgtacccagtaaacaatcaatattttgttgattaatgatgcctaaagctggttaagttcttggactcaacattcttctgagctcaatgactatttgcattctagtcataaacaggaaaaggttctgttggcagccagggagatagtaaatacccctgactctcatacattgacttaatcagaaacaacaacttccccttttcaaatttgcattgtgaatgataatatcattttcaaatatgtaggattatgacattttaaagagaatataatgaaatagaatgaaggtgaaaacttgtaattatattagagcaaaactatgtttcccatagcttatatcctactatttctatgtagtgtatctggcgtggtcccatgaggatgccataaccaaatgattgaactagaaactgagaaagacttatcaaacatttagtgtcacgggcttgtgagatgaatcaatgctgggatttccagctatgttttttatggccctgtattttacaaagctgtggaaaatattgagcatttgaacaaggctctcagtcacagtcgtataacaagatgcaggatagggctttgcccgtggagttcagtgtgaaagtggctgtggttggtggaccttctgccctttcccctattgctctctggctgctttttctggtgggtgggtgtgtgtgtgtgtgtgtgttttttttttttttttttttttttctgaggtacttcccagggaacagagaaataagttgacaaaaggcacatataaaagagagatctaggactttctaaacctgaggcccacagccctttcatttaatgctatattggcacatgtcttttttctcttcaaatcattctcaatcatggtccatttctcaccaccccctcctcccaacttgttatcagttgcgcctgaccttttgggaaggaagaatctttaaaccctgtttgcatctcagcagacgggaatgcctgcctacttctcatctagggctcctttctctgcctttagaaattcttttttattcttgatacacactgctcagattatttattaatttaaaaattaacatacagtaaaaatcggggtgtgtgcacgtgtatacagttctgtgagctttaacatataaattgttgtatctcttaccacaattaagataacagaacagttttgtcccccgcaaaacttatcctgcctcttgtagtcctattcttcctttaccccagcccatggcaaccactgatctgttctctattgctatagttttgtcatttccagaatgtcatgtaaatggaatcactcagcataatgcctttgatattcatccatgtttaggagtgtggagaaatcgttcttttttattgctgagtaatattacatttatggatatagtacagtttatccatttatctgttgaaggaaatttgggttatttccagtttctggtgattataaaaaggtgctagaaacgtacaggtttttgtatgaatatagatgttcactagcgtaaatacctaggagtggaattgtatatttaacattataagaagctaactgctttctaaaatggctgtaccattttgtattcccaccagaagtgtatgagagctatagttgcttcacattcttgccaacacttaatcgtgtcagtactttttattttagcttctgtaataggtgcgtagtagtatctcattttggttttaatttttatttcctaatggataataatgttatgttatttcatgcgcttatttgccacctgtttattattattttggtgacttggtgaagtgactatttctgtcttttgggtttctttttactgttcaatttgaaaagtgccccatatatcctggatccaggtcttttatcagatatgtgatttgcaaatattttctctcagtctatagcttgtctttctattatctctcttgctctcttttttttttttaatttttttttgagacagagtcttgctctgttgccaggctggagtgcagcgatgtgatcttggctcactgcaacttctgcctcctgggttcaagtgattctcctgcctcagcctcctgagtagctggggctacaggcatgtaccaccatgtctggctaatttttgtatttttagtagagatggggttttaccatgttggccaagctggtcttgaactcctgaccttaagtgatcagctcaccttggcctcccaaagtgctgggattacaggcatgagccaccatgcccagctgtctttctgttctctaagtgtgttttgcagagcaaaagttttaaattttgatgacatccagttacttggtttttccttttatgagttatacttttgatgtcgtatctaagaaatcttcgcccaactacagatcataaagattttctccagtttttttcctagaagttttatagttttacattaagatctgtggtctatggccaggcgtggtggctcaccgctgtaatcccagcacttgggagtccgaggagggcgggtcacctgaggtcgggagtttgagaccagcctgaccaacatggagaaaccccatctctacaaaaaatacaaaattagccgggtgtggtggtgcatgcttgtaatcccagctacttgggaggctggggcaggagaattgcttgaacccgggaggtggaggttgcagtgagccgagattgcgccattgcactccagcctgggcgacaagagcgaaactctgtctcaaaaaaaaagaaaaaaagaaagatctgtgttctacttagatttaatttttgtagaaaaagtatgaagtttaggttgaagtgcgttttcttttgcatatgaatgttcagtgtttcaactctatttgttgaaaagcctatcctttctcaactgaattatctgtacatttgtcaaaaatcacttggccatacttgactctatttccagactctattctgttggtctttgtgtctgtcccttcaccagcactatactgttttgattactacagatttattgtaagtcataaagcggggtgacttgaattctccagtttcttatttctcaaatttttgtcgttcattttaattcctttgtcttttcacataaatttcagattcagcttgctgacttctaccaaaaaagcctgctgtgattttgattgcactgaatctatagatcgatttggggagaattgatatttcaatcatattgttttctaattcctgaacatgatatccttctctatttattaaggtcagcttctgttgagttgatcatgtgcttttgacctttattctattaatatgatgtattacactgatttttgtttgaacacaatctcacgttcttcatataaatcccacttagtcatggtcaaaatgtttatatgtttatatactgcattcagtttgctagcattttgttgatgatttttatgtctatattcataagagatgttggtatgtagttttctttgtgatatctttgtgtggtttttggtatcaggtaatactggccttatagtattccctcctctcctggtttttgtagaagtgtttatgaaggattgatgtgaattctttttttgaacatttggtagaattcaccagttaagccatatgggtttggccttttctttgtgagaagttttttgattactaattcaatctcttcagttattataggcctgttccaattttccatttcttctagagtcagtttcagtagtagttatttatttatttttcctgagaacttgtccatttcatgtaggctatctaatttgttgactgcatttcttttagaatgaattctcttagttttcatccctctgagattgttctttcacctgcatttcaaaaggatgcttcttgctaggtaaaggattatagattgacagctcttttctttcagcactttatcagaattgttcctcttctttctgacctccatggtttcttctgagaaatctgtaataattcaaatcattcttctctatgctgtatgttgttttcctctggctattttcaagatttttttcattgtctttagtttttagcaatttgtttatgatctttctaggtattgatttctttgagataatcctgctggcagtctgctgagcttcttgcagtggtaagtttaggtcttttgctaaatataggaagttttcagccagtatttcttcaagtatttttcctacacaacaccgtttcttctcttcttctggaactctagttccagtattttagtattttctttttagtattttcttacagatccctgagcctctgcttatttttataatctttttttctcttcatgttttacattagataatctctattaatctaaattcacattcactcactattcctgctattacctccagtctgcaattgaagctatccagtgacattttaagttttattgtatctttattttcaaaatttttgtttttgctatcattccatttattttaagagtatttagccttacttcttggagcatggttaaaataggtactttaaattatttgtttgataattctggtatctatgctatcttggggttggtgtcttttgattgtctttttccttgcaaattgagagttttccagtttttcgtatgttgagtaattttggagtatgttctagacatcttgaatatttttattctgagtcttatttattatggagactgtttatttccttaagcagataatcgacctggttgcaaattctgacctgacttctctgggctatgtttctgactttggttcagttttcaaagcctttacagtgtcattttagtctgtttcttttgtgtgcaatctattgttcagtctgggacctgggcaatgatatcctaaagtgaaaatctgaaggccactggcatacttttagggtcggatccacaacgaagagcttaaatgtgagcccacatgttaatatgcccctttgtgatgtaactctcttgagcttccttggttccctgatgtcctctttttgctgtcctccagctagaaagcgaggaatttagttcctctgttctcctgcattactttacgtgactgtgtccaaggccaagcgcttgaaggtcagggagaaaaagaagcaatggaaattcgccccttattctgggactacaactcttgtgagaatcattcttctttctcagagttttaggtacctgctccgcctgtgctgctgcttcttggtactgagggattgtctgggggctggggtgggagggattggaaaaaaacaaagcaatacagataatttctctgaacattaggagttcctttttttttttttttttttcctttgttggccagaaaatgagggttctcttcaggttatttctgtccatacccagctagcacttttggatggtgagctgcctttgaatccagactgggtgatactggagggggaaaacagtggaaaattctctgctggtttggtgatactctgagttctagtctcatttctcaatctatttgttgttatttacttttcagagtcctctgattcttcatgttttctgtctagcttatatatttgcatttggtaggaaagatagggtgggagttcttactccatcttgcctggaactggagcctctatattagtctgtttatttattaatcaaatcctgcatagagtgggatttaccaagcctggtttcttgagatcctaggatgtattcataatatgtatcatggaattctcaaataatgcttatgataaaataagcttaaattttccttactttaaagcagaggctggcaaatgttttctgcacaggaccaaatagtaaatattttagtcttgtggtctcatagtctctgtcataacttcttaactctgctgtcatagtgtaaaagcaaccacgaacaatacataactagtaaagatagctatggtccaattaaactattgaatgacactgaaatttgaatttcttatacttttcatgtgtcatgaattattatttttttgatttcttacaaccgtttagtaggtagtgggccagatttcgcccatgggccaaaatttactgaccactaatttatgtcatggatggctctatggccctgatcaacaactcctcttgattgaaattttctgtctgttctggagaaacaaagataggaaagcaagagaagttctagaaatcctatggaatgcttatggatacaacctgtaagccaaagtagcttctcagtcttcttttgaactccttaggtagggcacagagagagctcatagatgttttatcttaattcatctccatattactttgtaaggtaaatgctttcatcttcattttatggatcaagaaactgaggcacagagaggactgctagcatgtctcaagtcatgactaaactgggatttgtatccaggcctgtccagcaccaaagctgttgctcttcacactctaggatggcacaaatctcctttttttctgttttatcttgtctctgtacaaaaaagccatgtcaataatggtataggtcattgaaagccttatactttaagactgctgcgctctggtctggacttactcatgaattattgcataactctgggcaaacctcttcatttctcaaggtcttagtctccatgcctataaaataggggattggatccctattttacgtttatttctctgtcatggtagctgtgagagttttgtcagtgagcatcctaatcacagacagcgactttggaaagagatggtacaccttgtcattggagggctgtggggagttgtagagaacaagcttcatcctgggaccatgtgtgatggctgttgacatagagctttgtagctgtcaaggaaaatagagtaaacacactacttccttttgatcttcagtttttcgcagtatgctcctagatcatacttctcttgatttagtgatagccttataaattattgccactttctttgaacccttattggtataagtcggtgataaatgcttgagaaactgggccttgatgaagtactggtatacctcgtttggaatttgttctgaaaatggtaaagcatttcttaaaggctttgttataatatgaaaatgttcattgctttttttgttcattctataatttttttatcccttttacattgcatgtcttgattacatagttgatttgatattctctgaaatgtgatggaaaagaaaatgtaaacacaaaattaaaaagcagaggaatgaagacacattttgtgtgctgcttcgtgccagatagttttgtacatatccttgtacaaagtagtggtctcatttttaccacagtgagtaagcccctggtctctacctttaaggaacttagagtttgataggcttagtggttctcaactggcattaccctctcttgagggtatttagaaatctgtggagcagctgcaattgtcacaaatattgagggatgctgttggaatttagtgtgtgggattttatcacaatgaagaattatcccaccaaaaatgtttatagatctccttttgggaaacactgtgctgagtaaaatagtagtaatgataataaaaacacttgcatattgagcactgccattgtgttcagagaactctacagatacagtccatattctctgatatgtagctctaaattcagaaatctctaaaattgaagtgggttttttattaatccatttggtaaaatgtgacctgaattgatgtgagaacttttatttttttaaagctgagaactgtattttttatagctgtattgaagtatagtttacatatcaaaaaattcacctgttttaagtgtacaatttggtgatttttagtaaatttaaaaagctatatgtaactcttaccacaatccagttttataacattttcataaatgcctccccccccaaattctcttgaacctgtgtgagatgatttccagatgtttcactgaagaaatatggaagtgtttgattatggagtgctgctccagatccttcctgaatgctaggtattcattcattttgaattccaaatatacccggctgcagaagtttcttgtaagagattgtggactgtatgaacacatcccatccccacaataaccctggaaagtagatgctattattgttccttgttttgcagttcaggaaactgaggcatagcctttatacaaggctgaatggaatgtcacaagaaagtccagtgggggtccagaagagaaaatctgtgaccacttggcctgtaaccgaatttgcctatatttaaagatggaggaaataatctttttgttttgttttgtttttttagttgatactaaaggatatgcataaagtatttaaagtttaactcaagatccagtggatatgtgtggaccctcactacctagtctataactcaccacacctttcactcctttgggtgtccatccttatcctctgtccccctcccacagggatgaccactgtctaaaatttgtgcttatcaggccaggcacggtggctcacacccgtaatgccagcactgtgggaggccaaggcggatggatcacctgaggtcaggagttcaagaccaacctggctgacatgatgaaaccccatctctactaaaaatacagaaagtaaccaggcgtggtcgtgggcgcctgtagtcccagctacttgggaggctgaggcaggagaatcacttgaacccgggaggcagaggttgcagtgagctgagattgcaccactgcactccagcctgggtgacagcctgggtgagggcgagactctgtctcaaaaaaaaaaaaaaaaaaaagtgcttatctttctttgattctctttagttttaccacatatgttttaattcctcagcaacactttaattttgcatatttttgaagtttatataaatggaattatactgagtatattcttctgtaacttagttttccctcaataatacttcttagatttatcggtaattcattagttttcattgttcttttgtagaatataccatgatctatctatactttgactgttggtggacatttgtgatgttttctttttttctaaaaagagataattcaaatggtgctatattgaatagtcctcctgaatttttcttgatacatatgtgctaaggattatgtaggcatgaaatttcagggtcctattgtgggtacatcttcagctttattggatgatgcctagttgttttccaaggggttatataaatttatactccctccaataatttatagatgctaaaatttttccaatctaatggttctaaaatgatatatcattctgacttgaatatgtatttctgtgatgactaatgagattgagcatcttttaatatagccatttagttttccctttttgtgaagtgtccgttgagtcttatgtccatttttctactggtttgtctttttttttgagacagtcttgctctgttgccgaggctggagtgcaatggcataatctcagctcatttcaaccactgcctcctgggttcaaatgattctcctgcctcagcctcctgagtagctgggattacaggtagttgccaccatacctggctaatttttgtatttttagtagatacagggtttccccatgttggccaggctggtctcgaactcctgacctcaagtgatctgcccaccccggcctcccaaagtgctgggatttgctgggttgtcttttgaatactcatttattaaacttctttatgtgctctggatactgatcctttgttgtttatacatgatagaaatgttttttccttctttgtggcttgtccttttgatctctttttggtgtctttggataaacagaagttcttaattttaatgtagctaatttatcattttccattaggagtttttttctttagtttttaaattagcgtttatggagtactttgtatatcctagacacctttctaagcaccttataaatatccattaatccttataacattagaggcaagtactgttgctatttccattttataggtaaggaaactgaggcacagaatgttaagtgactttttcaaggtcactcaggtagtaaatggtagagccaggacttgaaccaaagctgtttaaggaattcttaagaaaaccttttctaccatgataagatgtgcagatattcttatatgtcctctgaaacttttttgtttgtttgtttttgttttttgcctttagcatgtaggtcttcagttgctctctaatagatttttgtgtgtggtatgaggtaggggcccagtttaatttttttccatgtggattatcagtgtttcagcacagattacttaaagtctaaccctttccccacctctataatacatgccttataacaaatcaaatttccttatatgctcatatctatttctgggttcattgttttagtggtgaatttgtctctgtgtcagcactgtactgtattaattagtatgcctttataataattcttgatatcagtaagtcaagtccttccatcttgttctactttatcagcagattcttggaaagtttcctactctttaaaagcaagattgcaggataatttttgactgtaacacacacacacacacacgtacacacatgcatacacacattggggctttggaagatgatttgtcattgctattgtattgacttgtttcctgaaaatttagcagatataatttcatttgagtggcttgagctctatttatctgcatggccaaaatctcaaacacacatgatgtagtggcttgtagaaagcttttgattcttgttaaatggagaggagggagaaaggaaaggaaaatcagtctggtagattactagtgtcttctgtttaagttcagttgcgctgataattccagaaaatatactgaggaacttcaaaaggcatgtggaaccttgtgtagtatgatttatactaatcatagtatgtgtgtatgattgtataaggtgaaaaacaagataatgcatcttctatgattaagttgccttacttatcaagtaagaggtaactgtaccccgttggtcttaaatagctgatatgtggtttggtacttaatactgtctattggaggaattgaaatagaatacccagagatacccagagtctccactgggaatacttctgctccccaaatgtgatatcagagtaatatcaagtagaatgtggagtacacccacctatcgaggcacaaactgccctctcccatgaccctttctctgtagaaagtattacttatactgtaaatagcagtcaaatttcaagtaacatcagttctctacatcttagccttttccaatctgggtggccaaagtgaagaatgattaggtactgaaaatttataaatgccgtgtctgagaatttctagacaatgggaagacacctccctaaggaaacctgtcagtctgaagtcttcccagctttcagagcatagcaagttcttaccatagcctggagaatatgtgatctgccagtgcctgctcccccttcacctcttactgacatcccccttctctctgcaagagtgactgccttgctgttcttcagaatgccaggcaccctttcaccccaagcatttgctctcctcttccttctgcctgtatgtgcttccctggatgggtgtttggtttactcctgattacctgggtctctgctcgaatgtcatcttctcagagaggtcctccctgaccaccctctcccataatagcacccacattcatctctgccagccctccctgagttcctacatggcacctgacacatattcactgtctgccctccctcgcttcccctccccacacactaggaagtcacttcctagaggaccagggactttgtctttttaactgctgtttcttccacacatgtgccacagcgtggcacatgggagccgcttgagagctgtttgctgagtgaaggaagctgttggctgaaaggagggcagagagggcctctggagcaggcccgtgccccaccagccctccccgagagctcctgcggcagcttgcttgcctctctgtcggaaacttgcaccatttaggcagctcttccatgagtattcttccattacatgctaagcaccttgagacaaaggtctgtcttaagttctttccctactgtcacccctgctgttttccttcagggctcggactgagcctggcacgctatttgctcatgctatttgtcttcagctatctgttaagaaggcatgcgggtagcagtcatcctccccaaggggagcagcagattaggcagcactgtaattccttaagcaaactcctggcccaactagcatttccattctgaattcctctatgtactgtctttgagtcttatggagacgataatcttggtgagaaaagggaccagccatattcactgcaggatctcccgtggatgcatagcatggtgccagaggcatggtaccccaactcagcacacactcactaataattcatcgctaaagttcactttggcctatgtgaaatttattattgttgatgtccaacattacactaaaattataagaatttatgtacaatctctgtacaggatctgtagggagcacacagtttttcattatgaaagaggcttcgttgctcatctcagctcctgtgctgttgaacaaaaggtgttagacacacacccattccctacttggggtattcacaaatgtcagacctcaaagtctcttctgagtaaattactgcctttgcttcatttaaaggtgcccttgtgaccttaaagaattcagccacctttcaaaatagagctgtatttctactcccacctcaccagagggtgagcctcaagtgtttgattacagaggagcgagaacttactctctaggattaatgtaataagagatgaagagcagacaacatagccactcaccgaaaaccatgtattcataaaaaataagccaagcccaaagtctggatttcagaatattttcattaataaatactttattgcaatgaacagcttaattgcttaatctctgtgtagttatggacatgtcttgtatacactgcctgggctgtatacactgtgtacactgctggctggatgggcttaggcagaagcaagggtcaaggcttttgccagtcttgcaaggcaggcttgcatcaggaattcctagagactgaggagttctcattgtaggtttctttctgactgaaagaagcatggtgcgggcagagcactaggctgcgggggttagaagaccttgcctcacgactctaaataagtcgtttaacctaattgagcctcagggtcctcccctaatggagacggacacatcaaggggctgtttggatcaaatgagatcatgtgactgtttgtggataatgaagttctgtggaaagaagatgggagggtagcattgcatactgtcttggtaagacctcagacttgcttagctgcagctcttcaccctcttacggacctgcagctgagcagctaagcgtgattggaaatgtcattcagctacgatgactggtattctttaaaatgaccactgacttcaagcaagaacttcacaccactggcattgatgctacattcaggaccattctttctcatttctagacagtgatttcatatattttcctctctcccgaaacctccagcaccttccagcctcactctcggccgatggctttacttcccatttccctgagaaaattcaagccgccaggagagaacttctcaaaagcgcccactgccacatccccctgcctactcttctgtccacagatactgctgcctcccctgttagcatgggtgaccatacacactccttgctaaggccagcttctttactcgcacaccaggttgcatccagccttgcctgttgaagtccatggcagtgccgttctcctgcctctctcctgctgtcagctttttcttctagactggatcttcccagtcaatacacacaaacatactcttgttaatatctcccacttagataaccctttattgattccttttcagtcattagctactaccccatttctcttttcctgtatggctaaatactttaaattattttccatattccctgctgcctattcctcctctcatattcctcttgaaactcatcgtcatcaggcttttgctccctccagcctaccaaatctgctgtcatcaagatcacaactggtcttcctgctgttaaatccagtggtcagtttccatccctcactgtacttgattccacatctagcatcctccctcgttaatgcactttcttctcatcttctcatggctcccaggataccacactttcctggtgttccccccacctcactgttgcttcctttcagtcttctttcctgattcttcctggccatttgttgtcttgttggagtgcctggaggagtctttaggccttctcctcctatttctatcagcactcgctccctcaatgatcttacccagtctggagtttcaaatccatccagaagctaacatctcatgcatctccagttgaggcctcccttccacactgcaagttctcacatccctctgcccttggagaggcacgccctgtcctacttaccctcccaagtgcttaccactgctcactggcttaggcgtacgtgttggccaggggttgtcatctctgtgctctccactagaatgtgggctccacaatggaggactccgtttactgttgtatccatagcacttagaagagtgcctggcacatagtaggtacttattcaatattttgttaaaggagtgaatgtgttaggtctccatatacagtggagattctagtaattcgctgtctcaggtcctgtctcaactctccctactagtattagggcgccctagcctttcagagatggtctttgtcttggaactcttactaaatctatttgataaaatatgattgtttctctagaactctgttgaattgataccaggcattcaactatgcagtattaaatgtattctttatcattgatttggggaggctatttgggatagtagaaagatctttgactttagagccagatacttctgagtttaaattcttgctctgctgctaaatagctacagagccttagtggaaacatacagtcttaggccttagttttctcatttgtaaagtgaaagatttggttcatagggctcttgggagaaattacatgctgaatatatgaaatgcatctagcataatctctggcatataacaggcattctatagtggtaactatgatgattatggtccttagctatacggataatcttaggattgcttgcaattcaaaactttttggaaaaaaaaatgtaattattccttttaaatactggccgttggtctttggttcagaacataattgtctaatttaacattgtttctgtggtaaaagttagatttgatttacatttcaacttacagagcctttttcaggaatttattctgcttcaaagatcaaggacttcctttcagtgaaacttaacgacagtgcttaggaatggaatgctctggaaggattgtcttctaattaatgagaaaggagcttattttgtgggggaggttctaaaatgcctttatatgtgcactgagcataattccaaagttatacagtaaacactccatgaatacttggttacttgtttttgctccagagatacttaactgaactcctctattgattgccctgaggtatagctatggaaagtagaggtgatgctactaaatacaaattcaacataggcttacaaatatcttagaggagcttttctggctttgaactgtaaacgtcaacggagctatattcatgataattatatcttgattgtatcttcttagggaaaggattgtcaatggtcctagctcaaaggaaattgaacaaagaagttaagatagcacatgcaaacatacacatccgtgtgtgcccaaacatacggactctctcacactgttaaataatgcatgagcaaaatattaagtgcaaggtacagtctaacgcatatcactctgcagtatgtggtaagtgccaaatgaacaggataaatttaagtactgtaatttcaaagaacgagtcattagcaaaggctaaaaatggtcaaggaaggcttcctggaaaaagtgagcttggagctgggcattgacagatgagtcacactgtgcctcatgatgcagtgtgcagaactggtccagccagggtcaagtggatggctctcaggccagtccacaccctcctctgggggaactagggcaagtctgctggctgcctcagtccttccctgtgaatgcagcccattattcctgaatcacatccttgtctgccattggtgattttgggtgcttcgtgggctttgggtcaaggcagggggttcttaagtggggagggcaggaaagggagtttaggatcacgtttgttgtggggaagtatctgaatgattcatttgctgtgcgtgtctgaatctttctttggagatgagttgatgagggcaagctttggctgtggatttctctctggtgatgtgatttgatttgatggataattatggaagagaaggaaaaggagattcaggattcagacacagaaaaacctgacaaacgattcacaaacacttttctccacccacagaaacccaaatacttagactgtgccttgtggcaggggcagtagggtggctggagagagctgtcacatgcactcacttgcccagctccatggattgtttacttggcagccatagctgtcgatagttggttatacgaatggggtgtgtttggccaggatcccgtagtctcacttaggcctttcataatagtcatgacaggttctctgtggtcagggaggctgggatagaggtgggggagctggaaaaggatgggccacctctgtcctgtccatagggtgacagccacagttctccataggaaccaaacctgcaggtgtgtcagttaaccatgaaccctaagcaggaaaataatatcgccttttttagacctccgcaatttgtgtctctgcataagacaatgagttttattgcaaaggcctagttacaaaaaagcgtgtcctgtgtgacgatgactgtgactgtcccaagctgttctgcttcggtaggacagtccaaaccagaaccaggaccaggcttgcttgacaaatcctctctaaaggaacaggtggtaggaaacttctgaccctcagcgattggactcaaaacattctctggaagtgccttagacattaccctggttttacaaatgagaaaactaccactctgtccatggactgatttgtttgaggttaccaaactcttcttgcctgtctctttctctctttacatgctgttaatttgttgtggactgccagatttacatctcttcccctgacctgttgctattctagacttgtatgtttcaaaagcatctcaagcttgccatgtgcaaaatggaatccagctctttctccaagcctggccactcccagcccttccagtcccagtggatggtgtcaagtccacctagggtgctgaccccacaagttgagcctgagaatgtcttggatttctttttatccctctaccatcgaaatcatcaacttttttggccctctctgcctctggtttgtttatttatttatttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaattttcgtattttttatagagacaaggcttcaccgtgttgcccaggctggtctcgaactcataagctgaagtgatccacccgcactggcctctcaaagtgctgggattacaggcgtgagccacagtgcccagccttctggatttattttgaacctctccacttatttctctttgtctctgctaccacctccctgatctaaaccaccaccatcctttgtgcctccagtctcttctccacacagtctccagagtggccttttaaaaacaaagctgagcatgttccccgtctcaacacccgtttatagaccatctttatatgaacagaactcaggctttgtgctggcgtccacaggctgtgtgtggtccctgtctctctcctgcaaccctgtccatcttccctcttgcccatggcacactggccatatcagcatcatttcagtgtcctttgaatgataaatatttgttgccacagagctttcaaacatagttttccacctgaaaacttctttttatccattagtttgtagcttagatgtcgcctctgttaggccttcatggattcctccatctaaaaagtcctcccatatttttctctatcattatggccagcttgttttcttgacagcatcatttatgattgtttattaattgatctggttattctctgtgccaactgctggcaggaaagggctgacatttgttttgcacccccgtaggagcgtccttttattcccagctggcttcctattactgtaccttcccctcactcctccacacttgtctccttgctgttcctcagccgtgccaggcttgctgtgccctggggcctttgtacttgctcggccttcttttaagaactttttttaaatactggtatctatgtggctgactctcattttctttagatctttactcagagtcaccttttcagtgacgctagctctggtcccagtgtctaaaactgcacctgcccctgacactccatactgaacttcttggctttatttttctcctttgtgcttctccctatccaccatatggcacattttacttatgccatttattgtctgtctccccagctagaatgacatctccatgagggcaaggagtttcttctgttctttcactgttgtatgtccagtatctcgaatagctctgggcacacaggcactctatacatggttgaatgaatgaatgaatgaatgatttcatgaacaaagtgtgtccagtcactggcacatagtgggctctccttatcctttttattgtggtgagatacagtgtatcattttaacaaattttaagagcacagttcaatgacattacatttgtattgttgtgtaaccatcaccactgtctgctccctacacttttctgaaatgaaggagtcgaggaataagcaagtaattgagtgagggactcttggcaaagcagttgtacagtgtcgatctcttgacttggaggcccagggggtcctttccattgcactgtgctctggaggaggaagggcaagaagatgagtctgagccccatctcagggtgctcgatgcatgcagcaaggaagctcagtgtttccacacgtttcaggttgcctctgttctaaatgacgagggtgctgccctgtctccccttccttctgccgtgcacacacctgctcacacaggcaccatgtgtacacatcccttcctctgcactggaggaagcacctttgcaatatttccagctcatgggatggtgtgaaagggatatgctcattctcctttgaacccttctcaccggatctccatcatgaggggactctctctgcctcccttggtgttctcatcagcacctcgtcaggtgagtattccattgatggcagggaagtgtttatttttaattctaaagtaaatcagattacatagaacacaaaatgttgtgttggatcaaaaccattgactatgaaattctcccagatggatgaaaggcgggggcttgttttcagcccttaaccacttcttctcacaagctggttaaattctacgagaagtccatccttgcgagcacttcgccatcacaggcccttcccttggggagctgtggcatctcccccacccccagcacactcacaccccccagcagacgggaacattctcatgctcactgtcactcacgtgtgtgctgtcccacgtgttctcactcatatgcactaattacacacacacacccaacctgcaggtttgcttttgacacgccaggaattacatgggagcagccagagagcccaaagtaagccttgagatgactttaacccctgtgaagcccacagggtaagacccctgctcagaccaacgtgacaggctcctgctcatcacgtgagttgccctggattcctcgatgacgttgcaatggtgtcttctcaacaaaacctcattgaggtcttgagacaggggcgcaggccaggcacatctaagtgttcgaggtcttctttgttgaattccacagcattatgtgtgcctccaggatgtgcctggcacatggttggcctggggtgtttggagaggactgggtgtaggccggaccctagaggagcttataggacagtgctggcggcagaggtgcccatacctgcgtcctgcatgatgttgcgagcgtgatacccgatctgtgcacaggaagctgcgggagcttggaggaaaagagaaccttgctctgtgggatgagaatgcaggtcaaggtcaggggagagttcagagaggcacttgccaacctgaaggtgtggagatgctgccgtgcatgggcaggaaggggagtggtggggcagagaagtcagggtgtggggtgggggcatggttccaggaagcttcctattttgtcttgtcagcagtagataggaactggattgaatcgggattatgctcacttctattgttagctctgatcatttgttgtttgacttcctgctttcccactagagatacgagtacatggcaagagatttctgaattcccacaccacaggtgtggccatggtgcacagcattgcaaggtccagggtcagtcgtcattttgctggtaaggaaggcataaactaacagcccagtagacaaatagcagtgtcccttcatgcggttgttactttgtgagagtaaagacatacaccaattggtttaatgtattcgggtagattttctactagtcgtgtccgtttaaaaaaatcaccagtcagttctctttatcggaaaaggtactagacacctgtagttgagcatgtgctgagatctggtgttttgttaattgcagtatttgatgatactggcaaaagtcactaagagaatcctcaaaacatcttgttagaaatgggaagaatattccttgactggcaaattttttttctgttcttaaaattaagcttataaatggctggaaaaattagttattttttccaggctttagttgggaagagatttttgtgtctggtgggaacgttccctctctccgttgatgcttgagaaagctacaagacgctgatggtgttggtggcagctttgccttatcggctgtcctggatgtcttggcctcagataagacacttaacccacagtgggagcatgctgctgcttttcaactgggaaacgttaccgtctgtttccatcacagtggcccatgacgaagttgaaagatgcctctgacatttgttatattataaaaatgccaagaatctcctaaagtttgactcataggtcagtttgctttcttaaaacaaaatggcaaccaatgaaagttttctggtgagtgttatcctccgaaattttaagtggatttaaataaagttcagtccgtggatgagaggattctcagtgaaattttcagtgtgcagaattactcgaggccattgagcagagtcattgctttctgtaatgttttcccataagaacacaagaatctccatcctccatcagactaatagtttttccagtccagcattttgccactgagaatggaattaagggagttgctgtgggaagaccccataacccttccagccatcacctcaaaaacgtaggagtgtgctttaaatatgtgtaactccccttaataagctattatggagcccttattcatatgattcttgaatttgtctaaattgcatttgcagcagtttttattttgggctgttaccatctggtggaacgtggcgggcagtctgaacagcagccagtcaggatttaccccatatcaccaccaaaggatctcagtcctttatccattcaattttcatgctgattcatttgattcactaagtagaattgataaatgcctacattgttcacctatgtgttgatttttggctctttgtaagggcattgctttaaatcatgttaccagtcagttcttattcttcctcttaatatgtaagaagtgcagcttcttcatattggttccaaaggcacaactcaccatattttctctttcattttctacaggggcaatcggagctgtagagcctctggttggtaacacccattgtagaatagtggggtgtgggcctcagagagactgaggttatcgctggccccattgtttactggccatgtggtctggagtgctttgctgcatctccctgggcttggcttcctcatctgcgaggtgggggtaataggtggcttctcataaaattggactcactcagactccctcagttgcaagtgatagcccaatttcagtggacttctgtgaaaggtgcagctgacctcaggtggtgctcgattccagggggtgctggggaggagctgtctctttcttcatctctcagcaggggttgtctctgtttggctttctcctaggatgtggtggcgaaatagccactggcagccctggatttatatcttaccagtgtggcaacccagccaaaagagacagcatttttctaatagaaaaattagagaaatcccatggaggtatctaagtgcttggcatggggcacagtctgttctttcctgttgcggccaagggaggagagttttctggccctgcagtggccagaagatggagtcacttttacccaaaccacatggggaaaggattccccacagaaacggaggttctcaccaggggaagtggagggaggcatttacaacagtgtgagattacaacagtggccgccctggagatgtgagggctgtgaggcaatgcaggcagagctcctcaggcagaattctgtcatgcagaattcccagtagatggaatccagcctcttttttccttccctttactgcttaaggaatgcagcttctttagattgcttctaaaggcacttccttcaaacattaagttgattctacctttaatacttttataaacttttaattctatgtcctctcaacctggatgtgttttggaaagatttattttaagaggggggttggtatggcagggggaaatttcacttaatctgctttttgtcattcagtcaaaaattacgtatggagcctctgctgcatacagaacaccccaaagtctgtgggggatggaaaggaaccatgagaagcccctttcctggggtgtctgtggcccgttggaatgtgtggtgggtcaagtgtgtagattctgtggtataaggtggaatatgggcaagtgctgttagggaggtgggaagctggagggagcccagagtggagcagagccccatccagctgggacaatacaggaggactagatggagggggtggtatctgagccaggcctgaggaggggtgtggttttataggcatagctgttgggggcagagtggggtggaaggaggagtggcccagcagaggtgagggagagggagctgacagcttcattcttgatgctcactttatgccaggctctgggcatttggacaagtaacagttcattgctctatccaaggaagaaccccatcaagtcatgggtgcccagccgaaagtctttaaggggtcgagtgagggcgtggaggaggcagccttcaactttcctgaaaggcacagagatgggatggtgaggatgaatctgtgaaatgatgatgattcctgggtttctggaggcggaggtctacaaggagggtggtgcaatggagccaggtggtggaagaccttgaatgccagagtaaggagtttggtggagattgttgaggcactagttcttcagggaaggcctcatgggtgtgtgttctgtgcagttgcccagggccccatgctcagcttaatgctatggtattgtcctcttgaaattcttaatacttttgaaacaaggggtcctgcattttcattttgcactggacttgcaaatcaaagcatgcttgggggatgatgtactttagaacagagctgtgctttagagaagaggttgggccatagttgggaggctgtttgcatccttttgaggaagggggagtaaagggcccagacgaggatgggtatgctggggatggagggaattcctctgacagcctgtggccaggcccgagcagcaggcggaggaggagccgccatcagctcttgactgggggacattcttggagctgtcctctaagtcaggcctgcaggtgacttccagggatagcgttggtgttccaaacggcaattgagaagactgtcttaatatttttactctcaacagtaagctaaagctgacattggcagtctcattcaacgaatgtgaaataaccagaaaagacattccaaggcgttctggaatcaaacagatggacggagcaaacatgttaaaaacagtaaatcacaacttgaacttcagctaatcataattgcatttctctttccttatttaattttgaaacatcttcctaagtagttttttattttggttgcttttacttaagagaccttgttattatagggcaccccagttaaagatgcctcatatatgacatctgaaccaaaaaaccttatcatttaggacatgatatcctttctgaggtttgagaagtggctattttgtctcttacaaagatttgtagggaatttactgagggaattgttgagggactagtgagcaattcttgttcacatagaaatgaacaaaactgcatttacccagtgattttcaaaaacatactcccagtaaatcaaggttgctctgaactgaacttagggtctcaaccagctgcagaccagttacatcttagcaagcagggctttgagtggtgcagtgggcagagtgtgtggctctgacctatcaggtgtgatcccctcctactgtgcactgtttcctgtctggcacagacacaggcaaagcacttttgctgaaaggacagaaagactcaaggtgaaggcagtgccatgcaggccccggatgctgtgctgagtgtcttggaactgaggaagccgctgatggccagtggggccagggcagggcttgcgaaaagattcaaggcttcattccagtcacatggacagactggtactgcttttcacattcttatcaaaaagggctgcaggcaggtacaaagaccactgcagcctttcctgtcctcatggcattgccctacaactggccacctaaaatgaccttctctgctcctgcatccttttaggaatgggtaacttggtaccattcagatgtgccatgctgaaaaaatgagagtgctttcttttgagggagttgtggaggaatacatgatgtcctatatgggaggcccataaggttagtgaggtaaaaaaaagaatcaagagtttttcttgctctgctcattcacccatagtgatggagagatttgatttcatctggatgctcgtgttccactgacagtgagtactgctcagccagtgctcgccgccaggtagttaggtgtgtcttttacaatgtttagcacagcgaatagagaaagtgcctggcagatgcttggccatctcctctgcatctcccatagtaccaagtatcttgccttgtgcacagtaggtgcttgtctgtggggcaaatagatacatttgcagttgaagtaatcctgtttctctgcctgaagtaagagacattcaccatctgtagagtgggaattgtgacttcctctagatgcagggacagttttgtaataaagcatcctcataacctcacttggccctttttggcacaaagacctgtgaaggcggagaccatgacctattttgctcagcatttatttcccagtgcaaatactcagtatttgttgaatgaataaacaaatgggatacacctgtctttcttaaattgcagaagttcattgcttaaagtagccatgtatgtcttcatcaaagtttcttcagttctcaaaatcttctcatatatgtctgtgcatacacacactcactcaacccagcagttggcatacaatggccatttggtatttgttttgcaaaagaagttagtaagtggcagtaggtaaagaaaagggcactgactgggaggtgaaagatctggacccaagtccaggtttggccacctaagcaatctggagaccttgttaaggggctgggtatcctgtctcgcccagtcagaatcttgctgtctaaatggggctaatcactgcatatcttgaaggtggtttatccagctcacaagaaagaattgatgtgcagcgcttgtcaaagttaagccttgtacatgtgtgaggactttgttcttgtcaccgatatatgctcggatccccatgtttgatgtgtggctaatgtgtatgcaccttctccctagtccaccctgagagctgagggtgtcattttacctaaataaagaaatacattgttaatgtagaaaatttagaattcacagaaaattgtaagtaacaacaattacctgcagactgtagcccagagataaccactgttaatcttgtgggatgtttctttttgtacctctcctaggcaggtactttcacatcacacacacacaaagacacggtattacttcagtcacataaccattatttttgtatcaaatttacccaagtagataacccattccaggaaaagaaagagacttaactttgttgttctgttactttctcagggcctagtgcactatgagaccgagcaggtatttgttaaatacttaatggctttctggaacatcagggctgacaagattctgagttataatctaatgttctcagttgaagtgcaggagaatgaaggcctatggagagaagcaggcccagggtcctagggctggatgtagctgagctagaactcagaaatgtgctgttgtcttgcccacgtctactctctactaataagttaagaggcacatacaagaaggcccatctggttggtgcttctagcagagaagctgattcatgcttaattttgaccacatctctaggtttgtggttactgctcagaatcaggatagcatctgggtatctcgaagctgctgtctccagtggaggctttggactgatctcacaaagttatgctgatttctacatcagcctacatctggggtccttctcctggttatcattgtttgtactgtatgcacagataccacgcccttacttaataatccagccttggtggaagtatattctcctgtgtttttgttggaatataccaaccctgtattgccctgccctgcctttcgagcatcgtgaaaagaagtccttctttctcttggtggttcttgcctcatgctctcaccctccctttttgtggtgtcttactgagccagttgttcattccccagcaaacatttcatgtttacagtcctcaactaggctatactgtggaagattcagcagatgtgcaagcccaacctttcaggatctgagtcgagagagagaggggacattatatagagaaattatagctcagtttataaagtggccagtgacccaggagagcggcagagcacaggctgtggatcctgggtggcaggaggcctttgtcatggttattgggggtatagggagctgggcaggcagggatttgaaaagaggggcattagagcttgacttggaaagggggactgggatgtgaacatttggagattgcaggagaaagcattcctggcagaggaacaagtagtagatgagaagggtcacaggtggatccctaggtgggggtagctaaggattctcaggatctggttgctcaatagcagcaagttgagttctgcacctctgcaggccatgacctgggaaaacatcacctcccaagccccccactgcctttacttgtccaatgctattggtgcaagtagcctggcaagttgatacaaccagttttcctttgggacaagggacttggtgaggggatctgtggactcctaagagccttccagtggattccaggtgatttgggaacttcctaaaattgcacagatgattttgtgtacatgtgcacctttcccccacaactttcaaagatctctgttacccttgaaagtgtaggaggaagagggtcggcatgtggattaattttaaaaccatatttaaaaaactctcaaatcatgtgaagtttgtagtggaaagctccattcagtttgaaagccttcaccattctcaggcacagctcactgatctccttagtctgtgcacccctgatgggcaagattatgtctcatccctgcccagaacttggcctcagaatcttatttgtgatgtttgttcagggaataaaatagctttgatgtggatataaatttgcatgtgtgctgacttgcaatagagtggattttttttttaattgctacctctaggatcctaaggctgactttatgtggaggagacatttccaatgtccgtcttcctgcctggtccctacctgaccctccttattaagcacagggataagccttggcatgtcctgccagcaagctgagggctggggctgtctggcctgtacttgccaaatgtagtctgagctgtcttctctctaaaggactcttcagccccatgacccccaagtatagagccagacccaaatgtgcctcttcacatgttccaaggtgggcatgcttgggaacctcatccagcccctccttgacctgaggggtctgcagcagcagcccatgctcatcttaggcagtataaggactcctgtggctgcagaaccacgaggtgggactctcctcaggggctgcttcttggtgaatctgcactctatttataatcaaaagctctgccagatggacgtgaggtgcccagcagagggtaggaacactggcagctgccttggcattttgttaagtaggtatgcaagttgctggcccatcagagagctgtaaggtgctggaatgacagagccatttgttttcccttgtgacatggtctgttttataacgtggtgggtgagatcaagggagaagagtgggccccttcatagtttttcaaagtccttttttccttttttagaaaagttcaaagaggacattgactttctacagtcacaagcatcagcctgtcttggagagacagcagctgtggcatgtagtattttaaggtgatgagccaagtcagacaagtcctgatataggtggggtctggacatcctgagtgatcattctcatctaccactcctctatctgggccattctcattcattcagtagctcatggattgtctctctatctgggccgttctctttcattcagtagctcatggattgtctgtctatctgggccattctcattcattcagtagctgatggattgtctaatatgtgctgaggagagagggaatagatgcacatggatcctaccctcagcaagctttctgaacaggaggcagtggacacaaacagctgtaattagcacaaggtagcatgaagcatcgtaagaaacttggagatgtgcgctggcatggggctggggtcagaggtggttggattgatgttcctgattcctcccttctgggatgctcgtgttttatttattttatctaaaacctgcagaacctttaccacttgtttctacctttaacatcttattgcatttatagcctctctgttcatctgtctgtccatccatccctccatccattcaccatctaacatttaccatcctaagacaggatgcagaaggaaggaagactcagtgcctgctctcagggagctcacctttgattgcttccttatggtcccatttgtgttgggggttttgttccccagcttaactgtaagttccttgaaggtcaaagactgtcttcttcagtgttcttggaagttgaaaaatctgtttggtcagtggattgctgcagctgtcgtcttgggtgtatgtgcttaacaaaaggcttaagagtgtgtgtctgcagggcacaccagccttgctgtttgcagtgctgcacagatgactctattagagtcttttggttctgatttggaaatctagagtggtgggagggtgggaagggaggtggggaaaaatacaatgtctcaatagaccaagttcccaaaagtgtatctgcacttgaggctttcctgaagaatgaaaagcttaattcgtgccttttctttatgctacttgttcttttgtcttttttttttttttttaaggaaaagatgtgtcaatttcagttgcctaattcatttttaatatgggtcagagctgccatattcacacgctttgtctcatcacacctaggcttctgttgaaatgcttgcttcacaaatgaagtttaattaatagaaatagggaagtgaacacagggctgatgaatctggggagacatgacttggtgcctgcccagagaggtccctgggtcagattcctcccgagcctgttgtcagaggcagattcttacttagggagccaggatactgggagtcaggctggggcattcatcaacaatgcatagcatagatttgcttcttagcagatgtggctggcctatttacagttagaagaattgtcattgttttagaaaactttttttgaccaaaaaataaaataaccaccaacaaaaaacccagactcttgagttgaggccaggtttgaatctcaaagcaggttgacctattttcattacagcattatcaaaacttgtgattctacctccctaacatgcttttcctggtgtcacatgaattgaacacctgattcaagcaggagagagagagtgaagaccttgtccttgtctggggcggccctgtttcccactgtgctgtggtctgaacctctttgagtaatgcctcccagagctcacctgctaatgactgtgctccacctggggaggggctattgggaggggctggtccacgcagacagggctgtacctttcacgaagtgctttcacatcccctgtttgaccttgacaacttcccagtaagggaggcagtgcctgcagtgttatccttggtccacaggggaggaaactgaagctcacacaggcaggcagggggaaggcctgggagagaactttcaacactggcataccacggggatttgtgagagcacctgcctggagtccctgcctccgagaacttcgacttctttccagatcttctgctctcttatttgatttaagtagatccaaatatggttcaggaacaaagcaggccccaaactgtgtataggatatgtgggtaatgggccagaaagctcactcctctggaaaatgttggaaagtgacctctcctgagcatcccagtgacatggctggatgccctgttgagatatgagagaaggggctgggggacaaacccatggcaagggcactagctgaaggaattcatgcagaggagaggagagggcttttccactgacgtttccttgcctctattctgtgtgtgtgtgtgtgtgtgtgtgtgtgtgtgtgtgtgtgtgtgcattcctccttggaagatgagagcttctggtctcaaggggccatgccctgtttctcagcagcctcctcatctactctcttggttttcctcattctcttcgaggtaacaagtcctcacctatttttttttttgtggcaccctacagtgtctgcagtgataagagcaggtatctttaaaaaatcaaagccaaattaatctactttggttttttaaagtccccatggtccacaaaaatatttacagggactggagattatctgctagtattctaaaactaacagtaacaacgattctttacatttttatagagagcttcaaacattttagactatctttacttctgttttcctgttattcctagtacctctccagattagacaagatgatattaaatatttccatcttacagatgagcaaattcagacttagagacgataaggtactagccccctggaaaacaactgcactgaacctaggtcctttatttctgaacaagacaggcatcgtgttgaacttcatgaagaagataatctaataattgaaaatacatcaaatacaaggacaaataagagacgctgggggggtaatgtgggagaaacctaaccttgtctgagggtaaaggcagtgtgtaggtgagacatggatgctgagttggcctttgctgggtgaagagagtcaggaagattgtccagggcgtgatgtgttcctggaaccgtggggccccatctcagtgggccttgcaagccaggatgagtgctttggtttgtttttaaagctgtgagaagccactaaagggttttaagcagaggactgatgtgggttttagaaagactgctgtggctattaggcagaaacatgtggggaggggcaagaacaaaactggagagccagagcaggcagctgttagagttattcagggaaatgttcgtgctgtagactctggggtgactgaagtgggaagattcgagaactattggggtgtagaagggacagcagctagggattatttggttgtggtagaggacaacaggtaatagagactcaggattttggcctggatgtaatggggccattttctgagttaggtaactttttacattacagggtcttctctgggacctgcgggggcctgttttgggcaggagggcaggagcatggactcattttgggacatgctgagtttgaaatgcttttaaagtatgttatgtggaaacttcaggcaggaatggggacaggtggttctggagctccaaagagagaagtgggctggaggtgcaaattccagattcattgccacaaagtgaataactggaatagtggacaggaattagaccaccaaattctgtgattctttcgtctttcccgtacttcttgaggggatttataaactcaagctcaaaataggaacctgagctttaagagagatatagccacgtttggagttggtttaacaaaggctgttctgcgggtcccagagaagaccctgtaatgtaaaaggagaatctggtaggtaattggaaccaacaaatatacttaatgttatatcccagtgatggtgatctcagaactcacggttggttgtacgaatgctggttcctggtctctgtagaattgcttccttatggctgcacattccatcaagtggttctgcccaaatttactcaattagatcttggtggtgcatttcacaataagaaataattctgaaatacactcataatggtttcaaattttagatgaattctttggattaagacctaggggtatttccttggttgtagagaacacacacttttatgactccttgttatgaaggcaacagactgtgtaaaagaactctggagttgttggggcaagagctatgtggtgtttctccctgaagccctcagagggttgtcctcctcggatttcaagggacccgctctgtgaggcacactggagtctcaggggcaagctctttttcactgactcactcaccagtgtttgctgagtgtgtctcatgccttctttcttgcttgcccctggaacatgcacaggactcagacccagccctgcttgtggcctggggctggtagatctcatgcaggtaatcacggctgaggatgagctctgctttgtgtgagttctggatgaagtctgggggagtttggagacgggagatgctccttctgcctgggggagtagagaaatgcttcccagaggttatggaaggaaattggatttgtggaggtgactgacagatctgtgccccttgtgtcagtgtctctagctgcgacagacacatgggtcagcaggcgacccttgttttccctgagagcagcaaaggccctggtgaggatgtgtccagcactacaggactggctagctgctttcttttttacctttcagttttcaaggtatgaatttttaaccagatactttctaaccttaaagtgatttggtactcccaaggaatcattctgaaagttaggaaatttatttgtgattcattgagttgaactatcaataactgtaacagattccgatctcctttgtggaaaaaaaaagtaactgtcttctcaagtacaagaatgagagaaagggtcttgattaccattttgtcctgttcaccttttttggagaacacctttaatttcttggccacaccgtgctcgtcttcattttgcacagcaccactgttgtaactcctaaaacttacgcatcacggcagatgtgtgattctttcattctttagatctgtagttttcccttatacagaagttagtgtcttctcttccaatgtatttaaacctttaatgaatatttcatcaaatgaacttcatgtcttgtatttcattattaatgttgtttatgagaccctatcctcattagcataacttacaaactaagaggaagaatgatattttaggacagtggttggtgagagaatagttgcgcatccttctacacgtgtcaaatgtgggcctttagcgagcctgcaggaaaagctgggatgctgagtatgtgtctcgcctggggtgacagatggggtgttcatgttctgtgagctctcagccgtcccgagtgtgtggctgtccctgcagcatttggacgaactcccgccaagaggaagcctgggcatgggggtgctgtgaggcaggactgagtgtatgaatcaaggtcggccttgtcctagctgggtgacataagccaaaccccttgccgactcttcagggtcattttgatcttcccgccacccagatgtcccctggttcactgatgaccccgataactaatgtgtcattttcctctatgtgcttttcttttagagacaacgtctccttctgttgcccaggctggagtgcagtggtgcagtcatggcttactgcagccttgaactcctggcctcgagtgatcctcccttctcaacctcccaaagcactgggattacaggcatgtgccattgtgcctggccttgttttggcaaaaccatatggatgtcccatctaacactccagcctctcatttcaagggcccttttcccctttggccatccacttccacttgcataccctgggcctcatggtttgggtggctgtttcagctcctgaacctctaacttagtgtgctcctcaccagccttgcccttctctctggcctgcctgctcagcatcacccagggcctgttttccctgcagacctgggctctcctccttggccaacttagatgctagacctttcacctcacctcctcaaatccctttggtccttttcatcacttctgtgcaggacatcccagccctggatggatccagctagtggtcctggccctgcctggccatccagcctcagctcatgccactgcccctgcatccactactgttctgcttcatgagctgccttctgttgctctaaggagtcaactccttcccaccttggagcttctagaccgtgtcctctccccagatggctcctccctcacttcgtctattactttaagctccacatcatcatttgtttcctaggggagcctcctctgactgcctggttgaggtcaggcttgtcgtccagcctatacttaggattgtcacttactgtttgtgtgcttatctgttcaacacctggcccagggttgtatagggcagacctagtttcagaccttctgttccttcatgcccatgaaatgtcccagaaatcctattgccttggcatccaaatgccattgcccagactgtctcctatagtcagaaacagctcagaaagcttttatcagcatgagtgtcctagtttttggttcacaaaacaactgtggtcatcacagttctaattcctgttggttggttggagagtcagtacagagtattagctttgggccagattccttgagttaaatccttgccacttataactaggtgagcctgggcggccgggcaccctctcgtttcctcatgtagaaggtgatcatggtgcccacatcctggcattgccgagaggatcgagtgagcgggcataggtacttctctacactgagaagcactgagcacttggtgagcatccggaaacatctgctgctgttagtgtgggctgagctctgtccgctgtgggctacagaaggccctactgcctgtcctgcatttttctcttatgtatgggctttcagtaaacatgtttggattgaaatacacatttgaggaggcactggacccagacctttgagcctgtgattccaaaccctttcctcctgtgcagttgcagctcacttcccacatcactcagtcctgcctctaagcgacactacactgtcaccttccttcatcatcactgttggcgctttcacataagcaagggccccatgtatttttctcttattctctctgtctggaatactctaattctttccttgaatccaatgttctgttcacctcctcctttatatttttaattttttgttttatttatttatttagttttgagacagagtctcactctgttgccaaggctggaatgcagtggcatgaccttggctcactgtgacctccgcctcctgggttcaagtgattctcctgcttcagcctcccgagtagctgggactacaggcatgcaccaccacgccccgctaattttttgaatttttagtagagacggagttttgccatgttgcccaggctggtcttgaactcctgagctcaggcaattcgcccaccttggtgtcccaaagtgctgggattacaggggtgagccaccacacccagcccacctcctcttttaataccagcttcacaaacatccttcaggatatgtctccggactctgagcctgtgtgttgctctctgtccactcaatgctgtgtcgatttgccctagtaattggcaattataattctaagattataaactacagtatcaaaggtaagagcaatgtttcctctcccaggaactacacaaagcgtagaagaactcagtatttcctaggccttcaggaaaagcttgttgactaaaagaaataaccagttgacctggttttggtgtccgtttatttttgcgtggatatgaggtgtaccctgggatccttgttaaatctcatgttactcagcttgttttgtcaccagtgttgggcaaaactgggtgacaggctctccaccttctctgcccctttcttttctttccctgcttttccaggaacaccttgattcttctgtacgctagggtgtcatttctctcgttccttcagcagttcaatgagagttcctgagcactgcctacagtgtgacaggtgctcatctgagcgtgaggagcagcagtgaaccaaataggcagggctcctgttctggtggagctatgttctagtgggaagagaggtgataaaggaatatgtccacgacataggtggtgcttcgattctagcagggaagacttatgttgattggccaggaaagacgtctttaatgaggtgccatgtaggcagggatctgaaagaagtgaagggagcaagctgtgaggatagccagggcagaggggatgggcacccagcctggctgagagtgtgtgtgtgtgggggaaggagatgtttttaattggaatggagtaggggtgaaaggaggagctggaggcatcagaacatagaaggccttctaggaaccccctaaaagggccttggatgttactccgaattagatggagagctgtttgaaggtttttgggagcaggggacattatctgatttgtctaatgtcaccttaggtctctcatgagcttaaggaaatattaactcattcataggaggagggaagtaacttctgttttaaggagggacacttgcctaattcctctttgagtaaggcctaatctgtcagagtcgtggttggactgtgttctgaactgtagcatcccagggcctgaccctagttctgtttttttttttttagatggagttttgctcttgttgcccaggctggagtgcaatggcacaacctcagctcactgcaacctccgcctcctgggttcaagcgattctcctgcctcagcctcccaggtgcctgccaccacgcccagctaattttttgtatttttagtagagacggggttttgccatgttggcccggttggtcttgaactcctgacctcaggtgatctgtccgcctcagcctctcaaagtgctgggattacaggtgtgagccactgcgcctggccaatcctagttcttttactctcttgcttttgctcagcctgtaagtaggagtaggaagtttcaaaagttacaataattaacatattcacgcctttttcacggtctgggggagctaaagcaggtgcaggataaatgaaggaactgaaccagctaggaccaaaatcagtaatttgaaccaaacttgatagctactgttttgaaactgtcattcctacctataggtagataagggcaagagattataaaatctgatggccacgaatctaattttatgagacagtgtaatgataaaaggaatgagggaggctgataaatacagatctgtatgtcttccagttttagccagcttgtcttgtttctgagtttcttgagtttcttccctgggaattgttttaggcccaaatggtaagcaaaaggaatatggtgtaagtggaattaaataactccccccagcacctcctactttctctcctcagatgtgtgagtggtaaatactttggaagaaatacaccccaagcctggtgtgttcactctgctcccaaaggtgcttgggcagttggtggtgatgggagtgttggttgattgtagctctgtatatgagggtgtctgaggattgtaaaattatcaggaaatccctcttggtgttgaagtcatgagcaggtgcaggagaggtgaaaggaaagggcagtgggtattcttccccctcaaagtgtgggaagagcagtgctccaaggccacccaaggagctgggattttttccttctaagctggttttccctttctccccactcccaactagcacgtgggcagaaggaagtgctttatctgcctgctacagggctgggaaatgtggcccgtgtactgcctcagtgcttgggtcaccagcggagatggctgcagtcccagccagctctgcaggagcttcagtcagaaacgctgatgttaggatgcattcttcagggagctgcagcttttcttagaaggtggaaaaagagaaagaagtgagtaaggtgaagtcttagaagaaggaacaacagaaaccaagttcagtgacagcccaccaggcctggcagagtctgacaaggagtctgtgaggtagggagtgtgcacgtgtgtccgtgtgtgtaaaggctaatggaatgggagacgcccttgaacagaaaggctttcacccataagtgtgaagtctggttcgtcttagcgacaaaagttagaaaaccactttcagacaataattgtattattttacagcattcgaagcaacctgagttggtctcaaaggtggctccctcaggccttacctgaggatggggacagagttgctcaaatgctttgggattactgagactagagtcaggataagctcgatcccaggttcctcaggccatgcttttccactagccaattcagtcccttcagcaagtgtttgtcgagcacttactagatagcaggtactgctcttggcacttagagatatttggtgaaaaggtcagcctggagcttccattctactcaggagacaaatgagtaaatacaggaggtgatttagagagcacctgcctcctgtaggaaagaaagggaggttatgcaacagcacctggtaagggtggtcagggaaggccatgtggggctctgggacagaattttccaggcggaaggaagatacagaggcttcaaggcagaaagaaacatcattgtggagtaatggcaggtggctgatcccactctctgcatgcagaaaagagcagcagccttcttgaagccttcttacctttctcacgttagtacaattccacacccttgtgtgtatgtggcagccactgtcataggcatcagggatcctgcttttcttccccttgaccaagatgtgaagatttgtgatcagagcatcagaaataaagtcccttgagacttgcagattgaggaaaaaatgacaggagtcacccagatatgaaaatcagatcttgaattcgtctattgatcaggcattaggcatggtgggagttcagtccgtttcagctttaatgtcctgttgttttgctattgatttctttcctcaggtttcaattggtattttttccatgttgtctatacattggtcatctattttagtgatgctaattgtttagctattaaaatggtgcattagtcccacacaactcttataaacagctgtgtagtaaggagtataatctttgtatctgtagtcccccttagggttaataattaggtttttgacagccagctcagccggcttgttttcacagtgccctgtttcccactggagaatgcaaggatgcagtcacgggaggaccaggtggacagcatttggaggatttgggtggatctaagaatattttcatttggaagaacaggatggacaccagaggccaaaccaaggagtagaggaaaacatggcacctttcccccatcccacccctggaactttcacccacagtatagggttgccttgaagctctggattaccatggagctttcaatgagtaggaggagacatccatttgtcctctgtctccagctggccccgggaactattcaacatctgggattgcttcctgcggtgccccctgacccaactcaccagagtctaccgactctagacccactgttgtcctgggcccctgcctgactcttttacccactccaggatgaccctggtttctactgacacctgcctgacctaactcggtttgtctagaatgcagttgaagttgcagcaagggagatgaggaagggtaagaattggtgaaaaaaattacaaaggtttttcatggttcctaccctcgatgagtttacagtctagtcttcatgaggacatgtgctcatttgatcataaggcattttgtgacatgtgcctggaggtgattcagacagatgggcagggcaggagggaatgctggggtgtgtatagcaaaatgtgttattaaattatggcatctgttgtcaacaaccggtttagaccttcttgatctcctggggtttcttttcagttacagaattctgtcatcattacagaaacaaggcttagccacttactgctttaaataccaaaaagagatggcgaataagattgggatccatggggctttgagaacctagtagcgtgtgtgctgtatcacagttctcttctggctgatactggagagggccatgcaatgctggggacggacagctgtactagggagtctggattcgaattctggacatccctaggctcactgtgtgaccttcatcccccctccccccactccctgtaccctttgagtgcccctgccttcttactctgcatgtgtgtgcatgtgcatgtgtacccatgagtgtgaggaaggataactccagtgttgggggagagtctgccaggagataggtgccctgagtagtggtcttctcttgggcacttaccgactgtgtcattttggaaaatggccccccccaaaagatttccacatcctaatctcttgaacctgtgagtatgttaccttacatggcaaaagggatgttgcagatgtgattaacttcagaatcttgagatggaaagattactctggatttagatgggcctacccaatccttacaagagggaggcaagagttagccggagaaggagctgcagtgatggaagcgcagaagtcaagagtgatgtaatcacgagccaaggaatgtgggcagccttagaagctggaaaaggcaaggaaacaggttcagccctagagcctccagaggagcacagtcctgctgacatcctaattttagttcagcaagacccatttctgccatctgaccttcagaactgtaagatactaagtttgtgttgttttaagctactaaattatagtaacttgttatagaagcaatgggaaacatacatcaattattcctctggatattagttgcttcagctctaaaatggggacacaaaatgttttctgcctgaaggctgagaactggaccatgtgacttttggcattccttcaagttctagatttcatgagagagaaaatcgacctgaaaatgcattaaatgtttaaaaacatagggaagaaagaaatatacaattatttaatgtctgtgtatgtcatttaattcttacaaccacctgagagagattttataattattattttcttttagtcattcaagtatttgagtgcctatatgtgccagatggtgttctaggtgttagaaataaagcagtgaacaagaccaataaaaatctcctgtctttttgaagcttatctttagggagacagatgagaaaccataagcataattgctaagtgaatcatcagctaggttggcaattgatagctgggatggaagaaaattagagcaggttgatgggagcatgttactgactaggattgcaggagctcagagggtgagcagtttgctcaagaccacagcaccaggaggtagtggagtggggatgaaacccaaaatctgttggaatccagaggcctggtctgatccttttctcaggctagtagaaggctctgcctgactttgcctatttggattcccccactttactgagggagaggagtccccactgccagctgttgttaggacaattgctatcatcctgggtttcatatttttagctcctttcccatctctctaataagtaaatgccagagggctagggctaggctgatgctgggaatgagacgaggaacacagacggcacaggtcgcttcatgagttccagaggcttgtacaggagacacatgggccggccactgtttcctgtctctctgagggagctgcaactccagcctttcatctcacaactcaagttgcttttgctgcagctgaggcctgaatgtgcatttgtaactctggggaaaagggtgttcagttatcaacaattactattaggttggtgcaaaagtaactgcagattttgccactacaagtaactgtaaaaactgcaattacttttgcgcctacctgatatttttatgttgcatggccttttcctggcagtttgatgtttatcatttcctgtcattgaggaatgtgtttttctaggacagtatgaaggctttcaggatctttagagggaagctctaaaatgtgcttctctctccattaggttggctcatcagtcagattctgatttgaaaatgaagggtgcttggcagtaagaatagtggaagtaaattttcaatattatacattaacaagtcataactaataacttttatgggttcttcccatctcagatttcagagaatatttttgggttgtgttctattgatgagggcttaaagaaatgccttgttctggctgggcatggtggctcaggcttgtaatcccagcactttaggaggcccaggagggcagatcacttgaggccaggagcttgagaccagcctaaccaacatggcacaacaccgtctctactaaaaaaaaaaaaacccaaaaattagtttgggcatggtggctcatgcctgaaatcccagctactcgggaggctgaggcaggagaatcgcttgaacccaggaggcagaggtcgtagtgaactgagattgcaccactgcactccaacctgggcaacagagtgagaatctcatctccagaaaaaaaaaaaaaaagaaaaccaaagcaaagccttgtcctgttgtgcttggtttgaaactgccattccctttagtttctgcttactgctacttctacacaaggtcaagagaaagcctggcttcagaagaattacatagtcaacccctggggctagctagctgcagaagaacttgaacttttggttaattaatggaggctgggccatagctggcaaagcgggatgtgcccatgcctgggtgttgagagactgggtcttgacatggctctgcaactgtccatgtcatcttggaagatctttctgagttgggacagctgagaaacttcatgccatttgacagttttcttgaggtcatgagcaaattaaccaatcaaggaagtaaataagtaagttttggtggaacaaatttgtatgttattggtgtgcctttttttttttaataccataggtgtgttcctgatgaaaagggtgtgaataaatggaatttaaaatagttttccaatgaacggaatctttcacatgttaatatatcagggtcttctgcagtgacagctttgcctgaatttcatttttcacattagcttaaaaatattttaaagtaaaacatgttaattttgaaacatataggaaccagataaaggcaatatgttttttataaaatggaatcatatcctatcattggacttttggctgttttcctcttttaaccactataaaccatgttgcattgagcatcttggggtagcaaaatcacagattcctgattatttctttagaataaactcttagccttgaaattgctgcattgaagcatatacaggattttttttatatgagtcgcaaagttatttgctttgcttttgctttttgaaagagataaaagcttagacatcttgacattaaaaaaaacaaaagggttaatagcccagactttaaagtcagacatacctgaatttgagtcctggctccaccataacaagctgtgagaccctgacaatttacttcccatctctaagcctcagttttctcatttataaaatgggcataatatccttaaactcactgtgagcattaattgaatgacacgatataagtaaaacaccataccgtacatgaattctctatatgggaattcttactaatttgtacctgaacctctccttattcactagaagagtgtgaaaacttagtttcctctctgctccacccacggctttctagcagtcactgtaggcccaaggaaacccaccaccgtcttggtgcactgtaaccagggttgaggtgtctgtcctaattttgaaagcctgccttcagacatttatatgttcagacaaactaatcaggctgaaatttctcatgcttatttgcagctagatgaagcaatccatttagttgctttggaattacccaagcatggaagaaattggtttctcagccttgagatattctgcagatactgaagtacagatggcaccagggccagcttggtaaaaccagaaacaaggggcctgagtttggccctttgtcagggcctctgtccttgggaactggtggttccacctgggccccaacataagcctcagcttttcatttggccagcatgtatcatgaagttacttcttatttcaccctttgggggactctcagctgctcagagcttttgtgttttctcttttcagcttcctcctcaattgatacggatgaagtatttgctgaatctgtttctctttcctgaatcagaggcccagaggcattcatatagttgctttctggtaaaaccttgctgatctggtatttgggctgtcattagactgtagtgcaaaaagacgaggtgaattttgggactccagatttcagagtgtataatatctcttgtagttaatattcacaacccatgagataggaacagacagggaaactgagataccaaaagtaatgtgcccaaagacgtgcagctagtaaatggcagaactgggatttgaattcttgctgactatggttccatttcaactattactcaataccaccttttaatctgcttattataatgtatttcataactttctatgctgtggtattgatcattcattcatcagttacacaattattgcatggaaggatacaaagagaaaaagatatggcaatgtggtccttgttcttagggaattttcataaggtattaacaggagaagcaacaagataactatagatcataatataaaaatacctcccctctttgttagatagctttaacccccctgttcgctgaaggacttggttctgaatgattgaaacagataatcctccgtgattcccgtacatgtcctctgtgcccacctcccactccagcggtgagtccattgtgtttttcctttattggcaaccctaacgtgttggggcaccctctctaactccacagtacgttgtaagtttggtgttaggagagaaatgatctcaggcctgcacagcacactctttttctgttccctgccttttaaggtcatgccctcttgtcatgaatataagaatgcctgtgcccccttcggagaccggtgccactttcaggctgtgtgcatgctcactgcccctccatcctccttgagaaccatcgatgtgcacagagggttgtactgtttctctgtacatcccatcagcatggcttactcaagctttgcttcctgtcatatgtactaaggttttcaatgtgaaaatatgaaattacattctcatactaaataggctcctttaatccacactcctctctgagaaccaatccactttaccaagatctacccctcttggggctgtgctccctggttaagaacagctggtttagtagcaagggagaaggcaggagatgatttaaaacagaccctgggattctaaaagtcctgggattttataattcctgggattctaaaattagctgggaagattttgagtagcggaaaagagcctgccaactttagccatcctggataataccattctgttttagcttgatcactaatttttctgaccccatgtagaaaacgtatgtaaatcatggtggtggtagcagcagtagtagtaacaacaataatgataataatcatggcagtagctcccctttttttattttttattttttgagacggagtctcactctgtcacccaggctagagtgcagaggcacgatctcagcttgtcttggctcactgcaacctccacctcctgggtccaagcgattcccctgcctcagcttctagagtagctgggattacaggtgcccgctaccatgtctggctagtttttgtatttttagtagggacggggtttcaccaggttggccaggctggtcttgaactcctgacctcaggtaatcggcccgcctcagcctcccaaagtgctgggattacaggcacgagccaccacacccagcctgtgttagattagtgttagagtcaccttattgatctgtcaacactaggtcttatttcttcaatctatttgtacccattaagaagcctttcctcattctcccctctcctcacccttcctggtctctgataactaccattctactctctatcttcatgagagccacttttttagctcctacatataagtgagaatgtgatatttgtcattctgtgcttggcttatttcagttaacataatgaccctggttccatccaagtggctgcaagtgacagggtttcattctttttatggcagcataatattccattgtgtatatatgccacactttcattatctcttcatccattgatgggcacttaacttgattctgtatttgactcttgtgaataatgctgcaataaacatgggaatttagatatctctttgatatattgatttcctttctgttggctgtatactcagttgtggaattgctggatcatatgatagttctatttttagttttttggggaacccccatacagttttccatagtgctgtattaatttatatgcccactaacagtgtgtgagggttcccctttctccatatccttaccagcatctgttattccctgtatttttgataaaagtcattttaactggggtgaggtggtatctcatggttttgatttgcatttctctgatgattagtgatgctgagcatttcttcatataacctgttggccgtttgtcttcttttgagaaacatctatacagatcttttgcccattttttaaattgggcttttttttccccctattgagttgtctgagctccttatatattctggttattaatcccttgtcagatggatactttgcaaatgttttctcccattctgtgcattacctattcactttgttgactgtttcctttgccgtgcagtggtgcagctttgctgagctatttctctccagcggacgaagttgtccctcttggagagtgagatgcagttgcgtcacaggatgttgtcatatgctgggcatgtggcacaggtgaggtccctagagccgtgaaggccaggagggctggttgggaagcatagacctacatagcatgaaactgtgctcttcattttggttttgcatctgcggctttctgagagacctgagctgacacatggaacagatatggttctcccttgagaaattgttccaaatattttgatgtacttcagccagtcactgaaactctttagagtgggaataatgctcatgcttgccttgaacagcagtggcacagagtgattgaaagcctgagctttgaagccagactgctggggtttgaatcgcacctcggatattaactgctttaccttgggcaagttttgtaacctctttgtgcctcggatttctcatctgtaaaatgagacataataagaaatgtaccccttggggttgttgtgagaatgaaatgactttctacctttaaagcacgtagaacagttcctgggacctagtatatatagatggtattacactgtgaaatcatttgattctctaaatcaaatgagaatgcttcataaattgcaaaataccactcagtactcttagcgacagagggagaaaaaatggaatattgtgttggaagctatagtttataatcccacttcatgtggcagcaataaaactggcaagttattgatggggagcccacaaacatgacaggctccccagaacaatgatgcctcatctgtgcatgaatacccctggggaacttcaaaatccatatcctatggttgatttccagattcactgaattagaattttgcagggatacggggtactcaggaaggttttgtttattttttacagaaagatttccaggtaatcctaatgcagctgatgtatggactggtgtttggtaacttctgacctggatgctctaacagttggttatatttaatgggatgcaggaagatttagtagagggcctgacagcaggtatctacatttacataaattttcattaggtaatgcggatggagcaacacaggcagatttgtctggaggaaattctagacatctaaagacacctaaatcctggggctgagagtatggctctatttcttattgaggtcagttttcactggctgactgattcccttaccatgaagcacaaggttgatgggtactcttaattgtgtgaaaagtgggaagtgggaatagttgcaaagggagttggaagtaggcagttttgaatcctggcttgcctgctgcatactggatggaagctgcagatggaggaaacagtgcagaagactcactgagcaggcatttggatgactggccagcagatggggagtggagctcagtagatagccattctgcactcttcaggagagaagaacaacctggggccatgtgttcaataaagagatggggctggcacattgttgaggaggagaaggaggatttcaaatggagggctttttgaagaaggcattgaacacctccccacccacccctgccctgcacttctccctgtagctcagaaaccttttaatagccatgggaccaacatctagcagctggcttggttttgctggtccttgctttaaaatggggatacatatccctgctttacagacctgctgtggagttggatgaaatggtggatatgaaagtgccttaactgtaaagtgctgtacatacttacagaagcattggctaccatgtggagatggcgtgccccttggtattagtaggaggggacagactctgaccctctaccaggggtaaagccccaaatctaaagatctagaaacattagcaccttcatttcaaggtctgatatgtaagaggatggacattcctaagatttattgtgggcagagtagcatgctcacccctgatggtgacagtatccgtagtgggttctcactgtgggctgttgcatttaggccactggttatgcctgcttcccagagctcacatgtaactccattcctttctcctctactcaagaaggtgcacttatgtgtgtatgaaacagggacattattaaaaaggtaacctgaatctacctaattaaaagcacaataaattcaataggttattcagatttccatactgtactgttagaaataaatgacattcacacactgcatagcagttgtgaaggtgagaaccgcgactgtgggtagggagatcctccagacatcagcaattcccatgtagtgtgagaccaccgtggagggctcctttgtgtgtctggcaccgtgggaagttcttagggggacaaatgaggtatcattttctggcccctcaaagtactttcatctttccaggaatgtgtaattatgtgcccaaatgagtggaaggctcctaggttctgtagttgttcagagaaagaagggactcgaactaattgaagtgattgaatgagcagcacactgaaagctagctgtcaaatctgtaattataacttctgtgcagtgcatttgacattttacagcatttctataaggataatgaattctgatgccttcagaagccagataggtaacaaaaatcagggaagcagttaggaagactacacttggatggttagtattgtggtgaaccagaatgcgtgtggcccacctttaagacatggcgatccaaaatttaaaacagaagcatagcacagcacttctgattttcaaagaacttttacgaatgtcctgtttcatgttcacagcatcctatgatgcaggtctgttctccccttccagagataagaacacttaccaagatcagtaaaggtggagatagcatgtgacctggagactgcaatgccagtgctcagagctgtgagatgctttccctagaggccctgggtcccaggaccaagcccttggggaaagaaggtatcatgctttcctgaagtgtctgccctctccccagagcttccctagttattctctgagcacagctctggggagatgggcctctggacctgtttgtttctactgttaccccgtgacttaaatgggcccaggaggcaaagactaggaaacaccaagaaggctggtgtgggaattgaagaaaaccatcaactgtgtcaacagactggacccaataataggaacaaagtgctgaaatcagctttgcagtcacatttagttggctgacctgtgatttctcaactgtctcttttttatcttttaaccatccatgtcatttttcactgaaagaaaaagagaaatgcagagatccagatggagtcccttgaacccttgagccaaagtacagaaacccctgcactgtggctggatgcccctgaaggagggaggccatgtcagttacgattaatgtgagcagcttctctcattccagaaatgtgacctctggttacagcaaatgtgacaacatgaattaccttcaattatggtgaactacgtttaactacatgattgcctccacaccttggtgggaactggctgctttgatagccttgaccatggaagaaaaagacagtagaaaagacttggaaatgacaggcacctagaatctgagtcaagggtacagtggcaggccaagggctgtgggctttctgtattatcagtaaatgtgatatgtggtttgggctttgattcccaccagtgcttgagaaagggatagttacccactttattgagctaaaatttacttaaaacatatgcctttaagtatatattttacagatggatgttttgataagtatatacactctgtaactaccaacccactcaagatgcagaacactgctatcaccataagggtcccttgtgccctatctagtcagtcctcacccccaattcctgacccaggcaaacactgatctgctttttactactatagattagattcatctttttactattacaagttatattcacgtttcataagtgaaatgatatagaatgtaatcttctgtgtgcatcacaagtttgtcctttttatggctgtatagtagtccattgtatggatataccacaatttgtttatccctgtacctgctgttggacattagagtctaaacattggaaacattgttttggctatgaaaaataaccaggttttggctattacaaataaagtggctatgaacattttatataggtgtttgtgtacacacatatatgcttttattacccttgggaaaaatagcaaagactgcagttgctgggccatattgtatgtaggtggggttttggccctcattatttttgatgctccctggtgatacacctgtgaacgtattatgttacagggcaaaagggactgactgtgcagatggaattaagcttgctgatcaactgactttaagataggaaaattaccctggaagtgggcaagcccagggttatcacatggacccttaaaatcagaaagggagggcataagccaatcagagagacatggtagaaggagaggtcagacttaaagagtgagaactcaacctgctgactttgaagacagggaaaggaggccatgagccaggcattgctgatgtcttctagaaggtgagaaggacccccagctgtgacagcaagagtggggacctgtcttatgtaactaaattctgccagcaacccgaattagtctgaaagtggattctcccccagagaataagagtccagacttatagttttagcttttgcatgtagctctatgattcattttgagataattttatataaggtatctgtgaagtaagagttgaagttcactccttaacctgaatatccagttgttctagcatcatttgttgaaaaactatgcttgttgaataactttggctcctttgtgaaataaattatgtatgtgtgtttatttcggaactttctattctttcctattggactgtatgtctcttcatacaccaatcccactatgtcttgattaatgtagctttatggtgtatctggaaatcaggtagtataagttctccagttttacattaggttctttgtatttccatataaatttaataattggcttgtcaatttctataaaaatagccctgtttagattttgattgggattacactgaatctatatctcaatgtagggagaattgacattttaatatcaagtcttctgtccatgaacatgtatatttctcataatttatttagatttgatttaatttttttcaataatgttttgtggttttcagtttcaaatgttttgcataattttctaaatgcatccctatatcatttgtttctgatgttattgtaaatggtatttatttcaattttcatttgtttattgctaggatatagaattaaaagcagcttttgtatattgactctgtatcccataaccttgtaaactcatttcttagttactttttcggtgaattcattaggattttagacatatagatcatgtcatttgtgaacaaagatagttttccttctcccgttataatcggtaagcctttaatttctttttcctgccttattacattatttgaaacctctattacgatgtggaataggagtagtgacaatggaatccttgtcttgtttgtgatcttaggggaaagcactcatttcttcaccgttaagtatgatgctagctgtgggtttgttgctgatgtcctttattaggttgaagaagtttctttctatttctatttctcaggagcttttaccatgagtagttatggaattttataacactcttttaacgtatctattagaatggtcatatggttttcttttttattccactaatatagtaaatagcattaattgatttttaaatgctaaaaccaccttgctttcttaggataaacatcacttgattgtggtgatggtgccttatccttttgatatattattgaatttaatttgctgttattttgtaagaatttttatgtctgtgtacatgagggatattggtttatagttttctttctttaaatgtctggtattgttggcttcataaaataagctgaaaagtgtgccttcttcctctgctttctaagagactttgtgtaggattagtattatcccttaaatgtttgacagaatttaccagtgaaatggagtctggagttctctttgtggaaagatttcaagttaagaattcaagttattaggccgggcgctgtggctcacgcctgtaatcccaacactttgggaggccaaggcaggcagatcatgaggtcaggagataaagaccatcctggctaacatggtgaaaccccatctctactaaaaatacaaaaaattagctgggcacggtggtgggcacctgtagtcccagctacttgggagactgaggcagaagaatggcgtgatcctgggaggcagagcttgcagtgagccgagattgcgccactgcactccagcctggatgacagagcaagactctacctcaaaaaaaaaaaaaaaaaaaaaaacttcaagttattaaatagatataggactactcagattttctgtttctcttcatctgagctttggtagcttgtatcttggaaggaattttccaatttcatctaaggcatcaaatttattggcataaaattattcataatatttcctgattatattttcaaagtctataggtattctagtaattgtctttcttttatttctgataccagtaattcatttcctccttttctgcgatcagtctagctggaaatttctaagagtcgttgatgttgaaaaaaccacctttttcttcccttgatttttctctattgtttgcctattttcagtttcatttacttttgcgcttgccgttgttttttccttctttctactattttggatttaatttggtaatcttttctgtggtagaaggttgcacaattgattctagatcttttctaatatcggaatattggctatacatttccctctaagtactgagttacctatgctcagtttttttggtatgttgcatattatttcactcaaatgttgaaaatattttatttatcttctttgacccttggattatttagaaatgtgtttgtaaatttctacatatttgggttttgaccaacatcaaaaggtcaatcattgacttttaattccattatgatcagggaatgttctttgtattcttttaaacattttcaatgtattaatgcttgttttgtggcccagcatattgtctatcttggtagatattccatattaactggaaaatcatgtttattgggctgttaatgggtagaatgttttataaatgccaggttctataaatttaaccaagctgattgatagtgctattcttttgtatacatactgattttctttctacttgttttatcagttatgagagaggaatgttgaagttcccaactatacttgtggattgatttatcttttcagttgtgtcagtttttgcctcatatattttgaagctttgctcctggatgaattcacatttagggttgttatgtttccttgatgaactgatgactttatcattatgaaatgttcctctttctccctgttgatgttctttgttctgaaatttattttgtccaatattaaggtacacctaccttggaaagaccagttttagttgggctttattgttcactatgacaactctgtcttccagttgaagtgtttgtgtcatttatgtttgggttttaagtctaccatcttggtacttattttctattttttccatctatttgttgttccttttcccctttttctgccttcttttagtataattgaatattctttgacattccattttatttctactcttgccacataagctatatctattttatatgtgtcttctctgtatacgtgtatttaccatttatagggctcttcatttctttgcatagattcacatttccatttggtgtcattttccttccatttgaggactttgctttaacttttctgtagtgtatttctgttggcagtgaatcctctcagcttttgtttgttgaataaacttcattttactctcatttgggaagatattttcactggatatagaattttggattgacagtttttcttgcagcactttaaagatgccattctatcgtcttctggcttgcaaagtcagaactttcttttggccaggaactgtggctcatgcctgcaatcccagcactttaggaggctgaggtaggaggattgcttgaggctaggagctcaagaccagcctagcacaggcaacgtagcaagaccccatctcaacaaaaagtttaaaaaattggctggggatggtggcatgtgcctgtaataccagatgctctggaggctgaagcaggaggattgcttaagtccaggagttggaggctgcagttgagtcatgattgcaccactgcactccagcctgggcaacagagattgagaccttgtctcaaaacaaaacaaaacttttctttgattctgtgtacataatgtacacataaggtttttttcttcatttgatttcaagattttttcttgatatcagtttttgggtacttgattttagtgagaggttttctttgtttattcacctctggatttattgagcttcttggttatgtgggttatagtctttatatttattaatttttcaatcattattattttttgcttctacccctctgcccagaacttcgattacatgtattaacccagttgatcttgttcataagtcattgagtttctgttcatcattttaaaaaccaatctttaattaattttggataatgtaaatgtagccatgttcattaatcttttcttctgtagtgtctagttcaaggataagcaaatttttttctataaaagatcagatagtaaatattttatgctttgtggaccagatggtctgttacaatcacacaactctcctaatgtatcacaaacacatgcatagacaatacaccaaaaaatgagtgtgccagtaaaactttatttatgacaacaagctacggtctgggattaggtctatcggccatagtttgctgaactctggtctagtccactgttaattccatcacatgtgaatttttaattttaaacatcttcatttctagaaatttcatttgatttaaaaaaatatttgatatttcctctttcattatgcatgtttttaaaaatacttgaataaaattatgatagctgattgaaaatccttgattgctaattctattacctcctcatttctaagtctgtttctgtttagtaattttccaaaaactgcttatgggtcctattttcctttttcatgacaattctagtaatttttgattgaatgctgggtattgtaaaaattatattgtggagcatctgaattttcttcctttaaagaatgtgtaatttgttacggttgacagtcaagttacttgttgctcatagtgatcctttcaaagactgtctttaagcgttgttagggtgggtttaggatcaccttttagggtctctgcctaaaccccaagggatcaacaacatcttttgactctgatagttggaaaatcaaatgaatgctaaccctatgcgaatgctgggatctgttcagctcacagtttcagagttgctttttgcttagcctcatggagttttgtcctcacatctatgacttagtattcagcaaagactggagggtttccctcttcagatttctggattctttgccctgcagtgtctagccacctcagactccctacattccagactgtttcctcagctcagtgagacctttgtgttctgcttggcgcccccactctctgcttcacgtttcagaatgaacctccaggcagaaagctggggcagtcgtgaagctcacttggtttgagagaagggagcccatctctcaggcattacagtcttcactgtctgtcgttgaatactagaaatatttgttttatatttttccccagttttcaagttgtttaaggcaggaggataaatttggtccattttatttcatcattgccagaagtagaaggcagtcgtcacctttttaaaggtgatcatttataaacaggccgaaaaatgcagttctgtaggattaaagggaaatttcagtttgagtttttaaaagtgagacagttaataggttatgtaggtaagagggcactttgcttctgtgcaaacaccacagagtatgctgctgagttgctctgattaaccctaaatttgtgaatttaagcttataaattaaattctctataatgtatttatcaagtgccaggacagagctattatggtttttctatgctttgcattggcttctgcaaattaagtttcatttcccttttgaccacaaagaagatggccctattcaagacttcctcgttcataatgcctcagtttgttatccctccctcttccctcttcttcctgtacttcctgcttctcagtaatgatagttgttcttgtgatctagtagagtggaaagagcgtagtatctgaataagaaaccagacgttgtaattctggagccacatctgactctgtgacttgggatgagacactccagccctcagcatctgcttcatattccttatttatataattggcacggccatctgtgtgtgtgtgtgtgtgtgtatggattcaaatattttaaaaaggatgtgagaactctttggaaaccataatacatgctgtgagtgtaaggtgtttttgaggtcactgtgaatttcctcactgagactcaacctaacaatggaaatgtcttcttgtcccactaaacgctcctgcagaaatacccagcttctgcttggattgagaactgtcactttctgacacttcttccttatattgtattgatacaaggtttcgggcagtttctgctttttgtgatagctgtgctgttggatctcacacttgctctatcaatctgtatctgtaaccaggagacagaaatcacgtagtaatttgaataactaaagttcaatataagaaattattaaccatagtggaattggagtaatgaaggattggctagtaagaagtagaactctaaagaagataggaatagataataagatacagctaggtgtgctggcgcatacctgtagtgccagctactaggaggccaaggtgggagggtcacttgagcctaggagttcaagaccagcctaggcaacatagtgaagcccccaactcaaaaaaaaaaaaaaaaagagagacaagaaagtacccttagggctgagatagagcacttgaggaagacatcgtcccggggctgagatccagatcttgttgcacagagcttgactgtggttcactgaatggcatagaaattgtttttgtgtcatgaggatggtggggaagtctctctggtcctgtgctggtagaacttgctggaaacctatcctctggaatttgccagaaatccgccctctagggtgccaagggaagatgtgggagatatctcactggaggcgctccatttagaaactccccgaggtgtaggaggtggggatgctggagaaagtgctggccagtgggtgctgttgtccacaggcactgtaggagctggccctggagaaggcaggtacactgcaggagtgtgctgagtgagcacagtacaaccaggaacaaaatgctttcttcctgttaaagcgtcacactttgccagttgacaaaggaagaatatttataaggcccacattcgtttcacagaacaagcaaacagggtgtacttggaatggagaggtaatcagtgtataactggtacacctcatggctactcagcttccatacgtcccttttgtgtgaactcctgtgtgtcataacaactgtctctacctagcaagatgcagctaacttggttacaagtgaagaagttatcaccattccccaaaatgaggagacacacagtgccaagagtcaccatactccttgctggctatcttaattactcctcaaattcatcacactcctgtggaatagtctgttatctacacactaaattgtacttcagtaagttaactatgttaatttcccacaacttgtgtagaagatcaaaatgggaaggagagagaagaaaatgactaacacatttaaataagatgcaaagataacaggcaaatagaaaatatgcaaagttgctgcagccttcattttttaaattggtcaccagaccatcattgacatccgtggcttcattttttccactatctattttatgtgtcccctgctctcagccccatcacctgctgttcaggcttcttcacctggtagagggacccaaaccttccttcctcaggggttcaaatcttcagttctcctgcctggttttggttgctgtaattctctattaacctttactagaagccatggaaataataagagatgcaccagaggatcacccgggttccagacctggcctctttgcctagattgggtagaagcaacccggttgccctgtgctaatcataagcaatcacaacagacagtagattaacccaccctttcctgcctgttggtttggtgacataatgggaccaaagtgtccaggtgctcatcccgtgtttaaattcggtggaaccactgctttatagcctggtggaagaatccccatttcctcccttggggaccaagatctccaaaccagtgggcttaaagttgctgagacaggaatgaaatattctgtgcattgtttattagcgagaggagccaccctcactttcaccctttgaattctggacccacatattgtagctgtgagagaggctgcaccatatatgggtttctggtccaaagcatatgctgcattctatgaaacagaattctactcttcaggttattttgttccaactggcgctgtaacttgggtcttttggaagcctttctacttttcagttagggcagccacttctgggtgacaaggaaatgtcaaactcctccttggcagttcttttttgacactgtatcgatagcaggtttgctgcagtttctgtatttttgttacagctggcctgtcagttctcatacttacctgctttccagtatgacttgatgtgtgacatcaggtaaatcctttcctctctgtggacctttgagtctccacggaagagtgggaggtttagacttgatgatccttgggaaactttccccttctaaagcattcttgctccagtgaccctgcagggtgagggtgagctcagttgggatggtgcaggtgaagtgaattgtgaatgctaagggctgtgcacgtagcagggttgaggtatgatgtgttcttctcactatcagtggttgtgatcagcgttcgactttgaacctacctggagctgaagaaagggtaccggccccccggttcatatcatcatgtctctgtttcaggacccctagaggcagtgctcattctgtggaggtgggggaagggacaacattgtggagagaaggctagaaaaggaatgaggaagaggttgacattcccagtctgtgtcttcctgtcccctctttctctgctctccctcacagaggctcacacgcacattctgtctctctgccatccaaacagatgcagctgctctggagtcaaccagacttaacgaggagacaactcttctgctttcttccgtcttcttcctacccaccccctgacctaatgctgtgcttgcctgttacagcaggcctaggaggaaatgcactatgccttccctgtttttgttttgtgtgtgttttgagatgcagacctaaaaatattctgctgtataatcggttatccaatcagccatgcgaataatcactgtgccagagcctataggaaatgaggcaggagcctgaaactcagaagcatgccagctttgccttgcctttttttctttttttttttaaatgtgctcccttgggatctgggtttgagggttgagataggaggatatgctgggtgggtttccatggaggcaggtgcaggacactgatggtatgtctccctggtgggttgaggggaaagaatggttggtgtcacagtaggagttttgcacgtagttgaggcagtttgacttatgcctcttgaacctctattccctcctctgggccttgcttccagatgctgcctccctcccccagcacacctgcctggaatgttctctctcctcctctctgcttttccaagtcctgccgatcccctgaggtctagccctctatgttgtcagcaggaccaaccattcatagcggctgttgtctcacgatactcactgttgatagcagaagcatccagctcccatacctctgtgtagggcttgtgtttccagagtcactgtgtgctctcctctccactgtctcccccaattctctccaaagccctccgatgtcagtgggtggggtggaggtagtgaggggaggcaggaggaggtaggtagtttagtgtttaggctaagagcacaggtcttggagtgacagatttgctacttccatgtaacctctgttaaattctttaccttctaagcctcagtttcctcatctgtgaagcactgaaagtagtattttcagtttcataaaccctagggtttaggggtgttatgacaattaagtgacgcattgcctgtaaagtacttagcataatgactggctcctaggcaatgctcaacaaacatgaggtatgacattgtaattatcaccatcccactttacagctgaggaaaaggaagtgtggggagcatgggcgacttagttcacttgtacagtaattgactacccagcaaggactatgggtggtcaactaacaggattattcagggctggctctaagcccaaccaagtgctagatgctgtactggaacagtgactcaggcactcagctagggacgcagctggggaggtagatatttacatgtgagcctcaaatgtactgggggagatggaatggaggcatgtgtgcagtggaaagagccctggacttggagaccaaacagaagccctgtaaggagagtcacttgtctatcatttccacccttttgtccccagcacccaggccaagcccaggtatgttttaggtgctccatcagtctctgctgaaggaatgaagaggagccccgagccacagctctggctgggcctctgacctggggaaccttgaacagctctttgcatccaccaagtcacagggacctcctcagtacagggaggggttggacctgtagggacccgccagctcttgtggtcccacttggtagactcgacagctcctagcagctgcacagtacccagtgtgtgtctttacctcagttgtgcttttggagaagcagttggagaggtgagggcatgaagggctgggctgacgggcaccaaggtcgcccaggtgctggcagtgctgcagacagcatgtagctgtcctcagatggcccaggtctggctgggctctgcaggaacacttcagctcatgggcagcctggatttgtgctgatgcggagacttccctggcagccacagttgctgctgttgctgctgcctggtcagagttgagggctctgacaacagccaccacagctcgcggtctgtccactgctcagaaacctcacacaagaaaacttctgagactgcctctgaggccctttagatcctgagagccccacactcacactgcagcctccccaaatacagccagaacccacccgcttctggttttccatgtggaccatttattgcacctgcccctcctctaggcatagcactgcactttgggctccacccggtcctgctcagatgttgtgctccttaaggaatctctgctcgttggtcagactgactgttttcctccaagagtgcactagagtgtacttgcttctgtctggcgctttatcatctgtaaggcagggcactacagtagttgacgggctggctttgctgttgcacagactgagattgaaattctggccctgctgctccctagctgtgtgacctcgggcaagtcacttcacctctttgacctcaatatcattattggtgaaatggggttaataactcttaggtcctagggttttgtgggatgatgcacttgtacccctttgcaggcagcccttacccggcagcccccactgccaacgtctctgttgtgttcaagtctgtttcatgagccagtgtaacctccctccatgcagaaacaacgctgtaaagtattagcataacagtaggtccattgggcagaaaccacaccaataaaacgggcacaccccacagtggctctgatttccacacccttcccaaccccgcactcccaagccttgcccagggctttccatggactgagcctcagtagaaagaggttgaattagattttgaattttctcatgcctcctgtctcctggccctcagaaaattaaaatccagcattggaattagtcatggaaaaatccccattttctttcctttcattcctctgtgaagatcataggttcaggttatttctttgaattaattggctaagcctcagtgaaacatgggtaatttacctggcactgtgaggtgctggaaattataaccagtgctcctaaatggatatgcagcaaccaagcaccttcatggtgctgatgggtttgtcctcacagtgctgggagatggctaagcgggtgctgtggctattaccatccttactttagaggactgggactcaagccctcatcttgtggctctaaggtgaatgtcctttccctaacatgtctgaccttctccttcctcggcattgggaccctgggtaggagggccagtagaagatccctcagcagaacttaactggccaccagtccagagtggaaggctgctgcttgtttaaaattttaatccctttctttaagtgtgaagaatactgggcaagtgtaaaagaagggaagacatggtctcttccaaccagaaatgtataaactcgctgcagtgcctaggacacatgcgtctttattgaacaaatagttattgaatgtccgcttggtgcctggccctgtgctaagcattggtaatatggtggcaaaatagaaaagatacctcttaggcttctggccatgggcacagacagttaacaaggataatcaagttacagattgttacaagtgctatgaagaaaatttatgaaaaattaaatagcaatgtaagtaggacacactaaaataatacactaagtatcatgtatcagctctggctgcctccctctctttaaagcagagaagtccaggctctcaggggtgcgacagagccaggacaggtgtctagtgagcggcctttccatgggcagtgtgtatggaggggcctggaggtgtgggagtggccattttagaagggtgttgagattaatttctaccgttagaacccagttctcgtccatctctcttttcttcttctttgtttttgagacagggtcttactctgtccaggctggagtgcagtggtgtgatcatagcttattgcagccttgaattcctgggctcaagtaatcctcctgcctcagcctgcccagtagctaggactacaggcacaccaacacacctggctatatattttttctgtttttgtagagatggggtctcacagtgttgcccagactggtctcaaactcttgcgctcaaaggatttcccctcttggcttcccaaagtgctgggattacaggcgtgagccatgattccccacctggtccctctgttaaagcagaactcacagaagaaagcccaaaggaacaaaatttgtactttcatgatgtgggaacatctcttccagttgagaactctctaaagcatttgcaatcatagatttgtgtaagaacttgatttgcaccctaaattttgggatgtatttattacataagcagatatacctggatttgcataacagaaaggactattttggggtgacttatgacagatctgctatgtgaaagcctccaggaacttttagcatcagttgagacctgggggaaacagagaggaaggagcgtgcaggcactgaggccagaggaagaagggatgtgcctgtcctcagtggctagccatgacactgccagaggagcactgagaagggagcaagaagagcacttcctaagtggcgagaatacccagctgcaaacaaaacctcagacacagcctgaagctctgtgtccttttgtgcagccccttccttaccccattgagtagcagcttggagaagagctttttattacagatgacacctatgaatgcaagtgagggaaaagaaccgactaagccagagctgtgaattcccagaaatcaatatggacgggactggggatgcagctccctcagcttctctctccatggcccctatttgaggctgaatctaggaggccctgtgtttttgatacagtgtctcactctttttctgaggcacttttcaaaatttctgtcccagtgctaagcctgggcgagctccacagagctaacctgtgtgtccagagccagccctggctgtttttccagcttttccttatgccaatagtaagattagggctggggacagtggtggcgagagagtcaagtgtgtgtttctcaaaagttgccttgggagaggagtgaggtgaaaggaatcaaggcaataagtgtaacataggcttaaacatacttgcatgaagaaaacaaaggacttaggtataaacaaatgtttctaagacagggcacaaaaagcaatcatcataaaagtctgatacagtaacttcatcaaaatcaaaacttgtgttcatcaaaagatgctgttaagaaaaagtaagtaagccactaattgggagaaaatatttgcaaaacatctatctgatgaaacatttgtacgcaggacaaataaagcatccatgcaacacaataataaacaagcgagcgatttttttaaatgggcagaaaatttaacagatatttttaatagaagatataatggccaagaggctcataaaaagatgttcaacattattgttttcagaaaaatgcaagttaaaaccataggacatgctactacacacctaccaaagtgactaaaatgaaaaagctaataaaactaatgttggtgaggatgtagaacaactggagactcttaacgcatcatcggaggggctgtacaatggtccagacactttgggtaaactttttttttttttctttttttgagacagagtctcactctgtcacccaggctggagtgcagtgacacgataatctcagctcacggcaacctctatctcctgggttcaggtgaatctcctgcctcagcctcagcagtagctgggatcacaggcgtaagccaccatgcctaactaatttatgtatttttaatagagacagggtttcaccatgttggccaggctgatcttgaactcctgacctcaaatgatatgcccgttaggcagtttcttataaggcctgtgacccagcaattttattcgtaggtatttgcccaagggaaataaaaacatgtccacaaaaatatttatacacaaattattatagcaactttattcataataagaaaaataatgcggccattaaaaagaacaagatcatgccctttgcagggacatggatggagctagaggccattatccttagcaaactaacccaggaacagaaaaccaaatactgcatgttctcacttataagtgggagctaaatgatgagaacacatggacacagagggcaacaacacacactgggtccttttggaggttggagggtagggggcgggagaggatcaggaaaaacaactaatgtgtactaggcttgatacctgggtgatgaaataatctgtacaagtttacctgtaacaaatctgcactcgtacccctgaacttaaaaaaaggtagaaacagcatagatgtccgtcgggagaatggataaacaaattatgatatattcatacaatggaatgctactcagcaagaaaaaggcatgaactgtgatagagggaggtaacataattatgttcaatgaaagaagcctttttttttttttgagacggagtcttgctctgtcacccaggctgcagtgcaatggctcgatctccgctcactgcaagctctctgcctcccgggttcaagccattctcctgcctcagcctcctgcatagctggcactacaggcgctcgccaacacgtttggctaattttttgtatttttactagggacggggtttcaccgtgttaaccaggatggtctggatctgacctcgtgatcagccggtcttggccttccgaagtgctgggattacaggcgtgagccaccgcgcccggccgaaagaagccttaaaagagaaagcgcggtgtatcaaaactcactaaatgccacatctaagatttatgcatttctcaatgtgtatattttactttaaaatactcataaccaaatattaaactctagatggtgatatacatgtgtcagggtttaggggttgagtgtacagaggtctgcaccttcttttgaaatgtatctaaaaataagatagattgatggatgggttgagggatgacaaggtgtgtgataaagctaggaaaatcctagttgcacaatttaggtagtggaattgtgggtattcactgtacaattcttgtagcttctctgtgtatttgaagatgtttgtaatacaggttggaataaatatgctcaagtggaggatgcaagttgcagtagcatgaagggaagataattatgatttatcaccctttgttacacagtgctattttgtttatcttctttaaaattccattaaaacccaccacaggagcctttgcaatgtagctgatttatcaaattcagaagaatacttccagcgtctctgactcatttgatcacctggatacctttgagttaatcttccagccacagctctgattctccccttttgactgtgatcatcctgaaggtgtttccctcaatgctgagtgcttggagccgctttagaattgctttcactctctgttaatttggagaacaaagaatcaataagtagaaggagattgggaaattagtgatcggggacggtgcagagttcataaataatttaaaatatacagagttctggcttttcaacagagattttaataaaagatgaacaaggtcatcttcttccttctgatgaaagttacccatctgtagtgccatggcggatgctgtgtacaagagctgaaatggtggttcctgttaactttgagagctttggacaaaaatgccagatacatccttctagatagcaatatcaggcgagcctttgagtggggaggggaagttataaaccactgtagagaatcacagagtgaaccgaggacagagattggatcaacactccattccttttctgttttcttggaatgaagtcagagcaacattgttttcatttttgtttgcagtgaacctaatttttgaactgatctatgtagtaataagcacaggaaaggaaaagtggaagaaaggagattcagcacattagctagtgaggtcttgcgtgataacgaagacaacacaagcctgagccctcctggctagtgaggttggctctgcctgcctttgcccatcccaccaccttctcccgtgctgagcctttcccagccagacagtgttttgaggggcctttactacccctctccctgccagccccagcctagctgtaatcacccatctggaaggcgtgttttcctggcatttacctcccattatatggcacttcacttgggaagtgctccaacagaggcactctgctgtatcccaagaagccctcaatggcattaccgtaattctgtttatatgacgcacccccaaattcttgagctgtggctgtgacagaatcagtaattggaaatagaatttctgtgatagtcactgagttcccccaagtattaggcctgggagtggacttgtccaggtggtatccgtgggattgtgtaggggcaaacagcgatggataccctgttgatatactgagagatgctaagaaatccaaagcattccagtgacagcgaacattgcattgatagaatagggatgtaagaaggctgattaattgccacatttgataaagggttggagaggggatgaagggggaagaacgtgtgtgtgtgcatgcacgctaaggagtaccacgatagtttgtgtgtttcttccattgttttcagccctggataaagagggcccacctgtctccaaatccctggtagcaggcagagctcagtacagtaggctatattgggtatagggcatctatgaggcaaagaccatatctcactcacatccgggtcttgaggtcctgacattgagagtgtgccctggaaagagcaccgaaggttagtgagggcagctgcgtctgagcactggtgctgatgctggtgggatggactacagagtctgtccccactacctttggaagagctacccaattaaaactgagttggtggaggtattcccactgtgtctcccacaccttctctcgagggttcagatatgtcgcgttctgacttcccagcagcctgcatcatgcctcttgtctccagcacttccctcactgtgttcttgctctactgagtactctcagctgtgtggttgctttaggacccaagcggtgctgttccctcccctaggaagatgtgctcttctgggatttgggagcattcatgacatcgttctctgtaccaccctacaagcatccctttccctaccaggtttgtaatatagtcaacttttagggagggggacatgtgttcatttattgttttattaattattaagtgcccttgctgtgttgggaatagacaaggaatttgccgaaactataatccataaccacccagatttctattagaccttcatgttcatttacagataggacttaattttcttaatcagttaccaattgttgggtgactggttccctgttaatgtatggttgggtgagtgggccagctgggtatacagaggttcagggtattcaatgcagaaaggacctgaagatccatggaggtcatgtggtccaactttctgccttcagaggaggagtgtgtgtggggtgcacatctgagaaaatttacagactaggctggggtggggataaaggagagtcttatctgtaggtctgctgctttgggtttctttagattagcttagaagctggaaactggccaacgaaatgcacagaattgctggaattctggagaagagtttgcaccttactctgtactttctaattaaaagggggacccctcagaggtgattccgattctggactcccactggtgtagtgtggcaggttgagtttgccgccccgggcacatcccctcatggtcagagggatgaagaggagggggtgaatgtcaggttccagaaaagcctgctctaaagtcatttcctggtcatgctgatctggaaatagctgagaactgtgattgagacccaagttttgcccccaaagctagctttatatatggttgtagcagtcaggacctaccagatggaggggacctgtgggatagggataacaggtgccgtgtgcattggcacacaggagggcaagaggggagagagggaaaggctgcgaggggaaatggagagagaaaggaggctcttaggaaaatccctggaggagggaagacttctaacctgagccgaggccctgagccagttcctctgattttttttttaaagtcaaacatggataaagtcacactcaggtgtcactgtgaggggaaaggtggagaaaagtgactgtggtttcagtttcagctttagccaccatcttggcttatgatgttagatcagttcttgcctctctctgagcctcaatttacctatctatattttattagttgaggaatcctgaattgtaacatgaaatggttgtatgtttccaatctctgcttttacctgtgccttgttggatctccctctccccttcctagatgacctcttgggcagacttcccattttcagttaacgaaacgtcagtgttttcatctgatttaagactccttcttgctcctgccttgccactgtagtaagggggcgtgggctgctctccctacctctcagctctgactcctccattagtgagaaggaggcagagggataggagcaagtacctttatgcttaactgggcacaagagatgttttcttcctggttggtttttgcagcttctctagctgaaactggccaggcagcagcacccttggtctgacaggcatctacgtgcagattcctgctgaaattctgtggagacctctccacctcacaggtcccaatagggatttgtggctctggttcagccactctgatccctgctgcacagcctctggttgctagagtaaccttgcatggtggccagttcccctgggtgagatcccagagagagctcaagcctagccaccctgtggggcccacttaacttgcaggaagctcatgggtctctgccaggtcaaaaggtagcatggcgactgtcctagcacaggcgagcggagcagcggttcaggactgtagccaaagctgagagttccctggggtctgaggtgctagtttatccatcttgcaaacgtgattgtcttgatgattctcttaagtccccgtttcttagatctaggaaggggacctccctctagctgttatcctcttccacaaggctgccaacatgctgatgctgtgttccctctcaagcctcactagcctgtggctgtggatgggtggggggtgggggatggtggaaaagggatggttgattataaagggctggcttagtgagccctgggctggggagatgtctagttccatctgttggtttcttagaaaatgaggtattcaggccgggtgtggtgactcatgtctgtaatcccagcactttgggaggccgaggtgggcagatcacctgaggtcaggagttcgagaccagcctggccaacatggtgaaaccccatctctactaaaaatacaaaaattagcccagtgtggtggtaggcatctgtaatcccagctactcaggaggcagaggctgaggtaggagaatcgcttgaacctgggaggcggaggttgtggtggccctgagatcacaccattgcattccagcctgggtgacagagcgagactccatctcaaaaaaaataaataaataaaataaaataaaatgaggtattcagttcttgttttcagcagggagccctgtcttctctaatacctgggtaacaggaagcagtcacccaactctcctttatgtacagaatgaagaattttatcataacccacactactataccttagatacacacataagcacaagtgtcagatgcagaccctgtgccttttatttgtgttgtctttctgtgcttttgctgttctctctgtggttatttgtcaaagtatgagggtaacttcttgtggaaggacagatgttaagtattctttaaggccattgtaagctccccatcttccaaaccttagagagtcaacacacactgttctgagtctgctgtgtgcttacatcagtgctgacagaccaaattatagtactccctaacccaattctaaaggatgaatgccatggcacttaaagtattttgcagaaactattattttaacttattttcacagtggctatgggttttttatagtcttgtaggaactttggttaaatacagagtaaaaactgaagctgctatgggaataatgagggatcaggtccttcaaggtcttaaaaaaaatctctaagtagcagtttcttttgtgcctgcaattctgaattgcagtgtgtccctccagacaaagctgagcgccatatgtgactgtgcctgtttgtgttttcgaaagcctcagcggtcactgccatttcagtgcctgcaagtcttgacaggaagcagtggtaaaagactgtcagaacctgtttgtaaaaatgtttgtgtttgcaaagatttttgctagtattccatgcatatcttagctattaagcaaaaatattataccattcatcttagaagaaggaacaaggctaggtaatcactagcattctcttttctttttctggcagagaactgaaagccaagagcattctatctcatgagcactacaggtctagggcaggggtgagcaaaccttttctgtaaagaattgaatagtaaatattctaggctttgtgggccgtgtggtttctgtcacggctactcaggtctgctgccacagagcaaaagcagccttagacaagaaaacaaacgagcgtggttgtgtggcagtaaagctttatttacgaaaacctggctggtggaccagaggccataatttgccaacccctggtttagtgaaaagaacaagtttcgagttgtcaccgatggttgaatttagcccaagatggtagctttgcttgtctgattaccttcatgccaacccacattttctctggctgacactaaccaggacagaagcctaggctggtcttccattttctcttaagaaagtgatcagtttatgggattgtatgcactttacctcacccacagcagatgttcaggaactgagtatccaacataggataaaatacagaatgaaagcatcctttaacattgagatgaggttgtggtgaaggggaggagttagcagtctgtcactggggtgactttctggggagctctaatcagtcatgtgtttctgctagcagcagcatcccctcctcattcctcatgtggcatacattgcaggtcttcctggcgcagatgctttctttgctcacacacattccctcccttctttcgtttttctccccccagcacacaatgctgctgctgccacacaccatttcaccccatgctggcccacaaagaagacagaggttgatgacatagcatgcaacttcagaaagttcaccactttgagccccgatgtataaatggtagcagttggtactaactctgccagtgcgttcaaaagtcatcataaggacaatgtgatatttatttaaatacatattgcattgctgactgacagtgtatttgcagtcattatccatttctagagacaagttcatggcaagcatggtaaaaagctggacctcaggagggaactgaggacaaagtaagccctgatgactctcactggcctcctgctgcacctgtccttatatttgacctgttaggttggttactttaaaaagccagttacggggaggctcatttaaaaagacataacacctgtgaaagattattttaacgtggaatatatgactggacaattatttgccaatctgatgaagtagggccacaggttttgttttcattattctgtatctactgatcagcatatccacttgcttgcacaggctacacctataatgtccacaacttccagttgcctcttatgtaacaatagaacaagaacataaagatacagaggaaagctgagagcaattctaaatgtctatggttttttctttatctcttgttgttatacatccatatctgattcaacaataaaacatgtaacattgcttatccagtacttccaatggattcagcctggtgttttggaagaaacaactctttcttttgcactcgtatctcattatttgagacagtacttaattaatttaggtagttactaatccaactgacataaacttgggaaccaaccaccaactcctgataagcaaacagctcaactcttggggaacaaaaacgtgtaagctctttagaaattaacaagtcatgagagttcagtatggcttgggcgttagtcattaccttttagccagagggaacaaagaatgccagttcaaatgacaagttggttaaaaggaaatctgacagcttctagagtgttggaaaagaggtcaagacctgagcttctaccctcaatggctcaaacaggcataccttggagatatggttggtttggttccagactaccacaataaagcaaatatttgcagtaaagtgagtcacacaaatgtttttgtttcccggtgcatatgaaagttatgtctatactatactgtagtctgttaagtgtccaatagcattatgtctaaaaaatgcacataccttaattaaaaatactttattactaaaaatgctaatgatcatctgagccttcagcaggtcataatctttttggtggtgaggggctttgccttgatgttgatggctgctgaccgatcacagtagtggttgccgaagaaggctggggtggccgtggcaatttcttaaaacaaggaagtttgccacatgatagattcttcctttcatgaaagatttctctgtagcatgggatgctgtttgaccgcattttacccacagtagaacttctctcaaaattggagtcaatcctctcaaaccctgccactgctttatcaactatgtttatgtgatattctaaaccctctgtttcatttcaacagtgttcaccaggagtagattccatatcaggaaaccactttctttgctcatccataagaagcaacccctcatttattcaagttttatcttgagattgcagcaattcagttctaccttcaatcttcacttctaatacttattctttgctatttccaccatgtctacagttgcttcctctactgaggtcttgaacccctcaaagtcatccatgagggttggaatcaacttcttccaaactcctgttaatgttgaaatgttgactttctttaatgaatcacaaatgttcttaatgacatccagaatggtgaattcctcccagaggttttcaatttactttgcccagatctgtaagaggaattgctatctatgggagctggagacttatgaaatatatttattaaatcataaggcttttcagagtcaaaattactctttgattcatgggctgcagaatggatattagcaggcatgaaaaccttcatctccttgtgcatctccatcagatcaggtgcattgttagtgagcagtaatattttgaaaggagcttttttctgagcagtaggtctcaacagtgggcttgaaatattcagtcagctgtgctataaacagatgtgctgtcactcaggctttgttttccatttatagagcatagagtagattgagcatcattcttaagggccctgggattttcagaatgataaaggagcattggcttcaacttagtcaccagctgcattagcccctaacaagagagtcagcctgtcctttgaagctttgaagccaggcattcccctctctagctagaaaaatcgtcgatgggatctccttacaatagaaggctgttttgtctacatgaaaatctgtttagtgtcaccaccttcatcagtgatcttagatcgtctggagaacttgctgcagcatcctcatcagcacttactgcttcaccttgtacttttatgttatggagatggctgcttttcttaaaacttatgaactaagccctgctagcttccaactttctctgcagcttcttcagcctttatagaatttaagagagttagggccttgctctggattagactttggcacaagagaatgggctggtttgatcttctgtccagacccttaaaacattttctgtatcagcaataagggtgtttcactttcttatcatcatttgttcattggagtaacacttctaatttccttcaagaacttttgctttgcattcacaacttggctaatggtttggtacgaaaggcctggctttcagcctgtctctgctttgaacatgcctccctcactaagcttaatcatttctagcttgtgatttaaagtgagacatatgagtcttcctttcacttgaatactgagaggctgttgtagggttattaattggtctaatttcaatgttattgcgtctcagggaatatggaagcccaaggacagagagagagagatggagaacagctggttggtggagcagtcagaacacacacatttatcaattttgttcacagtcttctatgggcgcagtttgtgatgtctccaaacaattacaatagtaacatcgaggataagtgatcatagatcaccgtaccagatacgataaaaatgaaacagtttgaaatatcacaagaattaccaaaatgtgacacagagacacaaagtgagcacttaactgctggaaaaatggtaccaatagacccgcttgttgcagcattgccacggatgttcagtttacaaaaaattgcattgtctgtgaagctcaataaagtgtgaagtacaataaaatgagatattcctgtataataataactattgtgtgcatactatgtgctgaccattgcacattatctcatgtactccttttaaccgtgctttcactgattagaaaaccaaggcaagggctgggtgtggtggctcacgcctgtgatcccaacactttgggaggctaaggtgggcagattgctttgagctcaggagttcaagaccagcctaggcaatgtggcgtaaccacatttcttaaaaaaatattagcctgtgtggtggcatgtacttacggtcccggctgctcgggaggcggaggttgtaatgagctgagattgcaccattacactccaccctggggaacagagactctgtcttaaaaaacaaaaacaaaaacaaaaaggctgagttagagaagagcaaagtgcttgcccaaggttatatagcttagaccgagtggggattttgaactcagactgcttgactccatatttactgtgctctccagcttagggcaaactggtagccgggaagtcatccagctcgatttcagcttgcctcctcctgatttcctggatgtctggtttttaaaaagttaatagcaaactagtatagtgttggctccacagacgtgcttttcagaacccacctatttgccctttactggtaatcaggggtaatcctgtcccatatctgtaccctgatatgtctgggttgtaaaaagtgtaagactggatggtacagttaagctatttgttctggatttgggttttttaagtttggcatttgagcagaatcacaagttgtagaaagtagtaatttccagacatttgagatctgattcaccaacattactgtaattaaagaaaaacctatatttgtttgctccgttttgtctcactaggatgttttataaataataaacctagacatttagaaaatagcatctattcagctggttaagctttcgtggcccttcatgttcagatgtctcaaggtgatatgagtgtgcctcaatttatagggagtgactatggatggtgaactatattgacatataaaggcagctttaaaatacagactacagaaatcaagtggcttgacaattcccttagaacatatgtttatgaagtatagagctcaaatgtaatgatttcagttggttacagagtattaatgaattttgaattgaggcaattgtgatcaagcttgttgccttttctaacatgaatcattattaaaatgatgattgtcctccatagttatgaaagcattaaaaaagcatctacctatgcctgaattaacgggacagatgtggttttcagctttcacctggccaacaggacttccatggttgtgatttcaaggtgcttgtttatgtatatggttttgctggtattttctgagtcttcaataccatttcttgtaatagggtgtgaatgggtgtgtgtgtgcttgctagtatgtccccttggtccttagcattgtgggaatgtaaagtgaagctgagtaggatgtctcaatgtcctagaatcctccagcctttggtttttaagaggtacccctgtgcgagagctcgtggaggcccttctgtgtaacattcacaacacaaccaccacattcagtgacagcaggtgctgagtgcaaaccgtgtgccaggcatttcccaccatcagtatcaatcctcaattccagaaagttggtactgttgtgaccattgagaggatgaggagaccgttgcttggagactttcagtgccttgcctagggccacacgatggaaaagagcagaaccaggaattggactgctcttcaccatcctcatggctgcctggagggcaggcagtcttgggcttccttaaaagatttttgttttgggagggctcttcactgtctcaagaaagctgagggaagaattcgtctcatttagtggatgaggatacaaaaacatatgttaaaaattacagcctcgggctctgtggaccctgttcaggtgccagagggcttttctcctatattgagcacctttgccacaaagaagctagaggaggaaccctcccccgatttcaccttgtgagttacaggtgtctgacagccctgttcttagctaagaagtgtgtgtgcacctgactgcaaacagccgccatgcctgctggaggacacatgtgacacacagtttctggggaccctcctgggcctacagactgcagtctcgggtgggtacccatggcccaggacttcacattcctcacactgccctgccctgcttctcttctgtctgacctgatgccccaggcttagggtggggaggggatgctggtgggtgggttgtcattttcctgtcccagtcaggtattttgtattgtttctcaatgagccatttcccatctggatttgggggggatcagggaagatgggtgggttatgagttagtttgctgggcatcttcccttttttctctgtccagctcccaggtgtttgaggctttttcctgcctccaggtgctccaaatgtgggggctgccctttctctatctgggtttcagcctctccagctcctgcaagacagtgctgttggatctctgtagtgcctcttggtttggccactctgggatttgtgagtcatagtcttcagtttggtgctttttcctactccatcctgccttctgctattcatgccccattgcaagaacaggcattcttccttcccgtataaacttgcaacctggttccacccattctcctctcttcttctccagatagtcgtagagatcgctgcctcccaaaatagccccatttgattccttaggacaggcaggaaactcgctgcccgaccctgcctgagtctccgtttccttagctggagagactgtccttgctctagaaaccaaccaccggaaattcacctccatccctatcacttcctggggtagttctttctgaccattgggtttgcttcttgggtgtctggctctgcatacagttagaagctctttaaataccttttaacttcagggtttttgtggatgtgtatatggtggagggagagagtgtataccagtgagcatgagagcaagagttactatttatcacaactggtgtccaggggtggctaaagattatcgacttctagagttgtgtttttcaactttttttttaaatcttagtgagcagtaataaatacattgtaactctcaagcacacataaatgtcatctgaaacacgtttgaaaaatatatgcgatttatttgttttttgagatggagtcttgtgctgtcacccagggtgcagtgcagtggtgcaatctcggctcactgcaaccacggcctcctgggttcaaacaattctcctgcctcagcctcctgagtagttgggactacaggtgtgcgccaccacgcccggctaatttttttgtatttttagtagagaaggggtttcaccctgttggccaagctggtctcaaactcctgacctcaagcagtccggcctgccttggcccccacgaagtgctgggattacaggcattagccactgcgcctggccgaaaactatatactcttatattctgatatttcctgtgcaatgtgatattttccatacaattttatttcatttttcaaaaattgctggatacaaagcactgaattaatttcatatgtattttatttaaacaatcctctctcctccattacagtatacatttcatggagacaggaattccatgttattctacttcctataattgatgcttaatacctattgtcaactgattcttttctctgtgcagatcctctggagaaatattttgttctgtgccaagaaacagtttcattcaacggttaaggtgacttgtgtcactgatctgatttccttcttttacattaactatcaaaaatctcagacttattaataaagacatgtcttcacaggatacatctttacaatggtcttatttttattttattttcctcgctctttttttttcattttaccttattcttctgtcctaaatatttaaagtttcagctgattttaaagtaaaagatgctcaatgggaaaagctcacacaaatcagagctacctaaaagtagagttggaaagtcccaaggatctttttctctgaggcaagcctctttgcttctgggtgcttgccctgcagactggcttatgaagaggtcaccatcttttcagattccaggggcctgtaatgttcataccactgcagtattcgtattacacactgtaataatctggaataataagatcgtaggcactctttcttgccctcacatgtggatctgccttctccttttaaacagccatgtaacgttccctttctcacctactttgaatttttatattcttgctgctctaaggttttttttttggagcaaggaaagcaatttaaaacataaaatttactttcaaaagaagagtagagataattaaccagcccttgccacctaactcaatataatcccctagtaactcctcttggagccaccaggttccctgggagtggaattgcctgtggaaaggcctgtgtgggttctgagcttgggaaatggtgacggagccctctctctagcctctgggaggtgtcaaataatggatgagagtgaccttggactggcaagagcaggtcagtgcaagtgacatgggtttcttagatactcctcagctcagtgtgggtctcccgagactcagttctgcctgctgacttgctcattcatttccattgcagggctgcagttgggtcatgcctggttttttggcctcccaatgtctcttaattaacttaatattacttggtaatactaaagcaatgatgaattatgtgcatggagtcattaatcttctgtgtaaatatctcaaacgctgtgtcttaattatagactccatacttaaaatattttaaagcttctattcatatatttacttagaaaggtatgatccgtgtttctatggtgtcggcacactcagtgggaaaatggtgtccatacattggagacgttcgtatgaaagagtagtttctctgatgagatgagtgctgcctgttctccactgacccacagacattcttagccttagcaatgaagggagttggggtaagattgggcctggggatctgggccctctttcaccttctgactgttctgtctatagcaaaccatagagagtttttctggacagtccaggaaggtgtaagagcagctttagatgaggcagctgtctccctcatagcagagccagccctaagccagggcagggcctcctccgggaagaattgtgcacctccttcagggtcatcagtgagttaggtacattgtgagtatactaacttagtatttagcagttactctgcaccgggcaccatgctgttcctgggtggtggctggtggctggggcagggcagtgagtgttacatagactagacacagcagtaatagccaatgttccatgagaacttgccatggggtttgccacacgaagacactggctcttgtttacataggctgcctcatttgcacttaccaacaaacctgggtagcttctggtgtctgtattctcattttacagtgaagaagctgcagtgaggaggggtaaagtcacttgcccaagtctgcatagctaataagtggcagagccagaacctgagcccactgtccaaggtgaaggtgcttcctagcatggtggccacctctaggtaggagctcagctgtgccacccactgggacagatacactcccaacagctgtgattgggtagggtggctccacctcccagatgggtcctcggtttgctgagtgttggttggataacttgactaactttctcagcagtcctttgagcagctgaggtcatacttagatgtgacttacgtgagacaacagaggagtccaggtgagagctggcaggcatgggaccagggtggagttgtagttttccccaccaggtgggtggagccaggtctcttcaaaccagagggcacaattgctgtttgtattgttcacgttgactgtagcaaaaataactcagtgcctgtgaacctcatctgtgaaatgtaaataaccccttctctgcctatttgttttttgagacggagtcttgctctgttgtgtaggccagagttcaagaccagcctgaccaacatggtgaaaccctgtctctactaaaaatacaaaaattctccacctatcttactctgtagcttgggaaatcaccgagataagaggttggaaagtgataactgtccaggcatgcaagtagtatgtttataggaacatgactgagcaacagggaaatgagatttctctctctctctctttttttttttttggagatggagtctcgctctgtcaaccaggctagagtgcagtggcacaatctcggctcactgcaacttccgcctcctgggttcaagtgattctcctgtgtcagcctcctgagtagatgggactacaggtgcatgccaccatgcccagctaattttttgtatttttagtagagatggggtttcaccatgttagctaggatggcctccatctcctgacctcatgatccacccacctcagcctcccaaagtgctgggattacaggtgtgagccaccgcgcccggctgagatttcatttttaactcagacgtcaatcaacgtagccatatacagatttgaaaagcttttctttatctctgttaatggagaaaaagaatgactgctttcttgtcaaaatgaaagtgttcagttttaaacttaaccagttcctgccattttgaaatgttcactcatttcttacttttttttttttttttttttttgacacagagtctcgctctcacccaggttggagtgcagcagtgctatctcggctcactgcaacctctgcctcccgggttcaaacaattctcatgcctcagcctcccaagtagctgggattacagactcgtgccaccatactcagctaatttttgtatttttagtagagataggtttcaccgtgtttggccaggctggtcttgaactcatgatctcaggtgatccacctgcttcggcctcccaaagtgctgggtttacagccgtgagccactgtgcccagccaccatttcttactttttggcaaaggaagtagacatattggagggttgacctgaactccatagattcccagggagacagtgtatgactttgatcagcccatgtagggcacattcccattgccatccaattttacctgagccattgggatgggatgcaaaggcctgacatggtttagaaataaagcataactctgcagtgccaactaggatggggtaaatgggattctggcctgggtgacaactaagacaagattgctggcccaggtgctgagaaatgtagcccgagataatggttctgtttctccttttgtgtagagatgggatcttggaatctagtgaggtgaagtacccagctctctgctttggtactgtgaggggattctgcagaggtagatggaatatggtttttgtcctcaaggcactgacaagctgcaaatgatacgagacagtgtatcaataggttcaccttcccaacccttctctgctcttgtacttggttggtgctcaattgtttgttgatatgatttaccttcatgatgacatgtcaaaacatgtgatataatttttagctctggatggcaaacagtttcaacttggatgccaactctacccagtgggtgctgcctgaatggcaaaacatgtgacactgcctcagggtgccaggagaaagagtgccgtctgatgaccagtgggaatgtctgttatggccgggggatgggggttagaagcagcaggcatgtggtggtcattggttcatcctaagtacattaggctttcaaaaggggaaaaatgatgctcagaggaaatgaaactccttagtcttcccttaaagggtgaagcaggatttagacaaacaggagtgctttcagtcttggaaaagagcagacgtgaagaccgtaccttccagtgagtatgcagatatgtgggaggctgtgggagctgagggactggaggcacgtggaggaggaaggggcatcaggaggggcaggggcactgtcctcgctggacccatgacagacgtcagttggttgttggtaggttgagtgtagacagattgcagaggtcctcggggatgccagatggaggaatttagatgtgatgcagtcctgtgcttctcaagaagccttcccagatgctccggacacgattagctgctccatcctctccgccccaaaggagactcctagtactctgcttgagcttggattcttgtctgctgtcctgaaatgtttatatattatctgccatcctccttgaggatatgaacagtgttgtagccatctttgaatccccagtgctcaggatcatgcctggtatggagcagataaccagtgagtggtgttgaattgagctgaaatagggtccctgaactgccaggcgagatgggatggaagtgggcagtgccttagaggtgaagctgggtgcggaagtgggaggctgccaagcatagaatgtaccctctgccaagggagctcagagtccatgtccctgggatgcacgggatgggaaggaaggcaagtctgaagcgtcaagtttacaagagtgtgcacagcacaggaaaccagttgaaattgaagatggcaacagagaacggaaaagattgaaggagggaatttggaaagctgagcctagatgaattcccagaggcagtgacttatagggctcggaggccctgtgtatagggaaccaccgctgaacctgtgggtcagagggagtcatcaaagatgttgtctcttgagaaatgaggagctactgaagattctctctctcagatacctcaacattttagagacatggagtgatcctacagcccattgtattaatatttaggtgggactccttcatttgcaggtgacaaaaactgaacccaaactagcttaatttggtggcttttataactgaaaagcccaaatggggaggggaggggagagaagggaatttttgacttcaggctcaacttgatccagggatgcatacagtggcctcagggccaggtgcctgcttctgagtttcgctggctggctggctgactggcacactttctcttcattttttggcttggcttcccttggtgggtgttagctcttcatctctatgtccccctggcaactctaggcttgtggtctctcagggctgaatccagccaacaaaagaacttcttacctagttaccccagggaaagctcccagacttgctctcttcggacccggttggtgtgggttggagcttatgcctatccccgaaccaataaccttggctgcatgccaactcttattgcccctgggatgagagcaggaatggagcagttcctgggggaaggtcagggtgctgttacccttggagttttgctgggtggcaaggccatcattactgccccatccaggctaactgttgtagtcttggcagcaaagcagaagctgcctttgctctgccggtgaggaggagagctccctgccagcctctgccgccccaggcatgctgctgccctcttcccacagaccgcatgtccttgaagctgggctccgtagagtggtccaccaggtcaccctgctggccacctccatttgtcatccctgggcacattctagacagcatcttgggccggggccttgccccacctgggtgattgtggggtcactgaactgtcgtgggatctcaggagaaacctcttcagagagtctgcatccacagggagaagtgtattcacacttcccacaggctggggagctgtctcacctatccttagtcagggcgagccttccattgtgaggtgctttatagtttgcacagctctatccaacttgttacttaatctggcttttaccataacactggtgggcaaggcaaagcaagaatgattgtccctgttttatggatgaaagaactgggaatcaggaggggtaaatgtctcaaacggggcaacacagctgtcgagactagcattagacttgggggacacaaatgtcacataaaatgtgtacttttaaaccgaaggtgaagaaagatgagggcaaacagactactgtagccagtttcttcatgtaaatgtggtgttaaattacccattgttgttcctctaagtgcatacttcattaatacctgcaggggaaaaaatgacctctatttacagccaagcatctctgagccgacgcctgcctgcccaccagcctcctgtggtttacccaccaaaattttactagaggttgaatcggcttgtagaagctgtgtgatagcgctgcggctcccctgggtcacctcctgaaacgtgtagggtcgtgagtgggagggtgtctcagcaagcccagcctgaatgtgcacgatggcctcaatcgacccagccacttgaaaaagcagccgctgctctcggttcttgctgttcttgcttggtcagctcttccctggggtctctgcgccctcacagagcctccctgtgaagcctgtccttggagactttgctcaccaggtcatagacaattgttgttttccaactggaagagatcatctgatttagtctgttcatttcacacatgagaaacgaagaccaaaccccgtaccgtggcacctggggccctttgtgtctgccctccactgtgtccctgcagcctgtcccttcccttcccacctgtcctcataccttgtgcttcagccatgtggactgctcttcgccctgaacagcttgccttcgtgcgggctcctcttctggatggaacaccctgcctggagcagggagggccatgatgagggagcaggtggctgtgctgagcctttccctgacatgcactcatggatgttttcctggaacagagcaaaaccagggggcgctggtatcatagaacttcttagtgggaagggacatttaataatagttggtcaaaacctctcattttgcccatttatttattcatttataaatgcggaatatctatttttgtgacaggccttgggaatgcaatgatgcatgaaatagaaatgatctctggctttaaaggaatgataatttattaggggagacaaatattaaagaggcaatttttaaaaattgacaaatagctacataattagggtgtacaacatgatgttttgatatatgcatacactgcggaatggctaaattaaactaattaacatatctattacctcacatgcttatttttttgtggtgagaaaatttaaaatgcagtcttagcaattttcaagtatgcaatacattgttgtaactatagccactatgttgtacaatagatctcctgaacttactctttctagcttttgtatactttgaaattttttatatgttgatcaacatctccccaatcttcctgacccccacctctggtaatcatcattcttctctctgcttctgtgcgttcagtgtttttagactcctcatataagtgagatcatgcagtatttgcctttctgtgcctggcttatttagcttagcatagtgtcctctaggttcacccatgttattgcaaatgacaggatttccttctttttaaaggctaaatagtatttcattgtgtatctataccacattttctttacccattcatccattgatgaacatggaggttaattccatgtcttagctattgtgaataatgttatgaagaacatgggcgtggcagacatttctttgacatactgatttcatttcctttgtatatacattcccagaagtgggatcactgcattatatggtagttccactcttaattttttgaggaccctctgtaactgttttccatagtggcagtactaatttacactcctatcaacagtgtacaaagcttccctcttctccatatctttgccaacacttatcacttgtctttttgacaatagccattccaatgaatgtgaggtgatggctcattgtggttttaatttatatttccttgatgattagtgatgttgagcactttttcatgtatcttttggctatttgtatgtcttcttttgagaaatgtccgttcaggtcctttgcccattttaaagtcagattgttttcttgctattgagttgtttgagttccttatctatttttgatattaaccctttatcagatgaatggtttaaaaatattttctcccatttcataggttgtctctttattctggtggttttccctttgttgtgtgtaagcgttttagttagatgccatcccatatgtttattttggcttatgttgcctgtgcttacagactcatatctcaaaaatctttgccctgtctaatgtcaagaagcttttactctgtttttctgtagtactttcactgttttaggtcttaatgtttaagtctttgatccattttgagctgatttttgtatatggggtgagagaagggtctgatttcattcctctgcatgtggatgtccagttttaccgtaccccttattgaagagactgtcctttccccactctgtattcttggcacctctgtcaaagatcagttgaccataaatgcctggatttatttcttggctttctgttaaagaggtaattttttaaaatttaaatttctattgtgaattacggctgtggaaaagtataatgggctttgacagcatgtaacagcaggctctaattttgtctgggaggtcagtaaaggttttgctgagaaagtgtcatttaagctgagccttgaagggcaagcagagtgtagtctgatgagaaagagggttggggagactgttttagaaagaagggaacaggatgtggaatggttccactgtggcccagggccacagcatgaatcagtggctgagttgggactagcagaaatcagatctatggctccaagccctgtgttccttgcattcaaccccgctgggtgcgtttttggccctgtatcacagagctctatgcttattcatctaaagagggaagttcatgtccatggggcaggcacccttggtggataaagcagggacggcaaagacatggaggtgggaaggtggctggcatgtgtgggagggagcaggttggcccatgacttggagtgaagcactctgacagaggagaggtgggaaagttggaagaggaatctaggcaaggatgaaaggatgagatccttaaccaagaagctgcaggttgggatagcaggggaggccaggtgagatattgagatcagctgttgtcctagcagtttgactctttatttcaggcttgttctaaaaagggtttatggtaacttagatacatacatatgtatcctgttttttgtttttgttttttaaatacatatgctaggatcataaaacctcatgctgtaatagcctctacatgtctagatctatagctttattcctttcggtttttttcttctctgctttctagtagcacctatgagtgccttacatatgtctgatgctacagttaaagacacaaagagagggcccctttcaatagagaatccaggactgcagggcacagaaggaatggaaggtgtcagtgggagagggggacttctggcagagtataagccagaaagccttcccaaagccttggggcacatgggtggaagagcaaaacagagaagtgactcttacctggctgcatcaagcctctgttcaccttttgacagcagcttgggagctctgtgaggacagggttctggctttgctgagaaggatgcaggtgctcggggatagatggatagacagatggacaagtattcatgccacagcactaataagaggattcttaaaataggaaaggaaagtaccaagtctaatgaaggattttggcatctcccacctcctgctagttgacagtttctgtttctcaagattctgtacagcattaactggtttggagattattaactagtttagagactactgatttagagcctctcctgttggtgaaatttcactgtttaaagaagacacatcaggttttagaattagatttcagcctttgtttctctagtggcttgagttctcgtgggcggggtagggggagggagtggggggacatccgtccatatacagggtagtttctggacgttgttttctaaaggaaggtttgactggccctgcctactcaggatctcctgccagggagaagaaatccctgctggtgggtgactgagtgccacaggtgtgactctgcctggcacacagagggggatgagatgcaagaatcatttactctttccctgtacctggggaagggctgttaaggtacagctcctgctcaggccttttataccagggacgcctcatttcatgtatggttctagagggttcctgctggccccttcttctgccatcccagtctttcatccttgacagtgcttcttcctctgtgcttccatcagtcgtggccacagacctcagtgtcctctatgtgtcacctctcacctagctgttttggctgggcccacagtcccaccttgcctgttaggaacctgactttcttgttggcttccttttcaaattgttaattcaacattcttttctcaaatgaacaatccttttgtaaggcgaataattatcccacttctcctgaacgacgttttgcaagatttaaaaataatacttcatttgttgaatgtggagggatacctgtttcataggattcctttttagtggcaggattgaggaccgggatgacattggcttctagacaaactggtctgcctgctctccaggctgtgattgttcagttggcatcatggtagaatctctgtaataaagaattgcattaaaggaagtttgtatttcttatgaagaatcccatcaaataattcactaaggattttggaaagagaaaccaaattctttaaaaagcagggagagggcaaaggagaaggaaaaagaacgttaaacagttcatttatactaatggcccttgtgttattgtggcaaaatttcttctaaataaaagtcagagaggaaaaacaagctttgtttgggaggtgtactgtctgttctctgccttgtttttctgctctgaagtatagtgtgctgtcttgacgtaggtatgtaactgctatgaatattgatggcagcaaaagcttttttttttctctctggcctagtaaataaagcagcaaggataaaaagggatgaattgtaaaatcagtgtgctgtttttagcttctctggttcccttagaactcttaagtctcaaacatattgacaatctgcctttggtggtcagggtctgatgtgagcactgtgggttggcattttcagggatttttgcctctggttgaagtaacagagttcctttttctttgagctttcagagttaatgttatggcttcattgaggccttcctgtatctttccctctatccagtggcaatgctggtccctgctcctcagaataccgcagtggcctgagtgtgtgatcgttcctccagcagccacgcctcgcatgcctcccgagcaagcactcctctgggggatatggcagggaatggggcaacggggaatctggacagtaagcaaggaagggcatcctcgtagctctgagcgtggcatttcatgtagctgtatgaagggcatgggggaagaaggcatgggggcatgggatgagcctggctaagaacaggactggtctgaagtctagagggggcatgagtatagaggttggagatgagctaggctttctaaattaaattataaacacactgatgctggctaactctcaaaacacacacacacacacacacacacacacacacacaattcgttcactagactgttataatggtgttctgaggagcaaagggagctttggagggcaagtgtttagaaatgacaggaaccacaacagccctgtccttggaaggaagccctgttatatgaccagtgaagagtggagaatgggggcaaagactgggatgcatggccatggctgcatggtggtcaagagggaggatacctgtggcacgacaaagggatgttctgcctggcacggccggtgacagaggggaagcgattctggcagcagacagccggagcccaggggcagcacaggcaaggcttccatttaaatgcacaagggtgttggggatactgcaagcaaacatttaataggtgacggttcctcaaagggtcaggcttatgggaatcatcctaaaatttgtgtttttaaaaatgtttctgagtataaagtgttctcttcagaaacataaaatttattttcaaatacacatttgcctattgcataaaaatatataatagtgataatatatagcaaagtgctttttttccccctggaatccgttgtgaaaaggcaggggtggcctgatgggagggctgaagatagagaatcgctcttgtcagttactacttttgtgactcttgagaaattctctgtgtgtacattcaaaacttccccctccacacacctcccccccacaccaacagactaaatgacaggtaccatagtggggacatttttctggctcctggtacagtgcctgtcatttagaagtggtgttcacgtgtttcctgagcctattttattttgacctcttgccctaggcattttaatgagtgaatttcatgacctccatttctctaaggtattggtaacttttcgggtcccactgatattagtataggactctatagttcatattggaaagttacagttgctgatgatactttgttatttaagtagcttcatgccgaggaatgcctcttgcaaagttaattacacacatctctgttggtccatgtttctattgaaactgaagctgtataaagaaaacatttgtaaaagaggaaggagtcaaagtttttagacttgctgattggtatgttttccacagctcatggagttgcatgggttggaactggaaaggttctacgagtcatttagcccgtgagcagcacctgtgaggtctgtggcagtcagatgggcatggctgctgggatggatactagaggaaaggtcagaggctctgcctaggtttcctgggaaagtgcatgatgacctgtcacaagttcagccgggagaggcggcatgccaataagcaggcagggtgtttgccatcctgaatttacttcccttattgtgtggatgcaaaaacttatatccagaggaggagaaggacttgtccaaggttaccttgctactcagtgacaaagctgactgtgacttcgaactcagacataaacccaagaggaagagagggtcaaaacagatgcatcttcattttttccagaggatgaatttcttctgttcaaagacaccattggaatctttgttgtacccttgtgcttttctgggcctgatttggcaacctcaggaggaaagcatgctgcgttttgcaaatgtgtgcaaataacaaacatgcctgttatgtcctaggcagactcatcacacgcattggggcagttggcaaaatgcagtcatgcagcctggaacgaaaagtgttgcacacgtagttgcttatgagaaattcagtgttagaatgtaaatgccttcctggcccaggggcagtgtaattgttccatttctcataatgaaactttgtttggagggaaatgcttatatgtctaaggtgttgattctaatctctgttcctttttctgtctcctcttcctcccctgcccctgcttttttggtatgtttctttgtttttcttcacaggaaaaagtagaatatgccttcctgattatttttacagtcgagacatttttgaagattatagcgtatggattattgctacatcctaatgcttatgttaggaatggatggaatttactggattttgttatagtaatagtagggtaagtctcttttactttggggaaatgttgatttggaaaatgggaggtggaggttggggggggtggtggtaacaaaacagtctttttagggaatgtggttgctcttttatgccagctgttgcaccagaacctctcaggagttcttttaaggctggtgatgctgctgtcagtctctgggcagatactagtttgaaattctctcgttgttactcccgtttttagtaacatgttatagaagggagtctgaactcctaatatgagaggctttacctaacacggtcttggatctccagaaatagaccaaccctgttggtgattagagtcaaatgagtagagcttttaatacttagtgccaatgttaagttaaaaaaagtaaaaagtaataaaaccttcatagcagtaaggtactctgctatttaacatcccttgagcaaagctattaattttctttttttttttttttttttttgctgacttgcgggagaaactctggcatactactgttccattttaaataatgaaacaagtgtctggataatgtcacatatctggcataaaatgaaataagctagaaaatgcagagaagcaggtgttccaccaaaatcctgttgcaggaagaagacatcagtagttttagtgaaaggagaatgttaaaataaaaaatagtggcctgtgttattttagtccttccacacctggaaatgttgccaggaagagaaaaatgaatccatgttacaggaatgctgggtctttggaccaaatacccatgtaggaagataagatatatcctttttcccagtcttagttatgctagctgtaaagtgagttgctcctcaaattatgtttctgtaaatagcctctctgttttcatcttcatgacttcagtgaactgccttttgcagttgagcaaggtgatttttcttgtggattatccttttatcatgaatcttttgccttttcattggagactaattctgctgggtattgggagagtggaattggttgtgggccttcctaggtcctttcaacctaggaagttaatatgagatcctaattgcccagtgggacaattagacttgtgggaaacaagttagcttttcaaaccgcccccgccgccaatacattgtcatttaaggcatcattgcaaaagaagtgtaccaaaatgaacaggtagcagatatgtgccgtactttcctgtatttggtggactctgtcgaggaatggcaagccgaagccttgcaggtatgttggttctgggataatctggctgtgcctcttctgccactggactttttgttcagctaggaatggagatgcttagccccatttcttgcgtcaccgtgctatgatcacctcatatttctgcctggagacatttttcacactacagcacagcacaaggacagggaaccaagtggagcatggtggtcttattgagttaaggagacagacaagagtttggggaggcagaataggggaggggagggagctatttagagaaagagcttcataaatatgccttagagtactcttcagttttggctgagggctaagctacgcctacacggagttgtgagtccatgaggccaggaaagaccactactagggaaaagagaaagatcagggagctgtaaaatgaataataaccagggctcacaaaggactggaaggcattcaaattctgactaattagggtggaaagacctcattgaacaccctggactgtcagtagagaccccacagggccactggtagtagtgctaaactggctctagagcaggggctggcaaactgtggccaatgggctaagtcctagcccatctagcctgccacctatttttataaataaagttttattgtaacatggccacactcatttgtttacatagttcagtttgagtagtttaggtctacaaaacctaaaatatttaaatatttactatttggccttttacagaaaaagtttgccaattgctgctctagagtacagagactacctgaaatccttgcttacaatgtttgaaaagaagtctgaaaagaagcaaactaggctgggcatggtggctcatgcctataatcccagcactttgggaggccgaggtgggtggatcacctgaggtcgggagttcaagaccagcatggccaacatggtgaaaccccctgtctactaaaaatgcaaatattatctgggtgtggtggcgcatgcctgtaatcccggctacatgggaggctgaggcaagagaatcgcttgaacctgggaggcaggggttgcagtgagccaaaaccatgccactgcactccaacctgggtgacagagtgagactccatttcaaaaaaaaaagcaaactgatatgctaactgaactgcctgccagaacataactcaacattctttaaaggaagacaacaaaatccagacactgaacatatgaagaaatgtgacccataaccaggaggaaactccgtcagtagaaacagatcctgaaatgacagagatgatggaattagagaaggacttcacaaagctttaaaaactgctgttataaatttatggacttaaagggatacctgattatagtaaggaaagatgggacaatataaaaaaaaacaaatggaactttaagagatgaaaaatatatccaaaatgaaaaattctctggtttggcttaacctcagcttaaacactatagaaggaaaaaatatcagggaatttgaacatatggcaataacatgaagaataatgattgaggagaaaatgaatactgcctctgtggcctgtgggggaataacaagtggtctaacatatatatatatttggagcctcagaaggagaggagagaaagaggagacagaaaaaaaattttgaagaaacagctccagattttccaaatgtgatgaaaaatgaaactcacaagaagctcagcaaagcctgagcaaaataaacatgaaaaaagccacatcaaggcacatcataattgtaatcaaattgttaaaaaccaaagataaggagaaaaccttaaaacagagaaaagaaaatctcagactatttgtcaacaactatgcaagccagaagacaatagagagacatctttaaagtactggggaaaaatgtcaacctaggattctcactcagtaaaatatctttcagagttaaagtcaaaatcaaaattttttcagacattctagagtttcagaattcatgactaatagacctgtacctcaatcagtgttaaagacagttcctcagggctgaaggaaaatgacacgaggtagaaaagtggatctacacagaaagaaatgaagagtaccagaaagtggctctacacaaaaaagaatgaagagtaccagaaagggtaaatacgtgggtacatatacagatatttctcccctcgtttaaaaatttctttaaaggtaattatttaaagcaaaaataataacagtgtattgtggtgtctatagcttctatagaaataaagtacatgacaatggtagcatgaagaataggaacagggaaatagccatatggtcttgtgatgtacttatacagtagttggaatgattaaatattatctgaagatagactgtgatacctttaagatgtatattgtaaaccctagagtatggattggtgagctacaacctgtagaccaaatctagtttgagcctttttttcccccaccattgacaaagtattttatttactgcctactttggcaaataaagcttcattgtaattcagccacattcagtcatgcctatggctatttggtattataatggcaaagttgggtagttgtgacaaaccctatggcctgcagattctaaaatatttactattcggcactttatagaaaatgtttactgacacttgccttagagaagccactaaaaaagaaaatcccaggtctatctaataagcctattgtagagattaaatggaatttaaaaaaaacccctaaatccaaaacaggcaaggaagaagaaaaaaggaacaaaggacaggacaaatagaaaacaaacggcaagttgctagatttaaacctaggtaaatccttattaaaatcattatcatgaagaaaggataatggcctttctttgtgtccatgtgttctcatcatttagctcctacttataagtgagaacgtgtggtatttggttttttgttcctgcgttagtttgctaaggataatggcctccagctccatccacgtgcccacaaaagaaatgatcttgtccttttttatgactgcatagtattccttggtgtatgtgtatcacattttctttatccaatctgtattgatgggcatgtaggttgattccatgtctttgctattgtgaatagtgccacagtgaacattaacatgcatgtgtctttatggtagaatggtttatttttctctgggtgtgtacccagtaatgggatttctgggtcaagtggtagttctgttgttagctctttgaggaattgatacactgctttccacaatggatgaactagttcacactcccaccaacagtgtataagcattcccttttctctgcaacctcgtcagcatctgttattttttgactttttaagagtagccattttaactggtgtgaaatggtatctcgtggttttgatttgcacttctctaacgatcagtaatatgaactttttaaaatatgcttcttgaccacatgtatgtcttttgaatagtatctcttcatgtcctttgctgactttttaatgggatttttctttttttcttgagaagttgtttgagttccttatagatgttggatattagacctttgtctctcattctgtaggttgtctttttaccctgtttcttttgttgtgcagaagctcttaagtttaattaggcccatatgtcaggttttgcttttgttgtgattgcttttggcatcttagtcatgaaatccttgctcattcctatgtccagaatggtattgcctaggttgtcttccagggttttttatagttttgggttttacatttaagtctttaatccatcttgagttgatttttgtatatagtataagaaaagggtccagtttcaatcttgtgcatatggcttgccagttatcccagcatggtttattgaatagggagtcctttccccattgcttgtttttgtcacctttgtcgaagatcagatggtcgtaggtgtgtggccttatttctgggctctctgctatgttctgttggtctgtgtgtctgtttttgtatgagcaccatgctgttttggttactgcagccctgtattataatttgaagtcaagtagtgtgacacttccagctttgttgttttgcttaggattgccttggccatccaggctccttttttgttccatatgaattaaaaaaattttttttctagttatgtgaagaatgtcattggtggtttgataggaataacattgaatctgtaaattgctttgggcagtatggctaattaattgatattgagtcttcctatttgtgagcatggtatgtttttccatttgtttgtgtcatgtctgatttctttgagcagtgtaaaaccatgaaatttatagtagaaaatattggataaaatctttatgacctcagtgtagccagagatgtctcgggacacaaaaagctccagccatgaaacagtaattgaaaatgttgactttatcaaaatttaaaacttttcttcaaaagacagtgtgaagacaatgaaaaagcaaggcacagattgtgaaaaatattcacaatacatacacttgtattcagaatatataaagaactcttacaacccaatagtaagaagacaacccaataaacaaataggtaaaagatttgaacagatcttcacaaaagaagatatgtgaatcatcaacaaacatctgaaaagatgctcaacattgttagtaattagagaaatgcaaattaaaactacagtgacagtactgcatacccactagtattactaaatgtaaaaagactgaacataccaagtcttaaccaaaatatggaacaactggaactctcatacaccacttgtagaaatggaaaatggtataatcactttggaaaaaatgcgcccatttcttacagtgttaaacatagacttaccatatgaccatattaccagttctactcttaggtgtttatccaagaaaaatgaaaacacatgtccccaaaaaaactttattcataatagagaaaaactggaagcaacccatatatccctcaacgggcgaatggataaactcattgtgatgtatttgtgtaatgggatattacagaacaacaaaaagaaatgaactgctgataaaacaacgtggatgagtgtcagaaacattatggtgagcaaaagaagatgagccaggagaacatactatgtgattccatttatatgagttctagaaaaagaaaaaaaaaaactctaccgataaacagccaatcactggatactcaaggctgagcttcaagggaagctctgtacaaggctgtgcaaaaggggcacaagagaatcatttaaaatgttgaaaccttccctatcttgatcatggtgtttgttgcttaggcttatgcatttttcaaaacccattgtacactttaaatgagtgtgttttattatagataaattaaactgcaatataaagtgatttaaaatgcaaaaaaaaggaaactgaagtagaactggactctaagaaaaacttcagaacatcagattattttttatctaaaatatgtatgaaattggagtcaaagaacagaagaaaggttttaaaaaagaaaaggaagaattatgatgtcttcatttgaatcaaattcctactcactacagtttccaactacagtctgtatctcaatccactggatttttccattccaacagtgacctattgcttttgtcaagattcccaatagtcaagacattaagaaagtaattgatatttctaaaatgttaactgttaatgtgaccacaagaggactcagtgtgtctgccagagctgaagttattcctttagagaaaagtttgatctaagccaactcttatcccatgcctccaaatttcaataaagatatatttcaagcattcaggctctattacttaagctttttttgaagaacgtgaaggcttgtatgtgactcctcattctggtgcttctgactttagtcagtttagacagctccttgtcttttttctcccaccttggggtaaacttttaataacaatctagagtcagttactcctttctcatcctgtccttatctcttcaggcccgtggcactttttttttttttgagaggcgtggtggtgaggaacagaatcacggaatattagagtggaaaggtcattctctgagtcgttaaatccagttttgtcattttatagagaggagaactgaggcccagagaaggagagggactttcctaatatctcataactcttaggagtggaaaccagccccggccccttgcagccctgcactgtgtgggaacacagcctgcttctctctctgacttggcctctttggtggcaagagagagacatttttcatgtgttttcaaggacattgctgaagaacaaggaataaagggaccatgatgtatatgttgcaaaacatggatacttgaaagcagtcttcagtcactacctgcataaattactttgctaaccctttggggtgaaaattcctgtggcttgcacatttcagaagagtttgaggttttctttctttctttttctttgtttttctgaagctatgaatttgttttggaggagagacttttcactttagccttgctgcagggatttacagtaatcttttaaaaactatgctgaagagagagaagcctgtcataaatttgatctatttcctcagtcataactagggagagctcaccatctgaagctttgtaaaggtagagaccgggcttgttttccctcctggctgggttcgttgctaattgctgtactgttattaaaacaaagggctgatctataaatgccccagaactacacaactatacccaatcagggctgtaatcagaccacccgatgttttatggactcggtgtcttggcaatccagaggcacgccagtgggggcagtttctgctttgtctgctcattaaactttggacaccttttctttgttgctgggccagtcattcccacaatctgattggccagagttgatgctgtttgaaatgggcaaattttatacttactctgaaaaacgagcaataattccaaagagtatttgtttaaaagagcaaaagtcactgttaaatgagcagattgcctgaaaatagatttatctgaacgttctgagactaggaaaaaatttattgtggctgccaggtacaatattattcacatttcaagagagagaatgatgatattaataccttaccttaggtaactgcctttagcctttgcacagctccttagtatctgtgatttacatcctccaaatatccctatgaaggtgaaggttggggtgtgtgtgttagtgactacattgactacatataacatattaagatgtgagactttgaagtcattcattgattgattcatcagatatttttggagtacttcctatgtgtcagatactgtaataggcactagactagaacagaccacatgcacaaatgagcagaacagactaaaactccttgctgttacagaacctgtgttctagtggggtccacatgcctgtgtttacatgtgttgctgctagttgtgtgaccttgggcaagctacttattcctatcgagtttgttttctcgtgtgtaacatggtgttcataattgctgctgcataacattttgtgagaattaatgtgacaatgtatgtgcagtgcttagcacatagcaagtgctcatgaatggtagccaccaagatggctgttgtcattttagtttgcagcagttccacttgtcatcattgagttcccagggagtcccctcttctttgggaacagacttgctctctgttgctccattgcggtaaaaacagatgaggttaatccctgtcccaatcattttggagatggcgtcgtttgtattccaattccacagcccagttcttgtctttgtcttccttttatttaagcagcagccacacagaattagcccttttcaaaaataaataagattatcatcctgttttgcgtccctggggtaacagactctaacatttctttctctttctcttctttcagattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtaagcacttattgtttcctagagtcaggagtgtgctggttttttcttccaggtgggtttcagaatcactggtgctttgaggtgagttgctctgtgccagccaggggtcagcagatgaccatggcctccttcacagttgacaggacactttggcttgcactgtcacgttggatccccatgacagaatgacaggcagttattgtcattctgattttgtggacgaaagaatcttctcttgcagaaagacaaggtgaggtgttggggtgagaccttgggttcaggcctttaattccagtctatttttcctctctggcaacatgctgccatccacgcctccactcccaggcctgcccctctgaaagtggtgggtttgtggatgagggtgttggagtacttagctgcgtgcctttttttttttccccaaatggggagcatcagagggatggactcctggaaactctgattagatcctctactatcaggaactgtgctacccagctctgggggaagggatgaatgcttcttacctggtgacagggcacaggagtacctgccttgaaggctgttgtgagaactgagtgagataatggagggagagcccctaacaggatgtctggagcacagaggctctcagtgggtgagagagagagttttagccgttaggccctaccataccactcagtgccaggccccagtgtgcttctggctccaggcccccaggccaggttaaatcatacctgagttggaatagatgccctgtctgtgccctggccaacagctgcagcctcttatccttccataaggtgtttggggttgcctcactgggctctgcccctgataggactcctgtgttggggacttccatgggtagaagtcctaacacctttctgagggctggtgcgtctgagcaagaatatgggattgcagggtgtgcctgtttttcacaactcataaagccatcagaagaacacagatcacattttttgcctctccagaagttcttcatgaaatttttattaaatttgttggcacttagaatgcaccaaaaatcctctggaaaaaaaaatttccaaatttaacattttaaaatgtaggaagtggtgttttatgtgtacttgtttttccagatggttcatttattttcattgaaaaagatcagcacaagtcaaaaccacagaactgtgtggaatcaattgagaaaaacagaaataccttggaaatgactggctctgttaagtgtaacacgattaaatgagaagttcagtgagcaaacatgttcttccagatttagttgttatagcttaatctaatttcaaagtaaccacgacagctttttcccccaaagagcaaataacaggacagcctgtctatggtatgtgttgtgtgcagactttgggggctgtggctgtgtgcgtgtgtgcgtgcgagcttctggccagtgaaaaatccaagaactcacatagcattgtgtctgcttccttggctaatgaggtttttactaaactagtgcagtgctcctagatattgagaattagttttaaactgtatttcttcctttccccaacagacatcactgtttgaaatttgatagggagatttgtatgtaactctcccccaggtcagcagggaaaaatgtgagtctgagtcttgtatgaggacttttgagcttatatttttaaccacctaggtagggaacatcccagtctctcatcaaactcaaataggcttttgaagaaaaggatcagaggttgtcggatgtgctgtttctagtgctggttggcagccgtggcctgctgatttcttctctagtacttgaagttgttaaaaatgtccaggaatgtttgactgtttacacttatcttggaattgtttagtccctgctaaagagaatccagactgttctgtaagacataattttgtgtgcatgtgtgtatggaaatatatattcattcagtgaaaggtaaatttatttcacaaggtggtgaatcaggcatttgtggagttcttaagcacccacattaagagactgagggagaatgggcaggaaccgagaacccaccctggagaccaggccttctgacccctgtgttgacgtcccccattctctccacagccccgcgacctcagcactactgtgctgctcactgtttaacttcttaccttctctttccctgtccttccgtgttggacagggaaacatttatcaaagttcaagaccatcaaagtggaaaagaatcctaaagatcatctggtctacctgcatcttttagacaaggaaactgaggcctgttggaggtagtgactagtgtaagttctcacagctagtgagtagccagacagaaccagacccacgatctccacatttctgacccggtgttcttcccacttctgcctccttgactagagtcccatgagatccactgagatctaccgtacatgttgattatgtacaaaggagcggaatgcaataaagtatacatgttcacagtcggatacaactttatcatctcataaatgtgacaaatctgaaatacagtagttactctaaatgtaaaaaatattcacaaagcttactgccatggaatttagaagagctaactgctgggggttagttttgcatggcccattggtgtctcaagaaaaccaaaacaacgatagaaacctggccatggggattggaacgggtgtcgtcttttcctttccatgtgttccttgtaggaggtaaaaatattgaaaatcatcctaattgatcatttttgaaaaaaccatgtggacatttacatatccaaagatgtagcacccagagttttagttgtaatagaggttgtagcaaggcagggtcgtgctgagtctgaaatcctcttactgctcttccctcaccatcctctcccctgcctcctcctgtgctgcttatcacggtaaagatttgtcattattgctaagtcttctctttgcttgctgtattctggtttccgatgtaagcatctcagcttcttgcattctttctttcctgactatgtattgggaaagtgagatgatagcagaagatggaaagtttgaaggtggagagacaacagggaaggacagggaaggagaaggtaagaaggaaaagagtgagcagcacagtcgtgctgaggtcgtggggccatggagaggatgggggatgccaatgcaaggtcaggaggcctggtctccagggcaggttctggattcctgcccattctccctcagtctcttggttcctcacaaccaatcctaatcctgagtgctgcccccatccttcttttcatgacctctttttctgtcccttggcgggtagccttacccacactctggcactgagtatgactccatgggtagcttctattaggttggtgtgaacgtaattgcggtttttgccattgaaagtaatgggtctgagtctgaggatttcagactcagcaagaccctgtcttcctaagacctccatggcagcaaaagttttaaatgtaggaaataatcgtctctctctctctctctctcttttttttggagacgaagtcttgctctgtcacccagactggagttgcaacctccacctcccaggttcaagtgattcccccacctcagtctcccgagtagctgggactacaggcgcacaccgccacacccaactaatttttgtatttttggtagagatggggtttcatcatgttggccaggctggtctcgaactcctgacctcaagtgatccatctgcctcggcctcccaaagtgctgggattacaggcgtgagctacctcacaagggcagaagtaatcatttctcatgtgcctgtctctcaagaccacatttcagcttcaggacacgtctaccttaatgttacataataccaacatcatacttaacaaggctcaagtcagtctcaacctcccccttcccctcccacctccctcattcctggagaacctccctttggaatgcttagttttgttggggacactgggattttgcctcaagaccctggctcaaataactggtgtgctccataggtaccttcctctcattctgactcagttgctgagttctggtctcatcctgatcttcaccctcacctaccccagcattcttgaactacctctctgtgtgtctggcctgctgctgtcctgttggtctttctaaagcagctgccttttgctagtgatctaaagtttggcttcatgacctggattcaacacccacaaccctggctgcaatctacttttctttcgtgattttcttttccactaaccaccaatcaagactcaccaccctcaagcccatactgtgctactctcctctgtgcttttggtactctgttcttcttccctgaagttgcctctctcccatgcccacctgtggaaatccaccccacctggcctttgggctgtgcccagagagaagctgcctcaggaccctttcttcaccccattcatccctacttgtcacctgcatggaccttgggggactgaacaaaggatgatgaacatgggaataaagacaaagacaaaagagtatatttggaagaaggggtcagggggctccttgcttctagtgaacaagagccctgagcttcagagcctttcacattttactgggtaaaggagatagggagagaggggagttgttgtcggtcagcagcttgatttacagcagacttgcaagactgcattcttctaacaacaggctctagatgtcccagtagataacctcaatgagcacggtgccagggagtgattgccctcagcaaacctggcggtaggcacagtcgtgagtttgcccacatcctgcattcatgataaacagtttgctgtttgatcatatagcctccagtggaatgctgagttggtcacaatccctttggccttttcaactcccaacacctattaattttaactattgggatatttatatagcatctatgtgctaccccagggtagagttatttgtgtttaattctatgtctcctagaatataattttttgagggaaaacattttacataaaccgtcttcatattgctccaaagcaccaaaccttatgatttccacatggtagatgtttaagagattttgtcagatggatgaagaaatgcataaatgaatgatgaactttgacattgggcagtcccctccctaggccttagtttttccctctgtctagtgagggagtttgactagatgatccttaaggttccttttcagtctatctcacatccaggcttaatattaatgaaaagctttgaaatacctctttgaattttattactatgtgttctaagtaaaggaggcatggttaggaattatatatatgattcattggagtgccttcctggctcacaaacttatttttttttgtctttcctaggtttacaagttgtcctgaactccattataaaagccatggttcccctccttcacatagcccttttggtattatttgtaatcataatctatgctattataggattggaactttttattggaaaaatgcacaaaacatgtttttttgctgactcaggtgagtaatgagaattgtagctaacttaactttaaaatttttttgttttccccaaagcaactttcatggtttggggaaaatctaaaacaaaataggaaaaaaaatgcccaatataccagcacatttactgagccagttctcagtgtgagctatgttcagaatagatgagaattcagtctccctttccaccccgatttcctgtgtaatgtgtcctggcaaacaagataagagacctccaaagtaaaaacatgaggcaaaccaacagcattgtgctatctaagcctaaggaggatgctgtaagcgcaggtgcagaggaaaagaaccatggatgctgacaagaggaaatggcagattccgctaaggagggagcatttgaagggaaccttgaaggacaagcaggatcctgaggcaacgcagatggggcggtagggtgtcccgggctctggcaagggttctcaccttccgctggcttggatttcctgatgtttctgtcctgagcggtacagcctgtttgctctgtttgcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactgggtaagtaccctggggagagagtttatggagtgttctttgcttggataagtgggttttgtgagctagagccactggagaggtggctggaaaagaaaccctgaagtcagttatttgggaagggaagcagatgctgtctttaccagcagtcttcatcatcctgctcctcgagggccttagtttcagttgcaggaagctgctgcgcgatgttggcttctggctttagtcctctacttcccagtgctgcctgaagacctggtgccaagggtgcccagtggtcccctttggaggaactccaggaagccagggctatcctgattcaactcttaagagagccaaagggtcactttccaggtaaggaggctcctggactgccacaggctaaggttaatcatttatacatcaaggcaggttgctctactagatcctaaagggaagaaagggaatgtaaatcggatccctttcatgcttttcataactcagtataaccttaaacccagtgtgagtttctcccatgataatatttcccattctttagtattactataaatcatcccagcacaaaaccttagctgtcttcctttctatttgaagctacagacctctggcagaaagggtaggaatggcacgtagacttccagggctggtggacccatccagcctgccatgaaaacagttggacactctttcaaggcgagggtctgattcctcttgttcctgatagagccagaaagatttgctgtataaaaataagtgctatagcattttaacagccatttcccagggctgagtttgttagaatgcaaatgaaagctcacagaagtttagaaattgtttttcacggtataagagttgctggtaaagacagctaacatgtagattttgagcctaaatccaagtccaaaggggagtaaccaggattccaatcatgagttgttaaaaggaaattagtaataaagtagttctgaaatcagcagcttttagacagaaggcctgtaaattgataagtagcttctggtagtttctaaattttagatacttttcaggatttcctatactccataacttcaaagaatgtaacatataatggttataaataggtttttgctgcccttcagcagctcacaggattgtagatgtccctatatatttaatatgaggcaaagaagttatatttttatctttaatccccaaagtcagtctagtttgatcaggtttaagcatcaccaacatgttatatcttgtttttcctacttccctttctttttctgattgtcataggagtgtgagtgtgtgtgtgtgtgtatgcatgtgtgtgtgtgtgtgtatgcacatctgttatttatattcataaaacgtcttttcataaagaggaaggaggaaggagatgatattggctgagccaggggcatggcttctgtatgcaggagggccctcaggttaggtgaagcattcatttttgctattatttcctaaattgcaacttctagtcagattagttgagatctcaattccagtcttcccttgaagtttttcataaatagaaaaagcatcatcaaaatagcccaaactgatacttcccctccccaaacagtacataaaacaacattttgatttttttaaaaatcaaaatctgtgactcttctcagctttgtttttctctctattgacatggtgaattgtcagctgcagagccaacatgccttgactgatgaaaaattttatactttatgttatattccttcacatcgattctcagaattttcctgttgccaagcaagtgtaaaacctgggagtagatgattaaaggagagggaacttcaggctcctagaagcaaaagtttccgcttactttcctgagaaggtttaaatatcatctaggatgatataattattatttttattattaatatgacaatcacgtggttaatactttgacagtataattgcactctccataaattacacagcatctttattctggtggggatctcaagccattcataaactttatcccagtctgtatccctttatagaaggtctgggatcttgaagatggagacagtggcgtagagaccatggaacattccccgagttctacagcaaatggttgtggtccttgatctagaacagtggtctataaaccttttcataagggggcaaatagaaaatgtatttggccttgcaggctacatggtcacctcagcaactgttcagcccttccactatagctaggaagcagccatgggcaatacataagcaaatggatgtggctttattctaatcagacttcatttatggaccctggaatttgaattttgtatgatttttctgtgtcatgaaatattttgcttttgattttttcccccaccaactatttcaaattgtaaaaatcatttttagcttgaggccatataaaagcatacagcaagctagatttggtctgcaggtcatgctgtgggaccccctggcctagactagaacccagcactctttccttggcattcttccacctgtcagcagttgatgaatccttccagaacactagggggcagctaagtaatgtcttcccgactgttctctaagattttactctctgaaacacatcaggattgtttttaattacctgttgattgcatttattagctcatcatagagataggcaggggccaaggaaccaagccttcctaatatttcatgggccacagtcagctggaagccacaccgctgtgatacacagcagaacatccctgcccagcatggtgcctggcaccgagcaggcactcaataaacacaagggatggtcatcatccttcaagtgtaccaggcatattgcctcattagtgtagatgtgccatgtttgaatatctatttttatccacaactagggcataaaggggacatcttgggagataaaaagagattagattttaaatattgactacaagcacatttctgaatcctttaggcacttacatatggtggacaaagtctttgcgggtcattgttttgcatctagtcaagtttatattcagtcagcgttctcaagctcatttatgccttgcttctcactagtgtctggaaaatgtctggcagggtcttgagaagggaagtaaaggtgggtccaatatgtagaaaggcacacttagaacaggactatttggatgtgtgggaagtgggatcattaagttctggtggaaagaaacctatggtagagttctttgataaagtgagttccataaatataattgagctgttgtttgactcacatgtgagtgtttgttgctcacagaggcagtagggtgtagggcagggaaagagtgtttatttagcctggttgtgtgaccttgagtagttcatggaacctctctgggcttctcaagatgcagaaataaacttacatgatttaatttttcccttcaacttagaggaaattttttttccttcaattcaaagaaattgtttttaaatgcaggaaataaaaagtattggtttcaggagacagctatccagataaataatttcggtgtcttgtcttagcaccaagctcttttctcagtgcacactcctacggaggtgctggctgtcagaccttcacgggaagtactcatggtcaagctgacagtctccttcattcagggcacctaggaaatctctctgtaaccagccgagggcttgcctttttcttattgcatgctctggggtgttaaaaccagtataccaagtttccagaagtgttttcagcagctagaaaaacagccttgcattggtctataacttgagacatgaatatgcatttcaaccttttatttttattttttacatttttttgagacggagttttgctctgttgcccaggctggagtgcaatggcgtgatcttggctcactgcaacctctgcctccggggttcaagcgattctcgtgcctcagcctcccaagtagctgggattacaggtccttgctaccacgcccagctaatttttgtatttttagtagagacgggtttcaccatgttggccaggctggtctcgaactcccaaactcagggtgatccacctgccttggcctcccaaagtgttgggattgcaggcgtgagctgctgcacccggcccatttcagccttctaaaagaaggaaaactgaagctaaaaagaaaattatttcctgggcaccagatgacaccccttgatgactttgatataagttttttaaaaattagtctaaattgaagtccttcagtggaagccagtttcttcattgttgataaagaccatacaggcaaaatcccaagcagtctctattttcacgtgggtatttttgggaacagcttgcatgttctgatttttcttttgtatatggtaagatccaagaaatgcttggctctgaaaagggacttggattgagaagggttcaatgggagcaagaccgttctcagagccgaagcttgtctctcttgccccaccttctgacttagagatttggaatctccagtggactgtattcatctccagccttcccctccaggcctcaactgtcattccaagtgatacttctgatttgagcaaatgtgaatctgatgaacacctactcccaagaaattaaaagggttttaaattttttaaaggaaaattttccctcccaagtagagaagacagctgttactagagccattctctggaacaccagactgaggcctgaaggagggttggtgaagcagatggctcagcagatgacggttgctagggtcatggaagagtgaggtttcctgatgggagccctggacctgtctgccctcccgtcaccttgttgggcaccttctcccctgctgcatgcacctctgttccaacacagagggaaacaagcccaggtggggctctgtctcaggtgctgacccaggccaggcacaggccaccacaccaggcagccagttccttcttcatatatgggtttttcagtaagtttagtggtatagttgctctggatgaattaccctctgccttcctgctgaaattagtttatccaacttaattagatcaacaattgcagccacagcccaggctcattcattactctaattgccaatgtaagatgtgcagactgatatgagttctattaagcacatcaattttcatgtggccaaacaggtgtttcataagggatttaatgccctctccctagacttcagcaacagatgttaggtaattttttttaatgttcactttccctatttggcttctcgaggcaaacattgtgaaatgcacgagcctcattctgtaaagttaaaacctggagccagatcatatgcaggaaagcacatgcttaacaccctaagggcttgcacctgcaaggcaagagcgatggctctatccagactgtttgcagttctcattggctgaaaattctgggtgttgtggcagggtcataccttgggccatccattctgtcccctgactggttcttaacacctccttcctgggaaaggtgttttgctgaatttaacattgacctgtgctgctggaaagttccatccagctgtgatccttaaagccctgtttgctctagcttcctttggccaggtctgccagggagactgtgtctgaatgtgcagcatgagcttgtccgggaataggggaatggggttcctcaggccacaccctttcacctctaaacccagtcagctcacagctggagccagtctcccaggggggtcatctagatcaaagctaagtgtggagaataagggctgcttctcctttctgtgggtgcagctaagaaaaagcccattccccaaagagcccgtggcttgtgtcagctagttgaccttgaaaaaatttctttttcacattcattttgctgcattcattttgtttgcactcacaggttgcagataatccagatctaaggtgggtttggtttccttgggtaggttggtttccagtagaagattattttaggagtttttaaaaagagtttatagagtcagatggtacaagtttgtctctataattaagacttttccaccatcacaaactttaaacacaaagtctaaaatcttgggcagcatagaaaataggttctagctaagcaggagttttgtcctctaccaagacctttcctgaaaatcacttatcaagacagtttcctgtaagaaaaagccatatcccagctgattttccttcctggggccaaaatctgctattattcggcctgaaagccttgatgactctgtgtgtgtgtgtgtgtgtgtgtgtgtgtgtgtgtgtgtgtgtgtgtgtgtatggatgcttgtgtgtgtgtatggggaatatgtgattaatgtgtgttggctgctgttgtctctgatttggctactgttgtttctgatttaaatctaagtaaatgtttaattaaatgtatagaatgctgtctctaatgtgaccctctctccttattaaatcctcttattaacccactcctatgagaccatcttatttcttgcagatgaatgatgctatgggatttgaattgccctgggtgtattttgtcagtctcgtcatctttgggtcatttttcgtactaaatcttgtacttggtgtattgagcgggtaagctacacctctttcatcttgaaagcagagtcctgaggacagttgccaagaccacacaagctttgctggatgagggccgccaagaggggttgccagacattttatgtgtcctctgagatgctttcttttctgctgaggcttcccaaatcaagctgtttcctggaacctcaccaggcttcatgaaggagaactatagaacgattattgaccagaaattaatcagcattgttgcttgagatttaaacaatttccatagcatgccctttttttgtctgttctaaagtgagatacatttataattgctttatttgtctggatccaaatataatgcagattaattgttataaaacgatagcaaaatgagctggattgggtgggcttttggtagtccccatttgtagatttcagccgctgagcttgtccttatttgcagaaaaaaaaaaaaaagggaaggacctaggcccagtccctgtcctaggagcactaaccttcagcaaagcactgagaggtttggcagctgcaactggggctctgctctttagtaaatggataactgataactgatctccttacattttacaggtaaatgatgcgataggatgggaatggccatgggtgtattttgttagtctgatcatccttggctcatttttcgtccttaacctggttcttggtgtccttagtgggtaagcagtcggatccgtgttgcaccttctcctgctgccacgtgtgaggcaactctgcgtgtctcctagctgctccctgacagcttctctgcatgtgtttggactctgatgtcctctcagtgtgttgcttttggattgaactgtgattctttctgcctgtatctgtctgtgagattccgtgtttccaatgcttgccaaacactgttaatttaatgaaaacgttcccccaaagccagttgtgttagtatgtgaacgtgtagaggtggattacaagtgagttaaaggaattccagccttggtctcccccaggaaagaggcttttgtcccttgtcattttgtgtctattagtacataactccttgtcgttttgtgtctattagtacataacctggcccctttaggtcaccacagtgcattataaatacttccaggggagttttagattttactgtgaaggagaaataagcctcaagcacataaatactggacagtttcaaaatcttccttagattgggattctttattagcttggtgttctagtgctgtcattgtgagaactgtccctgtgattcagttttaaccgaaacttacagaatccttctcttaatgcagagtgatgatcgacttttgtgcacacatttcccatggccttacagagaccccgtcattcagtcacgatttttgaagtttgcttgtttatcacttcctctctatggattgactctccataaagagggtgcaacagattctggcctggaaagggaactccttatgttgcaggctctgccttgcccgtagctggagatgccatcccagaacccttgtgggcagccctgcatccacaccgcctctcagacacccccagaaggtggggtgctacagagaagggagctgggggctgtatggctctctcacaatcagctccttcatacagccattgccgggttgtggggggcaggcaggataccaggaggccaagaggggcccacgtctcccagaggagcctctgtcactgcgctgcgcccaggcaccctcaggaagtagtgttgatggatttgattccaggcaagtttatctcctcctcactcactttatcttgctctttccgaggctgtatctcggggaagtgatgtcttcatgtatgctgagttagtgaaaggctttaatcgcatttttggaaacactgccttttccagagcagaaagcagagtgcgtttatccatctcggcttcctttctgcatcttcccctaaacctgccctggattgaatgtagtcagttccacaccagggacgcatactgtcacaggaagtccctatgtagagttggcccaggggccagtgcccgccagagagaggagtgggggctgagcctgggatggggccacataaccctcccctgcctgagccgcctcctgtagatgagtggctcctcaagcctccggcccttccacctcaacgtgagaagtgtctctctcctagtaaacctcagtggccttaggctagggttggacatgtgagggtggtgtctattcctggagaaataacatcgcatttgattttgccacaggagctttctatacaaggttaacagcaatcctgttgtgaattccttggcgcctcatgtctcctaaacccagctaaactgacggaggccatggaaaccactaattttaacagtgccggtgacatcccttatcttttagctttcccaggcaggaaccgttgccccagcagacatgatgaagtagaggcaggagccagatcgtgaggtgcttaaaaaaagaaaagagaaaaagatgggcgggggggcttcccactatcacaaatggggattaaacctgcaactccgtgggaggtacccaaagctggaggataaaaaaggtacactccttcatggaacaaccagtttactgaaatatattttggggggaaataatttttttaaaaaatattttttcatcaaaacaaaacttagatccctgatggaggagactggaaatgacacatgaaattataaaagaaaacccgagacttctctgcgatttttaactgtcagtgcgggctgtgctcaaacccctagaggctgcacatgacctcctctctactcccccagaaggcctccggtagggctggtttgggtaaaggcagaaccatgtctgcaaagcacagcctcgcagctttgttcctgatttggccagtatttcctgagatcctgtagagtgcccggctctggtccagaggcgaggggtgccaggatgtctcagacacagacagcggccttgtgcttaggcgttcattatctcatggggtagcccattttgaagcagtgcagaagggcacatattcagtagaggtgcagacccagaggctctgtgagctgcactagagagatgaggaggcatctcccccggcgactgacgatgggctggcatgcctccacctccgcccctccgccccctcgccctcccaaccaccaccttccctctctgcctgctactcccctcttactttcccattgatatttttgttgttgtttaagcaaattattattatttttttaaattttagcctcaagagtcttcataattttttaagggaacactagaggtactgcaaaaccagaaggatataaatgttgagaggaagacaatttgtgttgcatagaccctgagggactgtcagaccaacacaaatgtaatccgctaagcactgaattaaaacgccctcattttagaaaggctggtcgagaccatgtgattgccttctcacgaggaaatgttagatggtgctgtatgtcttcaagtctgtcagccatttggaaatacctgtatctgtttttgctccttggctccgtcatgtgtgtggccatgccatcctattgtattcttgaacagactttaatctgcacattggatttggtgtttatttgtaaagtgttgtaacactgatgctttgggaaaatctttggttttataacagtcttttttccctcaaggtaagtatgaagtttatgaactgtaaaccctatgcagccatgcatgaatatagatgaatacttccatctctgatcacagtgctctgtgggaggggctgagaatgtctatgtctaatgttgcaatttaaccttaagttgtcattgaggatatgctcccattatgaccaggaattggaaagaatgtcttctttaagtctgcaattcagacatattacacgtggtcttctagaagtttggcaatttttcacttttcaaattgttaattgaactcccttttgaggttttcatctttagaatcatgctagattcccagggggaccatgggggtcatgggtggtaggctggttggctctgcctccttctccatttcagggcccacctgccaccagccatccctatggtggcagtgtctgagcttgcaagatgggggacgccctaggctcccaggatgtggctccaacccccaggaagggggctggaagacttgggttccgtcctgctggagtcccgcgttcactctgggacttcactgagttaccctgagcctcggtctctttgtccttcaggatatcagcgacatcctgtcttgccgtctcccacacagggtggttttcaatcagctaatgactgtagaagtgcttctaaaaatacataaagggtttttctaatttaacatatccttatcttaaatccgtggatatcccccactcccctcactgggttaggtgggaagggtgcagggtactctttggaaattctggagtgtagcattttctggatttcccagcaggtggccacactttacacacacatcaacgttgtactcaatgtcacccaagaggtggctctggagaatgtggaagcactgtgtcagctgcaaagtattacgcaggtctaagtcattgttattatatatttgacaatgtttttttgcacaaattgaggggaacggcatttctattacatagtggttaagcacaccagctttagaatcagacaaccaagtcttgaatgtttgttctaccttttccagttgtgagatttggggcaagttacttacctctttgagccttactttcctcatctgtgaaatggagctcatcacagtagcagcttcgtgaagttcagtgaggactcagtgagctgaagaatgtagagggcttggcctattgaaattatgacagttcaggaagggtgcatctcttcctggatttgatgcaagaaaagaatcgaatcaattcagtcctttcaaactaattaataatagctggccaagataggtctgtgttagtgaaaagcccaagttatatttttaaaatgttttattatatatataatgacataagctactgctgactaaaggatattactacataaaccccctcctgggcttgctttaaagaatagatcaaaatcatttataattcgcttatgaattcaaacctttggttttggcaacaacttatgaaaaatatttgaaatactttgttaagtagatcttgtatgttgttagacaataaatattgttattaaacccactcttatgacataaaattgaatgtaaacccagcccaggtctataaattcaaaatcataccaattaatttgtattcttggtgttctagtaagttccagatcctaccagatcacaggtatcattttaaatcaatccaattttgtattactataggcctatttatctttagaagtttaagggaacatggatgaagcgaagcattatagaaaactgaaggcaattttcaaactagtttatgtttttgaatctcgcctcctacatcccattctggctaattggataccaggggcctagacaaagactcaggcatggctacttttaggaagctttggtttcctaaggcaaagattcatgggatggagaatgtgaagagggaaggtggtgctggtgccggtgtactgtggactgactataccagaattttacatagtggaatcaggtttggtccatttaaattcatactagtaatagccagacaatctctgatttcttctacttgaatggtggctcaagaggcaaaacacaccaatagatagtagttgtattacttgtgaatattttctaagtggagacatatcctctgggaataggcattcttatacatttttcatgactgagattagatttttctctcatttggccaggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaatcacttgaaccagggaggtggagattgcagtgagccaagactgcaccattgcattccagcctgggtgacaagagcaaaactccatctcaaaaaaaaaaaaaaaaaaaaaaaaaaaaaaaaaaagacttttctctcattcaacactttaccagcatctactgacagaaaatggacaattgaatttcctccaatatatatacctctgatatgtctgctttgtaaaagagtagtgtaattgcttacaacattgaaaaggttgttattggggtcctggggtagccaggatatcggcatgatttgtcaccatattcagaataaaactgtactgcaatagtgagttaattccatatcttggccaacagagaatttttggccagtggctactaaggcacacggaagtccagtctaaaagggacaggggaggactctttgtagatagttcttatgattaaaaaataacttcctatgtgttgtagtgatgattaagctgacagaatgctaaagacacccttaatgattacttgtagcaaagtacttccccacatttagctggatttgtctttggtttgaagaggctaatacgtgaaagatttgttcacagttggatgtccccttttctgaaccatgaagtaatattgtgaatggagttgaatgctgaggttagggtgccggaaagattcagggtccttcggtaccctcacatggcttggctttggtagaacaagaaactaagctctgatttggctttaaatgagagtgctaaatttcctttttctaataaagaacctagctaaacatttatatatacttttgaacactgaactttcttgttgcagagttaacagctgttgggggtagctgacagctggatcctggtgctgttggtaccatggtacctgaagtgcacaggctggtagccacacctgacattaacaagtgagtggtaacctctctgccgctggcttacagctactgtttccatagaaatggctgtcgggatcagtggaaacgaggtaagtgaaagttttcgctgatccttgtttccatcaagctgacgtctgtttccctggcaacagcagtggacagcagccaggcgctagcaacagattcagtagagctctcacttgtcagctgtggctatcatctgttcctgaccaagttctttttttttttttaataatgtacagaaagacctctgaggacccaggaggcacctctggccacatgtgccctcctggatgctcgttttgcagatggagagctgtgtgctgagttgacttctctgtccgcagttccccctccacctgtgctctgggttgttgatgtgcaggttagaagagggaggttgttgagggtattagtgttgcaggggaggctgttgaatctgttgatcccaaatcctaggggaagagaattcattacagtgctttcatgcacagacccagctctttataaagctgttgctaccttaatagttgaaattaaagccataattttcctgtggtccctattcaattggaggcattaacaattgccattacttttacaatgaaaaggatatttaggagtttaataatttggcttgtgagaaacaaattgatgattgtctctaagatgctactgtcaacattatgctttttttctcttttgtgtaatattcttttacaggatggtaaaattgcttttacagagatcaaatattggtattgcagggcagcttggtatacaaagaccagtagatctatagtgtagggaactcttccttgttaaagttcaacagctccttttctggatttcattttaatgtttcaacagatggatgcacccaagccctagccctaagtattctccacccatatgagacagcattgatggtgccacagagcaaaggagagccactgttcctgccctggtgtgtgagatgagaggcatggaatgaggtgttggttttaagcccttactgataccatttattaaagagattttctctggaaaaaacaaaacagctttgatattcagagctgtatttttgagactcaaatgaacataaagatccacggtcttatgagaacttagatcggctgctagaagagcattggagaaccatggagttttgtctttggagggctttccggatgacattgttccacagctctctggaaatagggcaactgtgcttggcctgcaggcagttgaatttgatataacagacgaataagaagcagaaaatcctgctggatccttttttctccctctctcttaacttcctaagaatgacttattcatttaatgaattttttttcagttcctacacagtggtagatgtatgccaagtgccctgctaggcactggggttacagtggtggaatgtaggcactgggtaggcaccaggattacagtggtgggatgtaggcaccagggttacggtggtgggatgtaggcaccgtgtaggcactgcagtgacagtgtggaatgaaatggtttctttcttcgtgaagcttatatctaatgatggaggccaaaatgacaattacaaactcgtataaatgctttgaaagaaaggttcatgtgctgtgagagggtttaacaggcacaactgctgtcagtttattgggtaggagcatcctggaagtgaagaatgagtagtccacatatccaggcaaggtgggacaagaagctagggcaagggtattctagtcaagggaaaacccacagaaaggaggtacagtaggaaggagcagaggatgctggaggaactgaacgaagctagggtgacaggaactgggagagctggagatgaagtcagatgaaaggaaagagactggccggcagaatccaggtcacgtaggacctttagactatgtcacaggttttggtcattagctgaagggtaagagaatgcatggatgaattttaagcagggagtgatattcaaatttacattttctaaaaattatgctgtattctcatatcctcaacttaccttaaaatgcttcaaaaagataagatgattaatagatggatagggggatgcagagataggtgataaagaaaatgtagcagctgggtgctgtggcttgcacctgtaatccgagcaattcagaagggtgaggtggaagggttgcttgaggccgggagtttgaaaccagcctgggcgacatagcgaggctttgtctctggtacaaaaaaaaaaaaaaaaaaaaaaaaaaaaacagaagtctttttagctgggcaatgtggtgtgtgcctatagtcccagctactcaggaggctgagacaggaggatcgcttgagcctaggagtttgaggttgcagtgagctatgatcatgcttctgcactccagcctggggagcagagtgagaccctgtcttaaaaaaaaaaaagaagaagaagaaaaggtagcaggtgttaattatggaatctaggtgaggtaggcatatgggtgttcattgtataattgtttctacttttatggatgtttgaaattcttcctaataaaatgttgggaaaatctgcatatgaaaatcactgtggctgcagtaatatgaatagattggatggatacacaaatggatgtagagagaccaacttaaggctcatataatctgcttccagccacaacatactagtgctaccagactggacctttcaccataaacaactacaaaagactgggcaaaaaataggaagcaactattttcagaaaatggaaataggatatacaggattgcaatccctacgagaagggaaacacatgaggtaaactccgcaattgtcctggctttctgcctggagacagttttagaattatggcagagagggagagcccagcagagaacgatggtctatttgctgaggggtcaaagaacagtgttcagggctgctaagatagctgggattttcagggcagagtatgggtgagaagtatgcagagaaggggctccagtactcagagtggaggttctttgaaatctgaccatatactaagctgcttctgtgccaggtgatacttattgaagccaggcagagaacagctagtagaatgctgtaagtggttggaaatctctccatgctgggaggtatatggttctgctcagctgtagtggaaggacctaattgaatacattgggtactgagacttcagaaacgccaggctttagggttggagctactttagcccttgagtaagcctactgtagacctgacttaaaaagcatagaaacaagcttcaaaaggatcagggaaatggccaataaattaaacacctgtcaaaaagacaaaaatcaacactcgttaaaggaagagaccaaaactcagatgttcccagaatgtttttcctcatgacccaaaactataagacatgaaaagaagcaggaaaatattcacgatcaaggagggaaaagtcgatagaaacaaaagatgacagatgttgcaattaataatcaaagactttgaagtcactactatgagcctgtttaaggaactgaaggaaaagatggacataataaaagaataggtaaatctcagtaggtaaatagaaacagtacaatatctgaaaaaagtagactggacattgcagaaaaagttggtgagggcttagtgatctctaaaacaacaataagcaatctggtgtatatgaaattggagtcacaggagaataaagagattgaggaagaaaaattttaagataaataaagctgaacatgttgcaagtattgaaaactaagttaacagatccaaaaggcccaacaaacctcaagcaggggaaacacaaagggaaccactgctaagcacatcaaatttagatggctgaaagtaaaagatccagagaattttaacagaaagcaaatgggaaagggcacattacatactaggagaaaataataagaatatgcatttacttgtttgcagatatagtgcaagttgtagggcaatgggtgacatcttcaaagaggtaaaaggaaaaacgattctgtatgaagcaagaatacccttcacaaaagaaggaagtagaaaaactttcaggtaaacaaaatctaagaattggtcaccaacaaatttgcactctaagaaatgttaaaggaggttcttcaggctagaagaaaataataccagatagaaacgttaaatgtccgctttaaaaacgaggagcatggccgggcacggtggcttacacctctaatcccagcactttgggaggctgaggcaggcagatcacctgaggtggggagtttgagactagcctgaccaacatggagaaaccccgtctctactaaaaatacaaaaaattagctgagagtggtggcgcatgcctgtggtcccagctactctggaggctgaggcaggagaatcgcttgaacctgggaggtggaggtcgtggtgagctgaggtcacgccactgcactccagcctgggcaacaagagtgaaactctgtcaaaaaaaaaaaaaaaaaaaaaaagcatcaaaatggcaaacaaagataaaagattttttctcatttctaaattttctaaaagataatttaaagtaagcacaaggtattatgggaactgtaacaggtcaaagtaaattataggataaccatacacagaagatagaaggaagttaaatggagcttcactgtgataaagttactacattttgaaataatatgaattcatggtagactgagaacttaaggatgcatatgataatctccagagtaatgacttaaaaggggtactaaaaagctaaaagaagagataaaatggaatattaaatagtactaaattatccaaaataagtcagaaaaggaagaaaaaggaacaaagaacatatagtaccaacaacgagatggtagacaaacccagtaatatcaataattgcattggatgaaaatgtacacaacattttagttaaaagatagaaattgtcagactaaataaaaatttaagatgctataaagacatggattaaaaataaaaaatggatgaactgtactaatccacacaagttggactttagtataaggaacatttccagaaatagggacatttcagaaatagacattttattctcataaaaaggtcaattcactgagaagacacaatgatcctaaatgtgttggcacctaaatacagcttgagagtacatgaagcaaaagttgttaaaattaagtggagaaattgataaatctagaaacatagatgaaaatttgtatcattccttctcaataattactaggttaaaaacagcaaatatagataatatctagattatatttagattggttaataaattcagccaacttgacctaattgatatttataaaatactgtgttcaataattgcggaatacacattcttttcagagcacgtggaacattcaccgacatagaccatatcttggccatgaaagtctcattacctctcgattgaaattttacaaagtatctttgttctaatggcagtagatttaaaacagaagccaataacaggctgtttataaaccttcccaaatgtttggaaattaaataacctataactcaaaaaataataaaaattagaaaatactttgaaactgataaaatccaactgggaaattgtatgatccgttgaatgcagtgcttggagggacatttatagctatatcagtaaggaagaaaggtttaaactcagtagttctacatttccatctactaatctagaaaaagaagaccaaataagtccaaggtaagtagaaaaaagaataacagaagtaaataaaatagaaaacacaaattataaagttatttagaaagcgtaataaaaattgataaatctctaacaaaactaatcaaaaaaggaaaaagagcaaattaccagttttataaatgaaagaggagataccacagatattacagacattaaaataataagagaataaacttggtaacttaggagaaacaggcaaattccttgaaatacacagcctaccaagaaataaattgggagagtcctatatttgcctttttaaatggaattcagaatcgcaaacagaatcgcaaacagaatcttctctcaatcttctctcaaagaaaattagaagcctagatgaggtcaaaagtgaattatgtcagccgatttagaaaaaaattataccatccctagaaattctttcaggtagtaaagttggagggagcatttcccaactcatgaggccaaaatctcaataccaaaactttacaaagacataataagcacagtgtccttcattaatttggacacaaaaattctcaaatattagcaaatagaatatagcaggatgaaaggaataatatctcatggccaagtgggatttatgccagaaataagttgattcaccattggaaaatcaaataatttaccatattaatagaatgaaagaggaaatcatacgatcacctcagtaaatgcagacattactaacaatattctataatgatttctaataactctcagcaaactaagaatatgcaaaaacttcctcagcctgaaaaaaaaactatagctgacaacatacttattggtgaaagactcaatcttttcttcttaagattaggaacaaagtaaccatttttctatcttcttttattcaatgttttattgaaagtctgaaggtaagacaaagagataaaaggcagaaagattggaaagaaagaaaaaactatttctatttacagacataattgtctacatagaaagtcccaataattgaaccaaaaacctgctagaattaataaatgagtatagcagggtgacaggatacaaagtcagtatacaaaattccattttattcctgtatacaagctgcaggtgttgaaaatgaaattttaaaaaattaccatcaaaaattatttacaatagcattcctaataggaatgaatataagaaaagatatggaagacctctacactgaaaactacaaaacactgattagtaaaattacaatgatctaaataaatgaagatataccatgcccatggattgaaagactcaatattgttaagatgtccatttttctctatgcattgaatgttgtcccatttataaatctcaatagcctttcttttagaaactgacaagcttattctaaaactaatatataattgcaaatgacctctaatgaaaacaatcataaaaaataaagaaggagggcttatactgctgatttcaaaatttactgtaaagctgtaataaatacaatgtttgacataaagatagatgactagaataactgaatggaataacaaattcagaaattcctttatatgttcaattgctttttgataaaggtgctagataattcagtggagaaaggatactctttttagttaaaaaaaaaaaaataagctggagaaactgggtatctgcaaaaagtgtgatgctcaggtcataccagacacaaacattaaacttgaaatcgatcatagatctaattaaaaagctaaacatataaatattttctaaatagatttctgctcttcaaagactagaaatttaaagggaaaccacactgggagaaaatacaacacttacatctgtgtatctagaatatgtgaagaactcttaacaactagataatagatgagcaactcaaaaattggcaaaacatactttacacaagaatgtatatgagtagccagtaagtacacattaaagatgttctatgtcataaaccatcagggaagtacaagttaagaaactgctacatagatagtacaatagctaaaatcaaaaagactatttccaagtgtcaccaagagtacagagcaactgatatgctcatacattgtttatagaaacataaaatgatacaactactttagcaaagtttgtcagtatctcataaagttaaacatatactcaccatatggccaagcaattccatttctagtatttgcccaagagaaatgaaaatctatgtctacaaaatgactagtacatgagcactcatagagccttattcatagtagcccctgtggggctgttggaagcttcagtctccacagactcggccttgggtggaggtccgcccagctggggtgaggcagtgatctggctgcgagctgtgccaccctggcctgtggggtctctgctggctgagggattactggtttctctgttgtagtgaggggagcacaaaggcaggggtcagaagtgctggcccgtgtgcttgctctgtacttacagaggcatgacttctttggtcagtatacttcacgtttccaaatcaaggctttttcttcctaaaattggagcgccccatctctgacttttctcacagagccatcctaataaccaaggagagaaatggatgggaagggcctggataaacgggaagacctttccaagtatgtgggagctccacactggcctggttgtgtcctcctcctcggaggtcatttctgtgagctggaaaagtcatctcatttgcagtctggatgtttatctgcacttctctccagggcctcacatccttccaagacctggagcggcacttggcgcattagcctgatttctctaagtctgactgtcatgagtttggttttgggttcagggataaaacattaatccacagtgaacccatcattccttcgaatttctgctttaaaataaatcttggtttaagttgcctgctggcagttttgggcctctgagtcttggagacccttgctgtgtctgaaggattttaagtcagtgggtgagagtacaccacctgctgagaggtgtactgtccccagaggcccacctgtccttaaatcatggactattacttacaaacaggcccacagacacatgccaagaattccagggcccagtgtagattccagcagctgcactctgtccccctttggctatcagtcaaggatgtttcagcgtcaaacctgtacctatcagtatgccctaggagcacagcagagggttggcaagtcagagggcctcacccaaggaagctgggctccagttgggcattgaaggatggacaggattcgttaggatggtaaagaaaggaagcaagttgtcaggagagtgggacctggtgcctcctgcctgtcggaaccagtgagtgcaatggtgaggctgccagggtgctccgtgctggctggtgagcagtgggcagagcagatgtgcagttgggaatacccactgagagaggcagggtttttttttttttctttaagctgcgggagctgtcagagtgtttgaaataaggtgatggttgacagctgtgcctggaaggtaaagctgccacctcccagagtgcagtggagttaggagagcctgggggctgggggctgggggctgcagggatggggtctgcatggaggtgcagaggtggagatggaagtgaaggtatagatgtgggagtttgttgtggctcgtgcctctcagataagaagaggtctctggattttgattgtcaagtctggggatgtggattgtatgagagaatttttcttttttcttttctttttaaaaatattttttatagagacaggtcttgctctgtcacccaggcagcagtgcaatggtgcgattgtagctcattgcagcctcaaatttctgggctcaagcaatcctcccacttcaccctcccaagtagctgggactacaggcatatgccaccatgcccagctaattttaaaactattttttgtagaaacaggatctctctatgttgcctggctggtctcaggttctggcctcaagctatcctcctgccttggcttctcaaagccctggaattacaggtatgagccactgcacccggctagatttttttttaattgcttataatcctgtgctttattcagtttattttaatcatctccactactttgatgaggtaagtgttctttgcctcagtttacagatgaggaaatcaagactcagggaggtttatcaattttctcaaaatttacacagctagtaagtagttaaactaggaattaaatctagatctgtctgtctccagagcccaagctgcttttctcgtcagttggaagctggttctaagtctggtgagaggaaacccgctgtgggaccctgtcttcccagcctgggtctgtgctcgtacatcctcagctgctgtattctcaaagctctatgctttgtcgtttttgtttttgttttctcttcctgaaattaattacccaatgctgagtggaacaatgggatacagaggcttcagagaaattggtttagttttcctcttgaatctgcttttggacaagtctcatttgagctcaggtggtccttttgggtcctgttgctggagggtggatctctcagtctctgagcccagccctggggtgtggtgctctgccccttgttctccgtcagccaagtctgggtgctctgggaaggtacttcccacccaccgtgcctttcagtgggcactccccctgcggggggatcttctctatccctctcctctctagatgcagctcacagggtggtttccgtggcctgcgagtgggatttgggctgaatttcctacagtgactgctttagggatatgccagtagggggttcaatttcagccccttccttgggtccacagtgctcctccacagtgggaacccctagcagctctgaacagcagatccagcctcgagcttattctggcagtgtaaccaggcccttcacacagcaaactgtagtgacatgtcagtagcacatgccctgcggttgctggtgccttcaaaagtgttcattttaggtggttctgccaccctcccaagccagacttcatgtgcacatcttccttattttttcttgaaaaactggaatctgacaagtctagcagagtgtgtttatgaagtgacttcttaagtagcagtatttgaaacctgtcatgaagatatgtgatgatattggtttggctcatgtgattaagtgatctgtttcgttcagagagagtgatggcagaaaagagagcccatggttttgaagaatacctctttttttttttttgggggggagatggagtcttgctcttggagtacaatggcgcgatctcagctcactgcaacttccgcctcctgggttcaagagattctcctgcctcagcctcccaagtagttgggattacaggtgcacaccactacgcctggctaatttttgtatttttagtagaaatggggtttccctatgttggccaggctggtgttgagctcctgacctcaggtgatctgcccgtctcggcctcccaattgaagaatacctcttaaaacatgtttaagttttaaaaagattgaaacaaagtctgtaacttttagcatgcaaccttcatggattctcatcattgggaaaaattttctactggaagcattggcatgtcttttgtagccatggaaactaacccttcaaagagagagaagctcttctatcctcaaacaaggagatacagtgaaaggaaggcatatttcatactcagatgcctgaaatactttatttctgtgtgagtgtgtgtgtgtgtatatatgtaatatatatattgcagatatatattacatatataatatatatattacatatataatatatatattacatatataatatatattacatataatatatatattatatctataatatatatattacatatataatatatattatatattatatctataatatatattacatatataatatataatatatattatatatattacatataatatatattatatatattacatatattatatataatatatattatatatattatatatatattttaaggcttatacaagactcctgcttgtttttgtttatcaatggcacgatgggtgtagttttaggtgattgaagttacatatgcactgtggccaaatacacccagtacaaagcccaaagttgcatgtctttgatcctcattagtgtaaagtccatgtttgtgaaagcaattatttaggtgatttttatcgagcaactactaatggccggggtttgtgataaggaaccagtatacaaagataagacagacacagcccctccttaacagagtttacagtctggtaagttaaagaaaatagtgaaaaaccaattgcaggactgtgaagtaaattctgcaaaagcggagttctaatctggaggactctaaggtagagaaaagtctttatgtcttgagccagccgagtgggatagtatctggaagagcaggaggggttatgcaggcaacagcatgcacagtggcctggtgttgaaagagctccatgccttggaggaactgagtgaactttaggatgtctagagtacacagttcaagggggaagaggtcagaaaggaggcaggagagatctgacatgaccagataggtggtgcattccttcactccatccctaccgcactctcctgctcagggtaagtgccacatgtaaacagttaggtttggtctgtgcagggtggcccagctgctaattcctgtgttctgttcatggtggataactcaacctagtcattaaaagctaggaaacaccgactctgaaaatgattcatcttcccaaaagatgaaaactgttttaaacatcatcaccgtcttttatgtcaatgaaagcatcaacaaccctggctgggcacagtggctcacgcctgttttcccagcactatgggaggctgaggcgggtggatcccttgaggccagaagtttgagactgccctggccagcatagagaaaccctgtctactaaaaatattaaaaaattagctggacatggtggcgcacacctgtaattccagctgcttgggaggctgaggcacaagaattgcttgaacccaggaggtggagggcatgccactgcactccagcctgggcagccgagcccagaccctgtctcaaaactaaaagtaaaaatagaaatgtgattgtcaaatgtttttcttcaacatattttactgtgtaaacaagggacccccattttctcgtcctttttgcccaccagcggttcccatgcatttcttggcagctgtgtttcatgactgctgctggagaatgctgtcccaggccagctgtcttccccccacagacattacctgcaaaggagcaggtcttatttatggggtgctgtattcctaatccctccccaccccactctgcctattggtctcatgcagagagaacatcctttggctatcaccagcttttcatggttgagggaaaaatggaacaaatacaatgcttttgatgaactatgagctgagccagtgccaatgattaaaaattttttaaattgtgaaacatcacacattgctgttattttttttttttttttttacaaaattcctagtttccttgaacagaaactgaacctttatgctttccaagaagttatatttaaacaaaaaagttctttgaatcaaactacatttgcattctgtttcatttccttcatgtctatgtagaggaaataatttaggtctaaagaaggctggactcccctgataaaaatcagtgggttacttcttcaacttcccccttctctttgcctttataagtgttgcctttgtttttttctgaatttctgagccttctgttttactaaaaatctgagtccctagtgattttcgtggcagttttcaatggaggttatgttgttttttgctttgtttcgagggttttttgttttgttttgttttttgcatgtgtatgtaaatatcaaagtgttttgtttgtttaaattttatgtgggtctaattaaaacagatagcattgcaacacaagaaaaaaaaatcctgtatctaaatcaagatgacttccagtggcccatttattttatgggacgtttaagaaataaaagttcccacagcaaactgcgtgtcctcttgcatctgcggcagtcccattccacctgcacctctgtttgtgtgtgatggctggctgcagcctgggcgtgctgtctccagtagtgttggctgagccaggggtccaggagatcaggatgtcagggcctgtaaatcctggggcatgtgagtgtctggtggcctctctgcagaacatgaggcgtgtgcccagcccgtgggggctccactggggctccttagatggaggctggctgggtctggggcaaggggttctctccctggagtggtgcttactgagtgggagtgagggacagcaggtggagagatgagcggaaagggggctgtcacctttctctgtcctgagttggggctcttggggaaaatcagagtgcagtagtgagcagagctgggctttatgccctgtcctccctccctggtcctgattcatgacctccccgtgagccacagccccacggaagggacgtaggatttggagcctggttagtaacgctgttgttctgttgactgggcatatgatgtgggccagcaacaatgcctcgttgagcctccgtgttggcctttgtgaaatggatgtgaaaatcctcctcctgcctcttccactgaggttgtgagcagcccagggggcagtgaatgtaaagacatttggaggactctaggaacaatctaaataaatgaggggcttttttctgttattgttagagaaggggacatggcagagactcaggctgttttgccaaaacccaggtcgctttccccagctgtgcaggctcgtattctgctgaagctgctgttggttattcctgggaccctgggcgatgcagtcacaggtgaaggaccctgggcgatgcagtcacagtggggtgggctcaggctgtgcttgtttcagagacgattttggcttgttctgctgtgtttgtctattccatctaaaggtcttttgggggctggatgagtatggggcgcataccattgttctgtcgtcagagcgccctgcagccatttctcgtgaactcactcagcacttatgcttcttgggtgtcaatgccaccaaactacttggctgccaggtccaagagcgtgccaggctgttgcccagggaaagaaatgggcaacaaaaaatggactaagtcacagcagtcaggtccccgtggaggaggtgctggggaggctggagtcgcagcagcagctgaaaggtctttagaacgtgctgtgatctggtgtcgctgccgagtcattagtccatctctactgaggatccctgtctggggaagttgctgcatcccagggcaactgtgctgaaatcagttgtcttatttcaaaacttgtgcctgtgccctgagaccctcagcaggcatccttcttccttcatatggcagcccttcagatactggggaccagcctctcttctccatccctcctcctgccccgcccagcccgtccttcttccctgaacaggtggacaagaaatgttcatgtggcagatggggtgtcacggggccctgacaaggaaggtccacatgaggggagatgattacactggtgtgctagacccaggggactggtgtggaaagggcagaggtgacagtgaccgtagcatggtggtggttgggggtcagtgacaggcgtcataggtgtttttccaaatagtcgtgtaagaaagttggggcttcatgagaagtgtgtttttgaccacattggtattgatgttaaatccaacccatcacccagtgcttactgaatgtctctggtcttcctcagcaccattttcttcttattttcattttctgttcacgcataacacctgtgaaagctgataggagtcctatcaaatttctgtctgttcctccttgcctacagagaagcaatccaggttccttagttttgtatttaagcccctttctggactgacaggaagcctgttttcgttagtttttttgtttgtttgattgtttttgagacaaggtctctgtctgtcacccaggctgcagtgcagtggtacagtcacagctcactgcaacctcaacctcccaggctcgggtgatcctcctgcctcagcctcctgagtagctgagaccacaggtgcatgccattgcacttggctaacttaaaaaaaattattttgtagagatggggtctcactctgttgcccatgctggtctcgaactcctggcctcaagcaatcctcccaccatcacctcccaaaatgttggtatttcaggcgtgagcctctgtgtctggccttgtagcctggttttgatcctcatcctcctggtgtctaccttctccttcctctgctcctgcttttccttccaggcatcgtgttgaggtgcttagggtagattcagcagctgcatggccttgtgtgcccacgtgctgtgagcctcagtgtctatacaagagggtgatagcagcccctgcctccccatagtcactcaccagcggggatggggtaaggtgttgctctgggctctggttaggttgcaaggctgagggggccacccagggtaggggacacatgtattcatgttttggtgctcaatgagtagagttttctggtgaattagaggcaggcagaatgcatttggatggggtaagccagagaatgtgtcaccaaaagcatgagacttgagcttggtcttgaaaggtgcactggattcaaagatgggagaaggctgcccaggtggatggaattctgtagacaaaagctcacagggttgcggaattgagaagagtgtggccagagtataaggtgtgcatttataggatgggtgaataaggctggaatagcacttgggagaaggctggaaggccttgagtggcaggcagaagcatctgaccttcatccttgagggaggcaacaaggagctgtgagacattctgagtaggatgccaccagggggaagtctgggtctgcagcgacctggagcagagagggaagcaagctctgatgaaatgctctggccgcagctcctgtggctgcccagggaatgggtgtgtgcagacaggcctgcataagacacttcacagctgtcctgttaggctgttagggagattccttactgagtaattgcttctcaaccaggagataaaagggaatatcttaatgacctagagacagaagatctaccacatgaggcctgaacacaataagggaaaatggcgagctggccgtggaggctgctccagatgatatgtctagttttgggcacactcatttcatgcttctgggcgatcccagcaattgtgggctttctgtcctatagggacattttctggcctcctgaaggagtaggagtagggcttgttttgttggatacaattttttgtacatagccttcctgcatgcctatatgaagtggcgccaaggggaaatagagacatgggaagaaatacatgagaaatggacagacaacattgtccgttcctgcctgcaaggagcttacagtctagctggtaagctgaaatgaatatgtaatagcatgaatttgaatttggttagtagtggagttatatcttctaagcattcaaatttttttctatttggaaataatttcaaatatatagaacaaccccaagaatagaaatagcacagtgaataatccatgtaccccttaccccagttcacctaatattaaattttacctcatttactttttcatttgttatctatccataagacatgtggactgatttttaaaaatattttataatttattactgtccttagttatttcagtgctcaaatttcctaagatttggctagtaggagctacttctctagctcctgtatccttatgacatatctccataatgtgttttggtttgtttttgttttttgagcacttccttattttcttcatcttgtacctaccctacccttgccctggaatcacccagttctccaaagtcccctggttccttttaatggggaatgttattagagaccaagatgtgggtaccaggtgtgcttgtacctgccagagcatctttgcttctaagtcctttcaacaggcagacctaggaaatatatgcatttccgtacacatattcatacacatacttacattgatacatacacatactcacatatcagcctcttttaaaaatcagacattggaaatcagactttaaaataaacatcttttagaaatcatcagttcacacctataccttcaattccagcctgtccccagagggttcttctctgttccgtgtttctgtgtccctccttccacagcgagaactctggctcccagcagcattagcacatgtactcactggctaaatcctgtaatatgtctaagatagtttcagaatggtctcatccacatcactgcaaaaaacaaagctactgaaaagagttcagcatttgtttgtagttcatccctcactccaatcctacccaagactgagagtatgtcgtcaaatattcatgagctatttgaattagttttgtctttctccttcagtctggttatggtattcatttgaattacagatttgtttgtttcaaatcactttcagtttaggggtattttcccttcatctcatccttactgacttaatttttaaaaatttaaggtgaagaacattaacatggttcccaaagtcaaaactatagaaaaaggtatacttaagagtgtcactccaaccttgattcctttggcctaattcattcccatcccttgttttctgctctttcttttagatacacctgagagaaatatgctccttttatttcccagtttttcgtgtgtaaagggtagcacactttattgctttttttttttttttcatccaggcacttcttatttatcttttgatcagacacaccataaccaaaattctggtttggaacaagaagactcctagcatataacagttgttggatttttagtcacttgcaaaagtctgttggtttctaccaatagctttattaaataagctttgtaaaacaatctcttagtaataggattcttagaatatgatgaattcttatgcaaagtggagtaacttttttcccatcattgcaaagtttgatagaaggtgcctcggacttgaggtgtgattttcaggatcagagggtcagttgtgatgggaatgggttattctcaactgagcagatagtgtacaggattggcagtgggtttgccagctcattgcgatcactctgagccttgggacccatgtgtccttctatgtgtctcccaatcctaacgggtttgtggcagcttagagcccattcacagctagtgctaatttttctccctttgataatttgagaaagctcttccatttgccttttgaatgtctctcttatgtctggattcaacaactattatacatttgaacttcacgttgataccactctttgtgttttcaaagccttactgaatgtcttgcttaattcctgtgaaacagcggaacaggtattgttgtgtctgtttggaagtgaggaaactgaagctcagaacacagcagtgacagagctaggactagaagccaggtcttcagacgaagagcccagagtggtgtaggagggccaaggatttatctgggtttatcacagggactctacctccctgcccccttcctccatcctgccctgtggccaacagatttctactgtataaacctcacctctgtccacatcaataaataataccttcctgctaaatattcagccattcagaactgtctaaaatcagttcagagggtctatatcagcagctttgttatatgagcttttgtgatagtgaccatcattgtgagtgggccataaaccaggacttggcagggttttttactcctaggaattttagtcagagtagagttttacttatgcctgcttacctgtgtcccagcagtggaaaatgtacaacagtgatgcagcttgttagaaatgggatttttatatttgtaatgttaaaaaggcataaaatattacaaaagaaaattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagaagttagttcatcaatggacgttcattttataatgtatgtaattatacattataaaatgtatataattatataatttaaaaataaaatataattatataattataatacattataaaatgtatataatgtatgtaattatgcattataaaatgaatgtccttaagcttctcagggtaactcttttactatcttcataatttttttcccaagaacccatatatgatatggacccaaagtaagaataccttgtttgtatgtaaccatctgaatttagtattctaagttcggaatcaaaacatgcaaacagatttgtactaggatacttttctggtgaataatagaactgaaggtccacttttctttgagatgtatttaagaaaacagattatataattcattttcctgcagatacatgacatgccaagccctcttactgttgctcagggatgtgattctggattgagttgtgattttttcagagttcagagaatcatttggtgaatttacctagagctgagttatgtatttcccatgtgtcaggaaaccccggaggcctagaaaccccaaaccattctcagggtgtggtacatgtgaatggcgagacactggagtccttacttctttgagacagcaggtgttctttgggctgggaggtcagagcacgtgtctgggctcagatcggctcctgctcactctctagatccacaaagcctggcctccttccttattcacagggggtggagtggagactgacagccctaacaggaccaaggataggttccagggagtctggaaagtggggtgatttagaagctatgagagggatcctttctttttcttttctttttttttttcctttctttctttcttttttatttttatttttattttttttgagatggagtcttgctccgttgcccaggctggagtgcaatggtgcaatctcagcccgccgcaacctctgtctgagtgggattctttctaattgtgggcagagggtggcacttggtgaggattccagtttcttatctgaagtattagtgtcactgggtgtgcaagcatctgttcagcccctcgacagcctagagttaagagacgggtgtgaatatggggttagttttgttgttgttgttattattattattattattttggagacagcgtcttgctctgttgcccaggctggaatgcagtggcatgaacttggctcactgcaacctctgcctcccaggttcaagcaattctcttgcctcagcctcctgagtaactgggactgcaccaccatgcccagctaattctttttattttagtagagatggggtttcaccatgttgaccaggctggtctcaaactcctgacctcatgatccacccaccttggcttcccaaagtgctgggattacaggcgtgagccaccgtgcctggctggggttagctttatgaaagcaggtcacttccccattcgtgggttgggttgggttgagttgggttgggttggcttatcgaggtaggaccctgaaagagacatgctggctttgactcggaacaaaggcaagaaggcagacagaagtaacctgtgtcagaatctcaaggtctgtgtgcagaaactgcattgctgtaacctcacctgcttccttggcagctttttactaagtctctaactcacatatcttggctcctataacaactcacggttggagatgcagatggttcctcatatataaaaattgggtaatcgtccacctgactctcaggcttgcctgagtatgtggggttttgtatatatgcatagtcagaggcttgcacacatggtggaaagtagcataaacaccccacaattgggaacatttacctgtctgccagatcttttccagggcaggtgttcctataaatgggcagaaaatcatatgcctcttcccctcctgcagggaagacttttggggaagaccatgacaagtagcaggggttaagaaaaacagtaatgcttcatcagtgctcgagttcccatctgggaagggagaactgggttgtggagggggtggggactgccctgactccatgcactgctctggcccgaacctgcaggtgatgggtagaggagcctagtgtgggcaccagcaaggactgctgcctgctcagagctcttggtttggacaaaaggggtagcacacaatattaatgcaaagtttgtccaaaagcattgaagaagttctaaacttggtactctttgaccacagcttggcccatttgggtccctcctctttgaggaggctctggggaaagtggggcgtctctgagttcaggccccttgttggggggtgtcagaggcctgccatgacagcacatggtgttttgggcctaggccccttgagatcgctgtcatcgaggggagttcattttctaagaaatgatgcatgtgtgttggtgtgggctctgcgactctgacccccatagtcttgctttggaagacactgtcttctgtcctgtccaagtgtgtggctccattgctgtgctcatgtgactatactcagtgctgtgtgtcctgcccacaagactgttgtgcagtagggcagtggctcaggatgcaggtccccaaggatgtcctgatatgtgcttgtcctctttgcctccttcagagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatagtatgtagcgcctttcctgcccctggctagacagacccagtgtgcggttcagacgcctagcagtaggccttcctcgactctgacccaggctgtgagtgggacagcctcctcccagccatctggtcccttctgcctgcacacatcacggagagaacaggtgcattggtgctgactctggatttctgcctgaggtttggggtttagagttgtatttggtaaggtggctttatagccaaggaaggtcaaacggacccactgttggcctgggaaattcagtaagcgcatttctgtgcgggcacaggggtgatgagacacatattcttgtaccacaggagaagaagctgtggtttccctcacctcagagtgaacagtgttattggacaagaatttgaagtgcagggttcctcttgactcttactcttaggccacctgacatggctcctacatgtgctattcatatgaagccatatgcttagcccatcaggggctgggaggaaaccggctcaccattctaggcaggtgttaaggggcacgtgagtcagtgacagctgctttgctgtcacccatcgacaccccacactgtgacactaagcaccctagagcaccttctgcaggaggcaaggcctgagaactcagtccatcactgacattaattgccattgtcaaccacggtgtctctttcactgcatacttttcccacagatgcgctcttattctctctggggccctttgtgcctcgggtcagagtggaaactggaatccagcaatgcatttgactgagatgtctgtgacttgcttcaaatctagaagagttggataggaaggaccaagaacgtacttcaagtgcacatgtccattgagaggcctggggacccgaggccggccctacgttgtagaagatggccgagcaagtccctgcttgagcagagcgccttggatgttttgctctcagcaaggcctgttgctgggtacaggggaaacccagagctggagaggatgtggagtgctgcctcctagggagagacaggcctgtcacactaaatgcagccctggggagcagagctgcagggcacacatagagggcaggcaccgccgacgagggatcgaggacagggctggagggagcatttggcctgggccctgaaggatggatggattgcaggtgtgaccattcagtgtcagaagaagcaccctgacccaggggactagcgtgagggaggcgtggaggtggacaaaggccaggtttcagggaggaagcagtgggcccttcagctggagcacagagggtatgaaggtcggggtgagctgccataggaagggtgggtgaggtgcaattgtgcctcttctggaggttgtggagtgtgtaagtgggggctgagagacccctggtggagaggcttcttgactgagagggcccttacctttcttcaagcctgggctctgtgcctccatggggagggagtgtgttccgtgatctcagatgccctggctggtgcaaaccagtgtgctgactgggagtgggcagggtcaggcctctcttctctccctccctgcttcttgccaggctcaggaaggggccaggactttagcacctgaggatcagaagactgagggagggtttctagagctaactgtttgctgaatgcaagttcagagtttataaatagacattcatgtgagtctcagactcagcgatgtgcctatgaagtgatcagatgtaagagtgtctgcctgtcctctgcacagctctccccttggcagttgagccaacgtgaaccccatggctttcgtggagcttctgcacctgcagtatggcaacaggccatgtaggtgcagcttggagatgcctgcaccgctcttttccccttcacttgcaaactgtaactcagatgctgacctgccccatctcccctaaacccaacatgttatttgtaaacgagaggaggtatggcccctttttctcagcagagtgtctttctttgctagtttagctgtgtcccccagggagctgagtgaggccttcttacaggccagtggcctttcctctgtttatttctcctcctctagaagtagacaaggtttcgtgttctagtgttgctaacattagtcgtggtagagttgtttatagggcctatgatttgaggattaagggttttcattggatttaaggtgatatcttgagggttaaccattttatctcagcccagcatttcctatgacctatcactgtaaaaacctgatgatgacagaaatcaatgactctgcctttcagagaacttgccatgaggggaagatggagaaggagtggcttagtgtgagaagctgatcccattgttaaggcccagcactctgctgtgtgagcccaggagggcgcgatgattctggctggtgggagtgggcaggctggggcgatgtgaggaaggctccgtgggaggagcagccctgggcggcagaggttgggggtgggggctttttcaagctggggaaatggcacaaacaaggtgtgcgaagtgacaaatattcagggcccttaagtgcattgctcagtaatataatctaggaaagaaacaaaacctgtttaaaagccttgtagatcttcagaattcactctcactggggctcccaagcccataaagctgcaatgtgtcttgggaacatcagcagtattgtttctgctatgcaccgtgatgtgtgactcaaaatgattaactagcttaacgtttgatccagaatagcaaatatttctgtggtgcgcccttgttctttatggagctcgttttgccaggtgctggggtttcctgtggagtgaggctcacagtgcttcccgagtcatcagatttccagagccttgctgatgagggttttaaataaagacagaaatcttggctgtggaggccatgatgggatttagctgacttgagagcaccaagtctcctcctcctctgaggagagaacctctctgatcacagacctcagcagcccagaccctctggaggagacagcactgttgaggtttccctggggcctcctgtggctgccagccattttcttcctgtcacagccagaaaaccacacaaggagagggtttcagtgaggcccacatggtcctcctcaccaaataaacagtcctggattcaccacatgcacatgccaggtctggggctgtctctgtgcatctgattagcaggcagtagaaatgtgggtgttgccagtgttacggtgtctgcatcctccctgggggtgtgagatcaccccacgtgccttccactccaaccctgctcctctgttacctcttgagaggaggatggcgcagggcccgggctcctgactttgtccataatggctaaggatgctaattcaactgagagcccttttcagctgggtcctggatgtgagttgagcagtttcctcccagaccttgaggattgaagtgacagtgtgagaagaaatgcttcctgatagccgagcctcagcctagatgagcagaagtgggtgtaggaagtcattaataacagcagatgtctgtgagctcacaggaggcaaaggcttgggctggagggcatcttgatgccccttctccggatgtggctgcaatggagttttgtgacttggaatttggactttagtattaggcaaattactcaacctctctggaccccactttccttgtctgcaagaaggggataaagatatatctccccatggggctgttgtgacaattgaacgttctgtgactgctaggagtagtcatagttgtagtatgtgctgctgctgttttcatcagacaccagtaaaagttgacctcaacagaattttaggggtataaatttagggggtacaaataccgttctgtgacatggacatattacatagcggtgaagtctgggcttttagtgtaaccatcacccgaaaagtgtacattatacccagtaagtaatttctcatccctcatgcctcttccaccctcccacccttctgtgtctccaatgcctattattccatccacaccctatgtccatgtgtacacattatttagcttctgcttatcagtgagaatatgcagtatttgactttcctaaacataatatttttgaaggttctcctagaccgctaaccagcctcagggtggggcctccctcttaggaccattgccctgtgcttttctgttcagaaactataaagttctgaagtattgatggaaaacaaatctgttaactaggtcactttcgagatagggcagcacagctttcaggctcttgaagtccatttctagtttggcggtgcttgctgtcagggaacagatgtcaaatcaagtacttggagatgcgctcacattatcttttctctctgatctgctaaatgtcactgcatgcgtctgcgatgcccaacactggctgtacgttataatcacctggggagcttggatgcttcttgatgccatactccaccctctaagactcttgattaatcttggggtgggagccaggggtggctctttttcattaaggttccctggggattctaatgtgaagctagggttcagaactcctgagtccaggatgctatcagtggctgaatatcacactgttccaggcattcacttgaaagaagaggagaggcaatcaggcctctaactgagctgtctggtgactggtgacaggtagctccagctttgtgcattcatagaatatttaaaatgtcaatttcataaatttgctattagaaagctggtgttacacaattaactgaatggacaaaattccctttgaagtgagttcctgagcatttggtaaattttcaaggataatttatttaactttttgctgagcttcaagtttcttaagaaaccctgccaaatctcaaagtgatttttttagacatatgcagctgcttctgagttaacaatggagttttgctaggaccattaaaatctggaagcctaaaattctattttaaactcttctcattgtcagtgattagtcttaaaaaaaaaaagcattaaaaatgaaatcattttaaagggagctcattctaaaattctggccagaaaagcagggcaattttattgtaggaactattaatgattaataattcctctaagtaaagatatttgatgcccaaagaaagggaggggcatacctgaaacttcatctctgaccacaagggcagcctctctgtcttctgcttcttcagtggtcctggaggctatgggcactgcccctgcctgcccggggactctgccaccctggggcttggtggagcaggttgccctagctgcctctcttttgcatgtgctacctagttgcctcttactgcaatgtttgctttgggggtggacagaaaaccaggacgttatagctggttgcaagcataaggcatagcaatttgctggtcctgttttgaaagactgtgttttgaaattttgatttacaaaactgctttcatcaccattgaactacctcaaggcacaagttcaaaatggaagatactcaattaaaagctgtaaagcaaacagcagcagttagagtggcatacggtaaatatgcgtccaggtcaagagccctcactggagaggcagctggaagtgctttcactgggaagtgggagggctgactcaggggctggccctagggtcagtggctggacactgtctccattggggtggcactgggagtagttgtctggacaggcagactctctccacaggggtgatagaaagcagtggtaatttctaaaagtgcctgcatgtctgccatcaccttcagcctcctaagagctgatgggagctggactcagggactgttgccccactgtggagacaaggagtgggtactccagccaagtttgcagtctcaaatcagggttgttttatttgtttttaatacattttaattatggaagtaatatttgcctacataaaaaattcatgtaatttcaaagtatataaagtaagaaaaaaattctctcttccttctccttaaagagaggcagacttagaagtttggggcctctacttccccacctcactgcacataatacatgacacagaccgcatgcatatagcttccaccctaagatgcccaacacaggtatttttcactgaaccatgtaccacagatatttcccatgtttttaaagcaaaatgttggctcttttcaataaattgccattataaaaactgctacaatggactatgcactctacagcacgtggacctctactttatagaggtctctccaccatgagaccatcagctccatgggtgcagcaggaatagggtctgtttctgccctctgttgtgtggctgcacccagcacagtgcttgtcccatacatgagcatgccattacttccttcttgaatgaaagaacatagagtaataataactagcatttgtcaggtgctttctgtgtgtgagacactgttccaaaggctgtgggtgaatacattcattcttcttcacacaactctgtgagacaggaacttgacagatggggaaactaaagcacaaagcagttcagtagcttcccaaggccatgtgacttacgtggcaaagctgggatttgaacccaagctctgccacagtctgcaggctaactatcattaacccctgcaaacacatgcccctgtgtctgcgtgctcgtgttcatggttttgtgggagaggatacaagaaaagggtctgctgtgtcagaaaggatgcacattttaggaacgtgagtattctgcctacccatagtgtgcaggtgtctgtgctgcccatgcccttgcttactccagcattcctgctgctgtctcacactgcttcgcacaaccctcccctagagcacagggtccgtactctaaagactagctggcttagagtgatcatggaatcatggggctgcaaggggttaaagatcctagagtcatttctctcgtgacctggtggtcatgggagagtcgtagtgatgacagtagtggtggttgattgtgccttgccaaagctgggcacattgcttttattactgtctccactgttcacctcttacaacaaccttacgcagtacaggtccaattattattgacatcttacaggtgtggaggaaactaaggcttcacagtatcaggtaacctgtccacagtcttctgacatggaagtgacagggctggggttagacctggcctgtcagagtccagagcccaccttttgaactcccacctgtcctgtcccatatggtagtgctgtttggaatcacatatccagtctgtacagggctcctgactccccctaaagtgccttttccttaataccctacttagatgggaagccaaaccctggaaacctttatctagcatgggttagctggttgttgatttagaacaggttcttaaagacaggtgtttgtgtaatagctgtggaaagggcacttcctctccgctgttctgatgctgagctggattcctagcaggaggggtctggggcaggcgggcgtccattgcgtgaggcaacctggctggcagggctggccgcgtggggccctggtttggctgctgttgctgccctctgctgcttcataatgaaattgcctgtgttcaacctgaaggggtcacagtggccgacttgcttaaagaggataagaagaaaaagaagttttgctgctttcggcaacgcagggctaaagatcatggtaaattgctgagactgagctttctttttccgcaacatctctgataccttttccttgcacataggcattgtgtgaagtgcatgtgccgtgtggtgtgttcagaagatgcctatattttaattgcttgatttctttcttcttgtctttttccaaaataatgtgcccttaccaagatagcattgcagttttctttttgtttgaactgtaccttataaagaagcagctgaaccaactcaaaaaatgtacttgattcggcatgaatattcttagactggaaggcagacttttaaaatacttttccccaaatgatttttttaaatttaaaccgtttagaaattccaataatgttatttgattgatttttttttctccaggctacatgtttcaaattgcttctctgtcttttagtctctggctactttgcccaggactatgccaaagctagtagtggcagctttaagaatgaaattagctggatgcagtggctcacacctgtaattccagcactttaggaagccgaggcaggaggatcacttgaagccaggagtttgagactagcctgggcaacaaagtgagaccctgtgtctaccaaaaattgtaaacaaagaagcaaacaaaaaaatcaggtgtggtggtgcatgcctatagtccccagctacttgggaggctgaggcaagaggattgcataagcccaggagttcgaggctgcagtcagcgatattgcgccattacactccagcctgggtaacagagtgcgatctctgtctcttaaaaaataaaaataaataaaaatagacttcagggatgcaaagatttgggggcacttgcctttgaaagtgagaatgggctcgtgtgggaaagttatatttccagatatgtcctaaaatgatgctaaacatacccttcctcagaatccctggagtagctgtcaggcccatccccaggcagacagttaggtgagcagctggctccctgccttgctctgcccaagtcatggcagtggttcgacagcagcacaaagctttgcctatgcacaccagcacagtcgacccagttctgccaccaggatcggccctggtcacctgactctggggaaagtctgtttaaggagattcagaccgcagggacgtgaagccaacaactaagggaacagaggggacacactgtactcttttctttgaagtggcctctggccccatgggaatgctgagctgagaggttatgggacgcagatgggaacaacccgtggatatctgaagagggttatattagagtctaggtctcatcagaaggcctaaaagtgaaaaggaattaagagattatcagatataagcccttgtcattcagcacgttgtggaccccaaaggagggagaagaggaggtggaacttgcctgaggtgggacagtgagttaggggcagagttggggctgccttttttatctgtagcattcacggaaggtttatgaacaggaggctgggcttgatgcagcacctgaaggtgtctgcaagaagaatggccttcagctaagcaggaaatagtgtcatggacataagaaaaaacatctttaaagactgacatagggatatagctctggagaggttaccaaaaggagataaatgatttctgtccccagaaaagaaaacacccctccttggttctgccttgctgaatgcaggcttgggccttgtgattctttaaggattcttgtgccttctccattgtctttctgagatctgcagggagaggaagcaggctgacacatttaaggaactttattttgagtgggaatggctttttattgactgaaatacctggggactcaggaaggactccgaccctgctggcaccaggtggggcacgagccctcatatggatgctgggctgcccctgtccctgaacacgcggagatagttattgtctgggcataattcttgcttgagacatggaaaccttggtctggccttgacctccattctccaagaagagcctggcttctttacagcagcaagaggctgttactctgtggtggcctaatgtgtctctactagcatgtgcatgtgcctttagggggtgtgtgggcttcttctggatttggcaggcctgtacgtcatggtactgctcatgtttgtcatgaaaataagatgaaaacatgaggtctaggtgtcaggtaccctgtcccctaggaaggcagccacaactcagccactgctcagttgtccagcctcaccccctacccttacctttgaaaagaatgagaagctttaggctgcttggaggtggaaggaaatgctaaaataaattcctgagtgtgcaaaaaagtctgtcctgtggagaacagaggagtgaggctctgaggccaaagacatctgtgaatgaggctactaatgggacaggttctagacgaggctggagggctctgggctcagtttgatgtgtggcaagccttcccttcggggtgccttgactggaggactgaggctctcctgtgacgccctgaggcctctggggagctactgcttcctgtgctgcaccccattctctgggacattctacatgcagagcacttggactcagttctccagtgcaggctgctggctggacccctggcttccctcctgagggtggtgggcaggggctcacttcttgtgccctcccctccttgcagagctgggggaatgcaagggaaaccccctggttgttggtagtaaaaccagccagcatgtgggcgtttctgccttcctgcagttatagcaggtcagaggtaaatggatcttagagatgatactgtcctacaactcatcttacagatctggtagccaagcataggggaaaagaggcacttgtcccattgtcacctgatgataagaaccaggctttcctgacatttcttccatcatttttgacctcatcagcctccatcactgaaggttgatctgagattttgctatacctgttaatggtgaacataattttgaggctgcctgcttaggacccacacatagactcatttgctctgtgtgtgtgtgtgtgtgtgtgtgtgtgtgtgtgtgtgtgagatttgcctccaaattcacaagcctgacacatttggctgagatgaatgtcgtccttcagcatgagagtagatggataaatgtctacaccttggtgaaaatgctagttgtgcttacctgagaagcagcagatttccctggtttactgtgtgtggcattgcccatgataacatctggcccagtgcaagatcttaaagagaagcaccatgacccacatccacagagtgctccaagtaggggcctggcccggctgcccatgctgcaaaggccttggaaactctaattacagtctgggacatgcagggctgctgtctgccaccatcctctcacccccagtggcacccaggccccccgccaccaatctcagtgcaccacactgtaagcctaagggtctgccctggagctcttcccagagatcccaatgcctggaatagattgcaaaatataggccttgagcttctccagattttcagcaggcaaattgcagtgccagcatcctctcacaggtcacaggctttcctaatgcttggtttttcccagactcactgaaagtagtttttaaatttatataaaaaataaacttctctaacaaagctctaacattccagtttcctgaaatgtgtcagggaagaggcttcacagcttgttcatgtgcagatggcccctggtgcttatttctacagtaggggactggcacttgtcggcaatgtggggaggtctgaggggtctgcctgcacctctaataaggcctagccacttgtcagcaattaacactgaatccctgctgaaggggacaaggccatcacctaaatggggcagtcacaatgctatggaagccagttaggagaagcccatgtattcgggtaatttgcccatggctttaccttcatgagtttgtatgactctttctgtctggatttttataaaagcccagtcgtcaccattgcagcctgatttttgtgctgtcgtcggtcactgagctgatatcctgtaagtgatctggttatatgccagattttgagtggttaataaaggtcatcagaatagtaaaccagcactggtagataatagactcgtttggctttttggaacttgttgatttgtggaattttaagtacataacaccaaaatgtataccagtgaaaccacagtacatacttgaaaagaatggtgagtggaagttaggagagatttctcagtgtcagctgtgtgtcccaaggcattttggcgagttctgtcctctgagaaatcaagagtttgctcacgtattctcagaagccccttctggttctaacagtctatgattcttttctttattttttaaaaacatagatgagatcctattggggctaaaggaagggaaagtcatattaattttttaacattaaaaaaatgaatgcctaatgcaagtgaagggtaaaatgctttatttttaataaatgaggtctttgttatacccactgagcctgatcttttcaaatatttttggaaaaggataagtgtgatatttcttctggaaatattttggaaaaggatcctgtgatagggagtaagtggctggagaaggtaggctgccagggccctggtcagagtgcgtttcctctgcccagatttaggggctggatcaagggctgtttccaggaccaaatgaggtctccaatttctagcgtaggcactgtcctctttctttccgtctgcctctgctcatcctcagccctggcaacatctttttgggatatatttatttattatgtgcctgtggctctttaggtgtcaaacaactatgacaggagaagttgctatgcctacagtaggcaaagttagacaataactcagctaaagacagagaaaatacaaaccaagaatgatggccaaagctgattcagaggtatggaagatggctcacactagatgcgtctgtgcaatgatgaaagtggccagggcaaaatgacactggattggtcgctttgcttccagggagctccaggagagcttttctgagatgatggagttaacatgtgtgggcctcactgatcatccagccctggggacccagcactccgcatgcctcatctcattcttacccttttacaggtgaggcaatggagatgtacagaagtcaggtcacaaacgcggggttaaacttagatctggccaacctctgcacctgctctcagccactatcccaacccagctgaaggacagaatcagctcagagagcaggaggaccctgcctcaccctcagtggagccctggcacagtgctgtgagactatcttcccctctttgttgctgtttggggagttcggttttacttcttgtctttccccacagttagtctagggagcaactagaacatttcatacactaatagttggcagggggccagaaatgctaactgatgaccccattcccatagaaaatatgtaatttatctgtttcaatcagattgtttttaaaatgaagctttagaattgaaatgctgcaactgtaccgatatcagcatgagacatgactccagagattaaaaagccacaaagacttagtcttttcagaagtttgctcttttgaaaataatgactaatgttcctacatgattaatattagaactatgagatagcaaactgttaaagatggaaatgaccctcaagattgtggagttcacaccaccattttagagacaggaaagtgaagcctggagagaggtgatccattgcccaggagactcagaaaacaggaccaggcctgtgggttccccacatcatactgccctcaactcctggtcccctcagtcactgcagtaaccaccacggaaaatgccgcacagagttaactcatgatcagatgtgaaaagggtctcccactgtgattttctttgttggatttaacaacctcctcacctttctgctgaatcagagtgaggaacagtcgaggagaattgcatgagtagcttcttgtgtgtctgtgtgtgttaatggagtttttttttttaaggtttttccatgattagagtcgtattttttgtttgtttttgtccagttttttttgtttgtttgtttctgcatgaaataatgaaaaagtaaatcaaggtttgtaattggtttcttctcacttaggaaagaagaaaattattctatgagagtaccagcaatgtaacatgagtctataattttactcacttggtcttaacttttgacacccttgcctcagtgttcctgggcatggcgtggaggctcccatgcaggcaggctcagtttctcgggcactcacaagcggaacggatcagggatcttctttggtatcctcaagaaacttctcagaccactgggttccttgagccaggttccacctctatccctgctgttacctttatgaagtctgctatgagcaaggcgggccgaacacagccccctacgcgagctgcctgatccagctcctttccccctgagcctgggctgggcctcagaatcttcgccatagcgcttccagcccactaccagtatttgcagatgaaacttgaggcatccttgctaaggggagccacacgggcagagcccatgggccaagctttcctgaagacatcgtaaggtctgtaaaaacagtcactacagttcaaagccatgcctcaggaaaaaggaagtacacgtggattctcttccgtgacttcctcttttacctctgcaccccggcagaattaatccttctttactctggaacctcctgcacagacccctgaggtagctctcttcacagctgatggaagtgagctgggggctgcctgtccctcacccctattccaggtgggtgcagtgctgtgtgccctctttttgcccctgccctcctccactgcctgggctccagcacgtgttcgtgatgtttatggggttgaatcaagtggatgagaaaagacgctcgtgcaccagatggtggccctgggtggaccctggacctccacacactagtgggcgtgtttccacatttcctctacttccgctcaggatcctaccatggagaagtgggatgggcccagagaccctagtcatactgagaccagagtcaaccttgccctctgctcactggttgataatgatcttcttcttccactcgtaacactataattccttggtgctctagttgttcttacccagcttactgggtaagaactttctgcgtattggcttcacaagctcagcagaacttcagcatcaggtaaaatagcaaaaaaatagagttcttaactctaaaaaatgttgtgcatggtaccttcatgcactgccttccccattcacaatagctcttctccctcagtatatttaagatgattgactcatgaaatgttagggttattcacagatgttctatatgcaccttttggggcaagcaaagatgtacctgtaaagtacattttggtggcttctcagtgtgatcccagagatgaggaggataaagtggtgctatacccagccacaggattcactttgatcccttagcttcctttcttggaaatgtctagggggatagaatgtcctcctcgagggggactgtgttccctacaggccatgggtgcagagactcgcctgcagtggagatgcctggctccttggcactcccttagcccagctgaggccctgagggcccttttcaccctcctcctgggttccggaggtctgcctggtggcagaggctcccacctggcctgcctcccaggcgtgcagtgtgccccgcatgctctctgaagcccgtcttctccccacagctagcatgcccaccagcgagactgagtctgtgaacacagagaacgtcagcggtgaaggcgagaaccgaggctgctgtggaagtctctggtgagtgtggggagcacttgccctctttcccctcctgttgtctcagagaagcaggtggtgaggaagaccgcccaggctgcagcagagccccgggccatcgccttgggtgtggcgggtgggaaggctcctcgtaccccacgccacgcttcctcctgtgccagggctatccctcctgcacacctccccaccccccgcccccccgccccccggcccagcatttcacatgcctcttcctgtaagtagagcccgtgaagaatgtggtggttaacctggccacctgctgtgtccattaggtgctggtggagacggagaggcgcggccaaggcggggccctctgggtgtcggcggtgggggtaaaggcctgattctccttccagcctgggtttggcatttgtgcttttgaagaagagcttctgtggcagagttgctgactagaatgtgctacgtatttaagttttcctttgctcatgggaccttcctaacctcaggcctggcggttggatgacgaggccctgccttcttggtgcctggcactttttccctggagccctgcaccagcctctcctcatgatggaaggcaccattgcattaacactcactggcttttttctagatgatttgggctgtggcagctggcgggggggctgggggggaccagcagtgcagaatgtgctgggcactgtctgccgtgggggagccctgtgcggtttggttttgtttgcttcttgctggtatccttcaggtcttatctctgtaaagtgcaggtgtcatttttaagagaactcaatcttactcttggcagagtttcataaaaatgatgtgttatgggcagaatatgcaaccatttgtgaagtgattttgcctccattctcttgctctgccctctctgagacatcatgaagcagacagagaatgggtttgtcatccccactttacagatgagaatgctgaggcccaagacctgctgctttcccatactcacccagtgggagaatggcagtgctgggactcctagtgcagtgctccctctgcggtagtagcagcaaatgctgctgtcgagatgagtggcaggagagactctgctgccttcattttggcccctgcatcactgcctgctgccagggcctgcagggaatctggccgagtcttccctgacctgggcctcgagggtgctcagtctgctcctctggccctggcagcatcctaatttctgctctggccttgcccctgctggcctgctgtggtaaccaggggtgctaagtccaggctgtatgcatggcttttatgatatctcagctgaaatgatggggagtgtgtgctcaagccctcggaaccagaatcttaacactttttgtctttctttcagtcaagccatctcaaaatccaaactcaggtcagtatcttctttctgtttcttcgtcagcctgtgtgttgcctttgtatgttctcacttctgaattttacgtagtattgctctggacttgagttttcctctgtggattataacattgatactgaattgcagtcagtcaattgaatcctatgagcctggcttagggggagatcttaggtgccaaagatctccctcaaagtaaaccaataagactcagtaacgagttttgcctccccattaatcctccttatcctctgagtcattttcctaagagagctgctgcttgtcacttttctgctcgaaagctttccatagaaagggagttcaagaagtcttccaaggtactagcatttcttgatgtgcatgcgggttacgtgttcagttggtaaaactcattgaaccatatacctatgattagtgtactttttcatctgagtgtcatttttcaacaaaaacattttcctactatatataaacactaacttaaaataggcaaagacctaaatataaaatataaaatcatgaacattccagaaagaaaacaggagaaagtctttgtgatcttgagttatgcaaaggtttcttaagatacaacacccagtatactttctgtaacagaaaacaaacagataaattggtctttgtcaaaattaaacttctgttcttcaaaagaaaagaaaaaggttagcttcagacttggagaaaaatatttgcaaagcatatttgataaaggactggtatcccatatatataaagattaatgcataaaggagagtgtcaataatagaaaaacccaataaaaaatgggcaaaatttttaataggcatttcaccagagaagagatgtggatggcagataagcacatgaaatgaccatcagttgttacaaaaatgcacattaaaatcacagttagataccactacacatctattagagtgaatcagatttaaatatctgacaatgacaagttctgacaaggatgctgattggtgggaactttcatacagtgttgatggacatgtcaaatgacacagccgttaaaaaaatagtttggtagttcctcataaagtttaaacatatatttaccacgtttatatttggcccagccatcccacttctaaggtgtttgtataagagaaatgaagatatatgcctacatacaaagttgtaacatgaatgtttgtaccagttttattcatgcttaccccaagctggaagtaacccaaaggtccatcaaatgtgaatgggtagacacactgtggttcaccagtatgatggagtactagttcatgtctgctgagttatgcatcctaggagaaacccagctgtgagcgggacagtctttagtgtccttagtagagtttttccacgctggccaacatgttagaagctgctctttccattggaacctgcacagcaagagtaataataaaatacaccttacttgatccaggttttggtaaagagttggcacaactctttctctgctcacttcctgggttacagattttctttttgcctagcaacacagctgagtcagccagggctgcagcttgggtagcctggagattcctcttgactcaggcccccagaggaagtaccccattgtcgttagtgaggcagcacagcctggagaggactgactttaccaattggctgacctttccacgggatctgggtcactgagctgcagctcatggcacactttaccaaagcatccccttgtggcagggaaggttttctagaaggagacaggctaagggagagaatattttctctaatcacaatcaggaactgaaggtaggtggaggacatgctacttgtctgtttggctgagctcattttatttttatgaaaacacgattcaatattggctcttctcctaaaggtatattttgagcatcactagttagaaagggcacctgatgactcagtatgaagattcatgtcctactcagctttgacaactctgccaggctctggaggaacctcagagatttaagaaaggattgaaaaggttccctttaaaaaaaaaaaaactagctttgtagcactttgctgcctggtaaattctgtatggtgattgagatgctgcaagagatgtgtataataagcgaagtggctctctgcactgattgcatgagcagatccacgtcccatatggtggatataggaactgcatatgtgtgcaagtgtagttttgcatctgcacgtgaatctatgaatatctagattttctaacccacttaagggctgcatatgacagattctggagttatctataagccataaggaaggactgatagcatgatcaagtcaagattatacttttaaaagtcgcattttaagaccaacataatttttatgatgaagtctgttaatttctgtgccatttgtgctcatctttctttcctgcactcccaccccaatctagacctccagagtgaaagccaaattatctctcaatcatatttattggatactcagatgctgtatctgtcatctacgtagtaatgtttgcttgtcttttagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaaggtacaagcagaggccattccttttttgttctgaactagagatttctgtggctgtccaactgccatttggtcttatctgatcgctgcatgatgaagtatcgcaacatttctagtgaggacaaacttggtagaaccatccagacacagcaactaccagagcgagggtgccatctgtgccgcgtggtgaagcaccttggagccacttaatgccaagcatctaattgtcctaaccctgagccaacctaggaccaagaattcttgaagctggaagggacctcgtaatccctgctccctgccctcatcggggaagcttcattttcccctatagtacttctggcaaatggttttggttcccctgctttgaatgctccagcactggggtgtgggacactcatccctagagacagcccattctgggtttgacagttttgagcctttgaaaagtccttcctttcatccagtcaaacccgtttccctctacctctccagcctgcttggtgatattttcagctgttagaaatgacattgataggtgactgcttctgatatcgtcatgccataaatgaattcagacagatcttttctgtgtgattgaatgaaaaaatatgtataacctgatggtgtcaacgcagaatcgtaggcttttagggctggaaggcgtcagagattatgtgatgagctgccccttcccattttgtcatcagtgacactgagacctggagaaatcaagtaacttctccagagtcacacacatagctagtagcagaagcaggaccagaacctggtggacagactgtccacgcgaaggccacgtttctgtcctgagtgaggtagtgaagagagagacaaggtattggcgtatttcctgtggggcctgatagggagggaggtgtgaggggcacgagcagtctgagtgtcttgcaggagaccctgaggatgggtgcccctttgtctttccagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggtaaggaaatgtgggtcccactgcaaatgttttatgaacatgaggcggcaaccagtcacatccccgggcaggtgatgttctgctctgtcctgcatgggtgttctgagctgacaccctcatcttgacttataggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccaggtgagtcctccctccattccccgaaaagcacttcgtgagcagcagctaaaactcctctgccttcttgtctgctcacactcaggaagacaaaaggactccatttttgttcatctctgccctaatcatagcctggtaaattttgtgccatttaagttattcgttctgcatcatcctccagctgtctatcttaagtgatgtaatttttttaaagacttctagctacattacaaaataataaaccaaaaaaaccgtttttcacactcaagctcttccaagaaaactttttgattgattttatgaggtttctttgaaatagactctaaaattcttttctctttggtactttttgatggcaggccagttcataatcctagttataatagatttacacaagaagtgaattctcatgcctccatgctttggtgtgtagttggaggaatcagagtggtaggaactgtggcagccattggtcccttctgtcctcctcctgggatgcagtgaggacacaaagattctgagggtgcctgtcctgtggggcctctgcaggcagtagctgagaagggagcggtggttgcagagaggcaccgatggctctgctgctcagagcagcagcacatgctcccctgactctacgctgaggtgctcaaaaccctcctccttggacagggtctgatggagaagtttaaaagacccacctgtcctcattgcttttcctgtgtgatgtgagctgcagagccctgccagagaggaaaggcagcagacagctgggtcctgtggtggccctttccatgcccagctctctgctgtggatgagtcacttacccatttctgaagaaatccagagaccaaagggaatgatctggacaattctctcccacttggtcattttcaggtatatataatctgctgtaagccatagtattgttgtttgaattatacttaaattttggctgctgatcagtgattcttttttaaaaaaaaatttctttcagagaaactggtgtctttttttttttttttggtaatgcatgcatatggcacaaaattctaatgttacaaatgaataataattctcccagccagccacaaatttcctcttctaggaagcaaccaccattaaacagtttcttgtgaattcttagatctgcattttctgatagctacaactcagttaagctacctataggagactttccacagacaggagctcactgtacgtgctgttttgcatcttgcttttatcactttgagtgtcctcaagagccttcctgcttggtccataaaaggctgcccctcctttgaaacgctgcgtccatgcggtggtagatgtgccgttgttcatatgaccagtcccttgctgacaagcattgagttctgtctggtcttagcccacatacacagggctccagtaggtgaccctgaacacgcatcagagggcacatgtgttggctgtagatctgtgggataaactcccagagatggaattgctgctttagagggtgtgtccattttaaatgttgacacacgtgcccaagtgctctccttatggttgtattagctcattgtcttcacactgcccattgcctcactgcctctcccctcagtggagagcatgctttgggatgcccatcagttaggtgaaaatggcatttcattgtacttttaaaagatactgttcttatcaggagtgaggttgaacgtcttttcctatgactcagagccatcagtagtgccttttctgtgaattactttatcttttcaaatcatttgcccatttttgtttggttgtgatccataacagtttaaattttaaaaatatctagttcagattgaagataaaggagctctgtctgtcgtcggaagatagcatttttttcattactgttcttattcatctgattctatttcatcatggattgaattatcaagtatgatcagtagagaagattaaatttcaggtcattggtgatatctactcttgaggtagttttgtaaatttacatgagacatttagaatttcctgcttctgtaatttcataggtataattatccatttccacagttgatggactatgtggaatgctatgcagcagttaaaagaatgagatgcaccttctgacacagagggtctccagagtatgttgttgaatgaaaaaacaagccagttgcagaaaactttgcatagcatgatatcctttatgtctgaaaactcagagaagacacctagtgcttgttttctttgtgtgtaaacgtgtttaaatctgtagttgaaggttccagagagacacagaaagagcatgctttctggggaagggactaaaactgggctggggtgtaatcaaaaagcacataaatcttggctgggtgaggtggctcatgcctgtaatcccagcactttgggaggctgaagtgggcggaacacttgaggtcaggagttcgagaccagcctggccaacgtgctgtaacactctctctactaaaaatataaaaattagccgagtgtggtggtggtcacctgtaatcccagctacttgaaaggctgaggcaggagagttgcttgaaccggggaggtggaggttgcagtgagctgagatcaagccactgcactccagcctggcaatagagcgagactccatctcaaaaacaaacaaacacttaagtcttaataataaggttattttttttcactcaaagaattatctatttgtgtaattaaaaaacagtgttttagaaattccatgggataacagatggatttgttcagtgcaaactggactgtgaaaggcagcttaaaccagatctaggcagccaccgaggggctctaagagagcggctgcaatttgtgaatccacctgctggctgataccagtttggcttctcagatcctgacaggcgaagactggaatgctgtgatgtacgatggcatcatggcttacgggggcccatcctcttcaggaatgatcgtctgcatctacttcatcatcctcttcatttgtggtaactgtatccttcaagccgaccaggctttgttgttgccgtcgttatctggttttgtttttcttcctctgcatttctctgtggtgatggtggtggtagtagttgtggcagggaggtaaatgcctttaccttattagctcaatatctgcttttcttccatgctgctgggggacagcgtcctgtaagcagaattccagagaggctttgagggatgcgctctggctaagagaagcaagcccagggaaggagcgtgagacagcacacatactggtcccagaggtcactcagtttggcatcatgtctcctgtacaggtcccgagggatggctgagcgcaaggccaggtggttctttatgttatcattattgggagcttaggcgtccatctgtgacttcctaagacccttcgtgactgatgagagccatctttgtggactgatctgtgctcccctgggctaatttcactttgctgatctgtccatctttgcggatcaagtgtccattggctagctgctaaatcatgctgcataacttctctctgccttactttaccccttttccctgtcgagaggcaccctctaatcctagacttctggaattggcccttagatctgtatttacctcattcagacccttcctgatcctatagcctttggttctcggtgttttatctccaggtcctccatgcctagcaccagacctggtacacagaggcctttaatgaatgtttgatgcatgaacgacgtacacactcatgatactacatctgggttttcacccttccattttaaaaggtcctaatctggattctgcttctaaggtggcccagatctctgtaggtgttttcttctttatcttgtctggctcactgataaattttcttcagtgtggtaacctcagtgcaaacctgcccccttttctacaaggacaatgctttgtgctataaggtattttataaaaaccccatctcaacacatatacatccttgtagtcccttgactcggctctaaggccccctccacaagagccacccctgccctgtctcccacccagagaaggttcttctacctctgagctccccctcagattttatccacgtctcttactgcctgtaggttcttctgtctactggatttttatttatttattattattattttatagaaggagtctcactctgtcacgcaggctggatggagtgcagtggtgcaatctcggctcactgcaacctccgcctcctgggttcaagtgattctcctgcctcagcctcctgagtagctgggattacatgtgtgcaccaccatgcccagctaatttttgcatttttagtagagatggggtttctccatgttaaccaggccggtctaaaactcctgacctcaggtgatccgcccgccttggcctcccaaagtgctgggattacaggtgtgagccactgcgcccggcctgtctactggaattttgagtgggcattcctccatctccctaactagatggataagcttcttgagtcaggaatctttttgtattcacatctctcaatagagtacaggatcttgcacatagttggcccttggtaaatgaaaggtcattattttctttttctgctgtcctatggttgactctttaggccacagcaacatcctggacttgaatctgcagagaagtattccctggtgcttgtctgtggttgcatgttgttttctttatagcacatgccactgtatcagaggtgcttagggagctgcttatgctctgtcttccccaactagagtagacattccagtgtgtggtgtttcttcctgtgccctcagcacccacaacagtgcctgacacattggaggtacttggtagatctttctggatgaattccagagcatgccactctttaggagggtctgagtaatgcctctcaatacagatgatggattttgctctggaaagttgttacaagcttgtaagatcttcctgtggctcatcactctggatttgctttccactacccaaaggagttgagtgtcatggcaagactagagagattattgtttcttcactgagatcatggagggaatactcagtacagctagtctcatcactagcccctgtccgagttaccattaccccaggcctagcagaggaatgctcatgttaccaagccatctccagcccaggactaattgcttcctgaggctcattgcagctccagttaaaaaataggccagcatgtcaaaggctttttgagtcttaatgtaattcacttacgtttctctcctctttaaaaccttgaatagattagtcaggcgtgctattccctcacagagatttcatcatctgttccttgttaggttatgttggtttacgtgttcagcaacccatccaagacaacaaattgcacagggcgtatgggacagtgctatgctgctcctgtctcggggtctctgggctcctgcagttttgcctgcagatggccgggcatcaggcagagagaagcatttgtcacagaagggggccttctcacttattgccctctcatccctgtgcttctcaaaaacatgcttcactgctagtgggtaagaaacaggcatcttctgatttaggagtcttgttcagaatacttgttaaaaacaaaaacattcaagaaagccatgtatacaacattagagtaagagtgaaaaaatatgataatttgttcagtcacctaaccttttattgtgttttttaactggaactgcaatgagcctcgggaagcaatttgtcctgggctggagagggcaaaaatcaagttcaggtacagtgatcaaagatcgagctgcagtgagactattcacaacagtccagcaccaggtggcagtaagtcagacacattatagtcagtcagtgtttgtggagtgaaggaatgaatgagttatctgtagactctgaaggttatttcaaaggagaaagtctcatactgtcttgtgcaagggcatcatcatttgaataacttgcaacctttgaagtggtctgttttggaaagcactcccctgaatatatatgttgtagttgtagtatgtgtttaaaaaaaaaacccaaactactttttaattataccatgtttatgttatagattgttttataaaatgtataacatagctatagatacgtagatgtttggacacacacacacacagagaaaggttgaaattagtgggttttcatgggttttagtgaatcttaattttacttctgtagactgtccttttacaggtttttacttttgttttgttttgttttgttttgttttgtttgaaaagcagggctctggtactctagttttgctgtgtgagtataacacttgggacggtcacttactaccagcttcccgggatgcagaggtgtgtggcgttgccattgttggccgcacgtagttgcatttagtagtgtgttgtgcccttaaaaagttgaaattagatattctactgaatgtcttcttggccatcgctgtagacaatttggctgatgctgaaagtctgaacactgctcagaaagaagaagcggaagaaaaggagaggaaaaagattgccaggtaaccctattttcccctgacgtgtttgtccaggggctgtgttgggagccctgcaacagttgcagcctgccaggcttacccccgcatcacggcagctgcagcccccgggttgctgctttgtggatcatggttgaccatgcactgcagaccaaaacggatggaatcttgggcagaagccaggctcttggctgtcatccctcggggctgagagtgggagtcacgtgtccccatgcttaaagaatcactgcagttaattttggtgtcataaaataaatgatgcattcaatgctgattagctctcagatgagaattttaataagatggtctgtgtaatgaatccatcgcattgagattaccaggaagctctgagtttgggttgtgctaggctcttgtggttagtgttgtttctaattaaattctgtccttcattggagcattattgattcagaatcctgattagcatttttatacagagtaacatggttatttggtttcttgtgctcttttctcttctctttagaaaagagagcctagaaaataaaaagaacaacaaaccagaagtcaaccagatagccaacagtgacaacaaggtatgtattctaagatgcttctcccctttttgtttcaaaatgatcctgttgatctccatacatgtaccatttacactgtggaagtgtcttgtgtatcattcttgtaatattttggtgtgaagaatatggcacaccatatagaccctggcttcccaggggggattctggttgaatttaggcagttagttgtgtttactgatatttcaccagaaaaccaatatgataaagaattgactagtttgaccacttatgttttctttattggaattgtgcaatcagccctgacccgtggtcaggatcacgttagcatcttctgagtgggtatgaaaatcgcggatttttaatagatgtctgtttccagaggtaatcccaggatcaggtggcctcagggctatactgtaaaactgaatcccatttatgacagccctggttgttttgttctttctctgttcatcgagttgataaatgcttactgagtggctatcatgtgtcagacactgaggattcaggaatgaagaagacaggtccctgccttcatggggctcacagtctggcaggaagacaggagtatgagatgcattatcacatggtatgagtgaatgtgctggcacagggcaaggacagagccctgaatggtgctggctaaccacgactgggtcagggttcagccttcttctcacctgccctcaggccttctgtctgaagcagaatcaccatctggggacatctgcctgtccctgcacactcaaatacagatgcagctttggggaggaatccatgccctatgctggaccaccagggtgacttttcctctctgaagtgattttaagtcagtctcccctcctcccaagacgtctttgtcatcctaggttacaattgatgactatagagaagaggatgaagacaaggacccctatccgccttgcgatgtgccaggtatggtggcggaggccggagacgctggctttgctgtgtgtctttgctactgctctgtgaccacctgccgagtctgcggccagccagcccagcagcgtgcacatgagctgctgaggccaccaaggccgtgggaccagttagctcgcctttttcccatggtcacaggcagaatgtgtcactcaaattccaggtgatggggagggaaagtgcaggtgggtcagggcagtcccagcttctgctgggagactggtccaggaggccccccggtgttagcgctcacctgacacttttatatttgactggcacatttattggctgatgtgggtgggactgtggagttgggagcctaggagctgattgagactgaaagtcccacacagtttctcaggctagtctgagcgaggaggttactggggaaacagccaggtgttgggaggttggcagtgagaatctcagcactgccacctttcatctgtggtcagatcttacgctggtgggaatctcatcattcccgcaaactaaacatgctcaccagacggggacacttctcagcaccccccacccctgcaacacacactcagtccatgttctgaaggagcaggagggttttgattcatgtaagcaggtagatgttgttaaagtttaagccaaatttgcatgtgaaattaagaataattcaaacccatatgtagtctttatttcatgcctataaaaaaagtatttcatttaaagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgtaaatactccccttctagtctctcacggctgcctcttgccagtgaccctacaggttgcttgagggtggctcgggtgggggtgaggggaagtggttcacagccctttctgaacctgagtgtccctggcgccctcacccaagtcccctccaacccctctctcctccactgttgctcttgccctcagctcatctcttcctagctgcctccttcccacaggggtgtggccaggtcctgggaggagctccattctaggttctcctccctgccttcacccctgcatggggacagcaatggggaaagccttgtccaccccagcatattccagctggagctcactgctctggtgttccatgcttcggccagccgtggaaatttttcctaatgagtggatcttctgttaggatgccttgtgggatgagaatttttgtgaccaaggtccgcatagcatcctcatcctcatagatcccccacttgattgatcagttttcccaattgagttttatctttgtaaagtcatattgcacagtgatattttatgggttgtaagtattcagttcagctctatgatagtctacttaaaatagcatttctcatgttaaaatgataaggtgctcacaaggaacagggtaatgactcacaagtactataagaggaagacgtttatttactagctagtttctaggttttaaatcatctgggactgagtggaatgccaggggaaataaatggctcctggaaaggtttctagaattgcagaagtagttcttggctgtcagagaacaactctttataattcattggccctagggagacacaggtgggaagcaaggcctgctggcatcctcagagatatgaagatgtgatggtagcttttacagctcaccactgtttgggtgttctttaaaaaaaaaaggttattaaactgatattgctgacacctacagccctttgtgtgtgtgtgtgtgtttgtgtgtgtgtgtgtgtgtgtgtatgtatgtatgtatgtatatgtatatatatatacatatacatatacatatatatatgtgtgtgtatatacatatacatatacatatatatatgtgtgtgttatatatatatatatatatatgttgagggaatgcatttattttcacctaaagctacaaagcactcctgccctcactagcttggaagttctttcccagactcaactgctaaccaccttcaggtcctcaggggggtacgcccagcattaaataggcccaaaagggaggacttgaagtgaggggtcgccttacataaagttgactccagtttgaaagtggaaaaaatcttttccaaggaaaagctatctatctataatagtcttatagaatacaggaatacagataggtatatatacatatacacacgtatatactttagaatttaaacatatacatacatattttagatatacatatatacacacatatactttacaatttaaatatatgtgtatacatatatttatgtgtatgttttatatatatgttttatgtgtatacatatatgtacatatacatacataaatacatacatgtgtatatgtatatgtttaaattctaaagtcaaacattgagggtatggataaccagttgctaaccaggcgcagggcacattgaggacagcagcgaggttctgatggcccagagagccatcgtttgagcccaggtgtcaggcatgagccaccctccattgcttcacgagaccacaggacttggtgagaactctcatgccgggccatgagatccttgcatgttagcaaatgatgctccaaccttcactttctgaggactgcttgtgggtcaactccaaaatttaaaaaaataataataacatctattacaaaatctgcagacagccagagatgtcctgaagtctcagttactgcaggtcactataaatagtatgaccttgcacctgcaagacaagcctgggattcatctcattctgtgtgaactgttgagggcaggcctggcctcagtttcctctctcagtcagggaagataaacagatgagtttcttgtcatagtggaaaaacttcagtgatgtagacctggatcgattctgcccctggtccttactagtgtcactttagaattctcttattaagcctcagtttccccatcttgaggaagacaacaagccccacttccaaggacttggcagagtggtctgtgtggcacccccagcacagaggtgacacaccacccacagtccacaggttgcctttggtgggcttcgagaggctgacggacaggttgctcaggtgtgccgggcagggtgcatgggcagcacagcagacagctgccctctgcctggcctcttgctgcagtggccccacactcttaaggacccagtgtgttccaccctatctgggactgtttccaagcagcggcttttccctgcaggatccgcgtaggctgccacaagctcatcaaccaccacatcttcaccaacctcatccttgtcttcatcatgctgagcagcgctgccctggccgcagaggaccccatccgcagccactccttccggaacacggtaagtccccagggtggggctcgctctgggatagccctggcctctctcgggcagaggccactgtagagatgggagctgtggaggccctcaaggtgacagctagagtaggtctttccttcagctggggacgttggctgtttccggtttgtaagtgccagagagcttgtgttttagctgggtaaatctgaatggaatcattaacttagaacttcatcttaaatactctgcaggaacggtcagtgaattcagggagcctgcttctccgcctctttgctccctgctgctgatatttaggtcctcctttccctccctgctcaggtttacactcacccctgttttgagattcatgcctcgtggaagcacacagcagggaggaagcagaattcaaaccaggcacaccacatgcccaggctgtcttgttcagggttggaggcaagatgcctatgtcgtgtagacttaaatacaccaagctgctaggctccacgactcaggagaaatacaagttagggagatgataggatgtcaagttgaggtgttcagtggagaagaacattaggccaggtgcactggctcacacctgtaattccagtgctttgggggatagagggggaggatcactgaaggacaggagttcaagactagcctgggcaacataatgagacctaatctgtacaaaaaataaaaaaaattagctgagcgtggtgtcacatacctgcagtcccagctactcaggagactgagggaggaggatcgcttgggcccaggaggtcaaagctgcagcaagcaatgtttgcaccactgcactccagcctcagtgatacagtgagaccttgtctcaaagaaaaaaaaaagaatatataatgaatgttaaaaaatttcttctctgggaagatttattataaaatatgtgattatgttatatatttcacaagtatctccaaagaaagtgctgaccttggccccagatagccaatattaagtttgagtaacttcatgaagcagagtgcaccaggcagagccacttggacccttaagcatgttaacttagcggtttacaatattacttttcattggtagaattaggaatatacaaagagttattaattggctgggcgtggtggcttatacgtataatcccagcattttgggaggccaagacagtagaatcgcttgagcccaggagttcaagactagtctaggcaacatagtgagaccccatctatataaaaatttaaaaattagccacacgtattggcacatgcctgtcccagctacttgggaggctgaggtgggaggattgcctgagcacaggaggctgagcctgaagtcagctgtgttcacaccactgtattccagcctgggtgacagagcaagaccctgtctctaaaaaaaaaaaaaaaacaaaaagaactctagattttggtgtggcagaggtggctatccagttagccctctgtatccatgggtttggcatccatggattcaaccaaccacagatagaaaatgtttgggggtggccaggcgtggtggctcacctgtaatcccagcactttgggaggccgaagtgggtggatcgcttgaggtcaggagtttgagaccagcctggccaacatggtggaaccccgtctctactaaaaataccaaaaattagccaggtgtggtggtgcacgcctgtagtcccgactactcgggaggctgaggtatgagcagtgagctgagatcgcaccactgcactccagcctgggcaacagagtaagtgagactctgtctcaaaaagaaaaaatattttgggggaaaaaatgtactgaatttgtgcagatttttttcttgtcatttcctaaataatttacatggcatttacttgaccttgggtatcttgggaaatctagagatgatctaaagtctacaggaggatgtgcatagattatatgcaaacactacaccattttatatcagagacttgagattttggggtctgagagagtcctgcaaccaatcccttatggatactgactgtactaagaaaacaagtcaagggaccgggagcagtggctcatgcctgtaatcccagtactttgggaggccaagacaggcagatcacttgaggtcaggagttcaagacctgcctggccaacatggcgaaaccccatctctactaaaaatacaaaaattagctgggtgtggtggtctgcacctgtaatcccagctatgcaggaggctgaggcaggagaatcgcttgaacccaggaggcggaggttgcagtgaactgagatcatgccattgcattccagcctctgcgacaagagcaaaactctgtctcaaaaaaacatacaaacaaaaatacaagcaagtcaagggttttctattagttagttttgtaacttagagatggtgcccgctgactgtgtctgtgttgtaaggaaacttgcacctaaattggctcttgcctcagcagccccaccttagctgtgcagcttactcggcactgaggaccattcaaaggcaagacggctagaagcagcagcctgttgactctcaggcctagatattatcgtgcagtttcaggttattaccaagaaacccgaccagcagagggaggctggcgagtgtgcaagcatcaggtgtccctggcttgctggtgggcacctttttctgagcaccaggttgttagagattttagggttaagacacacctgcagatctgtgcctccaggactctgttgggacaaccaagcctcatgctgttgcttcccatttctggagcctggcaagccctacctatcagatttatgaaacacgcactccgatatgaagagaaaaagtgctttccccatggtgcgtgttagtgtcaatataaagaggaaggcactgggcctgtcttgatttgtcctcacagattagggtttttgttagagagggtttagttgctctagatgccccaatagaagaaagacctctgtgtcatttcattccatcataaaaaaaggacacaagggcagtgtttggaaaaaaacagcattaggtgacaaactaggccaggagctagtctaggattcgcattgacaagggattaatttacatgggggtttcatgtcttatttttaattataactgcttctccataagtttatttccctgctgccttacccaaaaatgttaccgttctgcttaaatagatgtacatatgtgtatgagtattgctttttagattctgcagtgttttgtatgttttttaaccttagccgaattcttagtttaaaaaagagagcgagagaatgcaagcagagtgagggaaaaaaacagcttaaatttcaacttcagccctggcgccaggttgccttgtagacttgtgggctgcagtgtctttctgggctactagatgctttccatgttaatattcccactgtgacctaggaaggagtaaggaaaagttggctgaggcctggcagtgcacgggaagacaccttccatagcctggccaagaaactccattacacagaagtggtcccacagaattcataagtccaaaaccagaaacagtttggaaagtgaataccctctgaagagagagactgggcttgaaacagaggtcctcgcattattgtgacacagcccccaggcgactcctctacctccaacagctcacccctgtgactcttcgctggcatacgccaggcctactccttgctctgcagtgcctgtgactagctgcgtggcctatgcgtgtgtccactccctgctcccagcagccacatctgttaaaggattaggcctgggtggtctccacagtcccttctagctctggtctcttcagttctttcaaaaccatagatcatagttgtcatgaagatcagtggccaagaccaactcgcctttgcagataagggtgctacggtcagaagctcccggtgagcagctttcctggtggtcagacttcttgctgctggcccacttgcctccacggctccgaggagaagcagggaccccagaaagggctagcaggactctgctgatgggataatagatggtattgtcaccaatgaggatagagttgcctggactgaaaattcaaagaccaggtcagtctgttatttgagtgggcccagcaaggttttttaaaaaaaaccctgagtttagagagagcagtgtgagatgcagaacaacgggcaggagtgctggagaccaccaatgcaggagtctgtaaaaccatcccttgcagacttagccagcccagcgcatgagcagggaagggtgctgacgccctgattacacaggctggaatgcgagggggcatatggaagctactggctccgacagatgccgctgccatcttcatttatgcttctccaccaatctgatgctcagatggagggcaacatacttcattcagccagaaacgcggttaaaaatcgaaaatgtgtataagcctctaatttatttggtgccacaagtcgtttgtagatgtagcactctctgatgagaaaagcttgttaacaaagcactcttagaaatgagcctctctgcctgtccaagacacaagactgggaagcaagtcggtgagtggttaaaggaggtcaggattctcaaacgctctttgggaatgatgtaattgaccaaagtgggcattcacccgtggctctgcacttaccttcagaatggcagggttttcctggagggatgggtctctgactggatcgggggtttctgcctgtaagcatgcagatgtcagagtttgtctgaattccttttctcactcccacatgttgtgccttgcagatactgggttactttgactatgccttcacagccatctttactgttgagatcctgttgaaggtaatgaattttccttgatcttcacatactccacagcagctggagcaataatagttgcacttctttgtttgccttccagatgctaggttacgcagactatgtcttcactggtacttttgcatttgagatcattttaaaggtaacaggttacccggcagtgtgtttaagggctgctcctgcgtgtgacacacaggaaagaagcgtggagtgcttttgattttttatgggttttttttttgtctttcgtggttgagctaagttttttttttttgttttttaaaccgaaggatttttttttcctgtgaccattccaacttgtttttgctctttttaacctttgaatgcatgtaggagccactctggcttcatgatagtggttgagaattacattttgctcatttaaaaaaaataccctctgtaatttgtcaactgataacacatatatctctatgtgtgaacttttttccaccctttctgacatcaaagtcagaggaaaagcatttatcctatgaagaggatgtctctctttttgtttctctgactgcattatgcttttggggacctaaaatagtaacacactattttcttgcaataggatttgcaagatgacttgggtctatttgtgttaaggtattttctgtctgttttaatggatgggcttacatttacacaaaaggagcgccctttggccggggtgacctaaatgtactgcccatgcatgagctaatggctgccattgctgcttgtggtttgtggactgactgtgaagtctgccccatggggagcccattccttatgtgcttagagtgctggagaccacagcagagctccaagaacctatccaaaactggccaagaaccacagggcgtgggtcattgtggttctgggagaacgtggcccatcagaactgtcagggcaaccatctcctagcaggaagacaagctgggaaatgaagacttttaaccatggttttctttaagccattggggaatttttgtgtgtgcaattcaggcaaaatgtattttgcatcggactactgtggaacttgggctctttacaaaatcttatataaaatgaaacttcaattaatatggtcagggaatgaggtggttagttttttgaggttggtttttttatttttttattttttggttcatgaaacagcataaagccaaccaacaactgtttacccctttcttaaaagtcttctaaaaatgtgagttcattttcctgcctttaagccgatgaatttggttgacacttctcctaagtcagaggtgtgcagtgggatggtgaccagctcttgttgatgaggcctctgtgggagggcctgtggatgcagaatgcacagtggtgggggtcggagggatgccgccagaacactcaccggctcagcttctgcctcagcttcttggttttagaatttgacttcttttcaaagtgaatggggagctgttctacttagtctgttagcctggttaattgaggttttattttactctccacattttttagttgttaaatgaatatagttacccttgggctttggggaaaattagacacaggattatttaaaaggaaaaaaatgattgttactttttaatttctgtagaattgcttcaccgacttaaatcttctgagtcattcttcattttgaaggtattttagagaatggaaaataagctaaaacaagaaggattcagaaaatggagactcaccaagaagtgtctaatatctgagacgatggttcctggtggccttggggacatttggaaggctgtttggttatttgcttaagccctatgaaattgccatttttgtaggtcaaaaagggttgaacactggcgatttcataaggttcaatgtaatatttcccacctctacctctcttatactgtacttacctgagccttctccaaccttttttgttttaaaataaatagtgagctgtatatattttgctatttttactttggggaactaaactctttttccatcaccaatagaaatctcactgaagcacccataataggtgctccaggtacatgtggcaggtgagcacagagccgttgagactggctcaggtgagatgccacctggcttcctagccatgcctggcacgtgtcatcagacttggaggaattgcttaagatggatgcgtcattaaagaccattaggaacaataaggggcctctgtggaaaagtgacgtaggtccatagagcctgggagccctgaattcaagcccccactggaaaggcttaattgaaacaaggtaggctctaccagggcctcagaggggccagaaccagcgctttgtggggaagtgggctctccggacagcacttaccttttgacgaatgtagtcctgtggagcctctcttagacaggctctttggacatgccaacagtgtattcatacttgaaacctgtgatcactgtaataaagcctaaattggtttcttcttttaaaatgtatccaaaataagctggccctttttgattttggtttgaagaaattatcctgtggctcaaccccgttggtttacatttctgacttcttaatgcacacttgttaatgaagttatactttcctcaagattttgcaaagagcccaggtttcttttcctctggagacaaaaaatggtaaatcatccatgattctgcttctagatgacaacttttggagctttcctccacaaaggggccttctgcaggaactacttcaatttgctggatatgctggtggttggggtgtctctggtgtcatttgggattcagtaagtattctggggtgtgtgcccagaattgctgggctgaatggtttatgtaagggattttaacataattgataaaggctgggcatcattttcatgattatatttagttatataggtttatttaatttgctcccattccagaaagatttaaacaattcatgttttcttgtgtgtgtgtgtttttttctttttgtgcctgctgctaagttgagcttattactgtctgtgaaatttgctttcaactgaggtgaaagaagtgttgactaggagggagggaatctaggttctagtcctggttcctccaaaggctgattccagggccttgagggcatcctctctcaggaaccctgtgccccttttatataggaggggctggggccaggtggcctttcagtttttccagcttagatattgagaacttcctttgattttcaggatatagaacctgctaggactttttctttggcctcaaaatttttcagctaggagggagccaaggctgaaagtcagggccccaggtcttttccatggcatttagcgatttctggtgggaacagccattgctgagtactgcttaccatccccaggggtgtggggcagaggctccagtagagcatcaggtgtggccttgctttcttgctggcctgtgagcacttctgttcaggtgctgagcatagaatctcccctgtatgagcacacatgcacacacctgccctctaagctaaagagaagtggaaaggacctgccctcctaggaagaccaaaaacctctgcttggaacagccctttgtgttatccttctcgcctgccactgagggaaccctgtgatcatagcttggaaggccatttgcattaacatctttgcagctcctattaactcccaggctgttcatgtccaagctgcagccttgcccacttcctcctgagcatgtgttctggccacactcagccacctagggtaaagcagaaagctgcattctcttgtgtcgcatctttgtacatgctgctccctcacactggagcccccctccctattgtcctcgctaacccctactcctcctttgggactcacctggctatcaccacccccaccccagagtccttcccaggctccccctgccccacccccacaggttgtgctcccctggctgagcacaccacatttacccccgtcatgtgccacactgggttgggattgcccatctctccaccagactgtgagctccttgaaggccagagaagccctggtaccaaagtgctacagcagacctccaaccttaaacaaaaacaaatgatatatgaagcctaaaagccagctactacctagtatttacagtgagtggaaagaacaaagagagttcgtgagttgtgtctctgccaaggttagctgtgcacctgtcagcctctgtgagtgccatgggctgggcttgggaggtgctgcctcgtgtgggcggggaggagaagtcgcctctgagtcgtgaagagagatcagctcagcaccacatggatcccacgctaactgtgcagggatactaaagtgaagatccagtgaaagggtgaatctcaaagcatcctgtccatttataacacgctctgcctgccgtctttctgctccttccctagatccagtgccatctccgttgtgaagattctgagggtcttaagggtcctgcgtcccctcagggccatcaacagagcaaaaggacttaaggttttgattcctctcctccctgctgggctggcttgggttggggttggctgtaattactggctcttctgggcagagctgagctgaggcctgatggatttttaaagtgagttataaggacctttctaaccaattcagccacctgtgccaagtgctaatggcattttaaaaattattatttattgtctttatttttggtaattgaagatatttttctttgtaattattgttcatttattacctttttattagtagttctttgtgtttattttagtcttttatttagtttatttagtctttcagttttcatgtagactgtataaaaggctactgggtttctgttttcctgagtcatttatggggtggggaccctttgggcccatgtgccaggcagcactgcacctgtagcatttcttctttttttttttttctttgaaacggagtcttgctctgttgcccaggctagagtgcagtggtgtgatctcggctcactacaacctctgcctcctggggtcaagcaattcccctgcctcagcctcctcagtagctgggattacaggtgcacaccaccacgcccagctaatttttgtatttttagtacagatggggtttcaccatgttggccaggctggtctcaaactcctgacctcaagtgatctgcccacttctgcctcccaaagtgctgggattagaggtgtgagccactgtgcctggccaacacagaaactctcggctgatgttagctcacctcaaggccaaaatcacaaagaagagtcacgcccctctgccctctccgcagcacgtggtccagtgcgtcttcgtggccatccggaccatcggcaacatcatgatcgtcaccaccctcctgcagttcatgtttgcctgtatcggggtccagttgttcaaggtagaggaactgcctccaagcataaaactcaggtggatttctttaaggagaagcctgcatttacttaactgcctgtctattttatacccaggggaagttctatcgctgtacggatgaagccaaaagtaaccctgaagaatgcaggtgagcgtcctgagagtggagtaggggacttagaagagcaaatagcagacttcaaggattcacacatgttggcacgtcagaagttttggtcgtgaaataaaataggcctgtgtgctcagcttgtgggtagatagatggtgtttgtttttcattgaggtgaaattcacgtaacatcaactgttttcagtatacagttccttagcatatagtatccatggcattgttgtgcaaccaacatctctatctagttgcaaactttttgtcatcccaaaagaatggctagatggcttttgtggtggagaatctataaatgacgggagttgggggaaccctgaaataacaattatgaaatgccccaaatagcttccatgacagccatgtggatgatttccccaaatcagaatttggaactcaactccctggtgtttgggaactggctccctcttcttatacactttctagacttcctctctcctggctcctattacctacatcttggccatatttccatagacaagaactggcagaggagagacaaggtgggagatattcatgcctcccattccaggatgtccagtgaccatgaaggcagtcatggaagccattgcctaaagtttcagactgtgcagaggcctgtgtctccccacccgcgagagacataactgactgggctctggctgactgtgcctgtacattggtttggggtttattttaagcagaaggtgcagtcagagagcaccaattgcaatttggctgtgtttctgcacctccagaggcaccgttcacacaccgttcatggcgtccctggaggtgagcagcctggcattggcgtgaggacactgtttcttccctcttgaagcctctgtgtcttcatttgtaaaataaagatattgcgctttatctcttgggttccttccagaaatgaagttctgggagaaataatttgccagaaataatgcaattctttcggaaagaaaattgggaatgtcattagtaagaagagaaagggatttgattaaaactaaaatgcaggaagagtatacgtgggtttgtttcctagagcctacagagttctctatggctgagctttgatccttcagagcgcgcctcaagcccattgtgtaagagatgcactcaccatgctgtggtttttatcggccaacgacatatgcccggtgtctgggtggctgctctggagaatacacgttgcactggtagttattcaatggttatttgagccgcgaagtagattaaatggagggcgaggagaggagaaacggcgccggtgttatgctcagctgtgtgacaggcgggcggactgagtgtgacctgcctggaggttggattggggcagtgtgtccaactttacgctgcttccacctgtcatgtgtgaagccagacgacccacacctgttttcctctccaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgtaagtacagggagcacacagtcttctggagaggcacctgcgtgcccagggctgagccctccctcctggagtcagtcccatttctgttctccagtgtcgcaggattgccctgtggctttttaaccttgggccacttctcagtcacttcttgacccacagggcctctttctgtgtaggtggatgatttgtgaagcagggttggtagaggtgcctggcagcatctctgggtggaagcagggaggcctgagatgcctcagtcccgtgaactcccattggatgtcaggaaagctgccatccgctgctcccaaagagggtctgaatggtgtcccaaaccattcattcattcattcattcattcattcattctaatatattcccagttgcggacagttgctgttatgccatctcttttactgagcacctgctcgctcatttacagaccatgctgtgcagaggcttgtgtctccccacccgttagaaatgtctaactgggctctggctgactgcgtgcttagataccagctctgtgcaacatggcatgttaggcactgtggaggaaacagtgtctaaacatgcttcctctcctcaagcccaaatcaaatcagtgtcaagtggtcaaaccaggcaggtggtctggtgtgtcctagatgtgcagaacagggtcctgaagaatggctaagatgttgatgggtaaagtaagaagagcaggtaaggagaagttagaatttgaaagggagaatcctctgtgctttcgtgttgctctttgcttctggagctcccacccccagctcctgccatcagtgtgcaaacacacctagagtcctggatacccggtccccatgcatagatgagctgcaggaggtgggcaggctggggctcgcaggccagcagagttcttggggtgtgtgtaagagtcagatattttcaggagctcctgtaggataaagagacagtcaggtggggcttgttcattagggatttaatcctgggagaacagaggcatggagtaaggcccttcactgtgtgcaggcacaggctatagtgtcaggctttgaacactgtacttgagcaaatcatggtggcagctgaggagaaaggagcaaacctgggactcggggcttggaggaactggctcaactcctggctctgcccccaaggagtgtgactgtggcactttgatacctccctgaatattcctatgatggggatgatagtaatgtctgccttcccagatggatgtgaggattaagggagaggctgtgaaagtgtctcgggaagcctatgcatgggctgggtgccccagaagtgttgaatctgcatcagaatggggatcaatggaccccaagggtgttacagtaatccccctcttcctgttaagagttccgctaggcatagctttaattttagtgcatatctctgtttggggaagcacccttagttctttggaactactctggttggtcacttactgtcttgccagtgtgcatagttttcacttcctccagtgtcttacacgtgatattcttcctctctgaatagaaaggagtgttttaggatatttgtgaaatcttttgattttcagttcctcagaacagtccctcgatgatgatatcctgggtgccccctcctcttagtgctggctgtttgggcctgaggctgatgggagagacctggttgtgtccagcagccttggggtgggttcccagcgagtgctcatgagaggagttctggagagggaggacctgggaaggcagcgggctgggccgtgtgggctggggggcttggcaggtcctcacttggtttttctctctctaggttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcaggttaaagtcacacactgttttggcttctgtcccttggtcaggagcggagtgccttctttattgactgatttcccccatacccagagaagggcacccacatactgtctgtccctggggctagggccctgttctaagcacaccctcagcccatttgagtcatcactgctgagcgttaggtttcccgatacatatgagactttgtaattatgaaatccatcgccagacctggtggtatgaaatcagagagtgcttacgccacctgccatggtcatgacccactagtgatggctcagaatcttagttggggtgctgtggccactcacacagacattcacagtccctactgggagatggtctttaaagccacttagggcagtttcttacccttggtgctattagcatttcagtctgggatgattcttggttgtgtttcctgggctttttaggctgtttagcagcatccgtggcttccagctgttagatgccaatggttcgtcttcccctggtagcagtaaccaaaatgtctccagacattgccaagtgtcctttggggggcaaagctgccccttgttgagaactgctgaccgaggggggaataccctgcatcaccccagggaagtcagtaactttgaatttgggactaagattgtattggcatcattcttgatctgacaccgtgttttagccagtctggtagaagtaggagccttttgctcgggtgacgtggtgaggagagggagccctgtgctctgggctatcttcctacacctgcactgtgaccctaggtgccctctgatccctgctggggcttgatccctcatctctaaatcgagggcattaaggagctgctctttagagattccttgcagccctgaaagagtctacaagatcgagattcttttctgggagtttccccgggtcctctatcagtagcatctctgttttgatgacgacgtcgcaagcaagaatgatctggtagcctaggcttcctcagaggaagtggcccgggcacggcaagccaaccatagctggctgtacccactgggaaatgtgagaacatgccggtttgtgtttgcaggaagattttcctttgagttgtcagggtgtccctgtagactccaccagtgattgtcagggagaggtctggcccagcaatttgctcacccaaggaagaggagtgtcagagcaaggccaggccagccacgcagagccagcgctgaaagtgtgtcagcctctgaggtccagcacaggcttgaattgggggtccctggagtgagcatgtgaggtcagagcagcgccgggtcccagacactgggaacctgtccgaagcctgcacccagagtcaaagcaggagagcgggggtaggtctaggctctcaatgctgagctgagggctcttggggctagaggttccctctgggcctgctgcagagggtggaccagccccactacccagagtaagtgagaaagtgctccagctgggtcccaacctgtgttcaatccaattgtcactacagtgctccagctgggccctaaactgcgtccaatcaatccagctgtcgctacagtgctccagctgggccccaacctgtgttcaatccagctgtcactactgaccacatcctagggattctgaaatgaacacaacaagctccccagcccagaagctccccgatggacatgtggatagctccccataagatgtgtattgttaacacactctggctcctgaagggtatctcatgtggttccaactgggagcatccaggaggctactagtcttggggaatgagccagcccctctcgttcttgtgagtttctgtggttacttggcctcctttcctggaggacagcacaggcaggggaactataggtgtgatccacctatagatcccccgtatgtgtgataaagaggaaaggcagtgataaggcctggacccagtcctcactcctgcttgtgtatacactgcagggcctcaggaaagacagctaaaagctctgagcctcagtttttagtaagcaaaatggaagccacatgggtaggtacccagcttacccggagcttgctgggagggtcagcgaaggtaatggaggcagggccctcggtgactcaagagtggtgccagcagcaggaagggggtcactcgtaatcattttcaccatcgtccacggccccttcccgggagctgtagggtgagctctttcagagcagatgaccacggggtcctccttccctgcaagtgctcagaaccccgtttctgcccttttctgctgttgcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcaggtaaaaatggagacagccgtggggatcaggtccgggcattccgcacagccccgtgccccaaatgctgagggtggaatgctgcccctcacaggaggggtttgatttttctgatgagtctgggctataggttggccagagttctgttctggctgacagttgtcacggtaggagtttaagatagttcttttgttgaagaaattatccgtacagcatgatggtaggtaacatttccatggagcctggcattggtgctcaattctgtaaacatttaccatgggcctcctgtggccagctagtggttgagaactacagctctggagatacacagctgtttcaatcctgattttactctgaattttttgtgacttggggaaagttgtttaaattccccgaggcttgatttctttatcagtaaaatggggaaatctgtcacacctacgttagagataaggtttatgctgtagataattcccctcagacactttgttttttattttttgccttttgtttttgaggcagtctcactctgtagcccaggctggagtgcagtagcgcgatctcggctcactgcaacctccgcctcctgggttcaagtgattctcatgcctcagcattctgagtagctacgattacaggcatatgccaccatgcccagctaattttgtatttttagtagagacagggtttcaccacgttggccaggctggtcccgaactcgtgacctcaggtgatccgttgcctcagcctcccaaagtgctggtattacaggcgtgagccaccgcgcccggcacctttggacactttgatctgggcctgtcacagagtaacactcaatgttggaaaacaaaacataagtcacactcctgtcctcaggtggctctcagcatggcagtagggaattttccagttgatgaagtgttgagtttgacctgagttacagctacttcttattccagtgggggcaagaaatgcaattgagtttaattggccaagtcagattatagtatggtattaacagcgaatgttttcaaaagttacattgcctagtagatactctacgaggacaggaagcaaagaccaaggtctagagccagcttttgcactgactttaagaactccagcacatcaaaccagctctcagtgctgtctggacagtaggtctaaagatagggataaattttctggcatttttcttaacctaagagttctttttgaatgaaaaggactgtgtgctgacgtagaagaaagtgtaaaatcaagaaaacactgccttttattcaacataaacttacatggcataaaatttatccctaaccaaattctacctctattcatagacattttggtggtatctgcattgtgctctggtcaaggccctcaacataaagccctgccagaagaaagggtgaattccctttatcctgagcagaggaaatggatatgttttcccccttcatcattcaatcatcctcatcttgtcacagaccctcctgcactttgtgggagttcaccacatgaccttgcaatgccggtggaattgcccagcgagggtgctgggctgtggaggatgcccacaggggcacagagggctgggagcctccatgtgcaagcatgtgagatcgtggctgaggctctgagaacggtccctctgtcttcatccatagcactacgagcagtccaagatgttcaatgatgccatggacattctgaacatggtcttcaccggggtgttcaccgtcgagatggttttgaaagtcatcgcatttaagcctaaggtgagttgcagaacccacttttcaaaggttgttgctgagtcaccctagagaagtacccgcttcctgttagtcttgtgttactgaattatgctaaagtgttctggccgctaactgggttaccacctgagaacattaaaatctgattagagcatgtgtgtatatatgggaaaatgaatctgcaagaacaaaacctcatgaaaacaattctgagaaacagaagcagggagattagaattgggaatttgtaaactgcagattattttgaaagccagttttctgtttctagaatagtacatatcatgctgtgtcagggaaacctgcctcattacttgagcactagagaaaatgtttgaacataacccatcagaaagaatttgaccctgattatactttcagatatctagtctaaagactttgttttgtttgttcttggtctgcagcatcctttttaccctttaagggaagtgctgataccagctgcagacctctcacagccataccatcttttgtttgcttaatttagaaaaatttcacttgactttaacacaaaatgagacatgaaatgtgttcaactgtgctcgacgactcagcgtgttgtacccctttgggagggagtgaattcagttccccacttgtcagtggctgccagatgaggggcagtgtagttcagtgtcaaattgcatagttgtggaactggactggattcaaatctctactctggcacttacagctgaaacaagttcctttcttccctgcgcctcgacttcctcacccataaaatgaggacgctaatagtgctgtttcatggggttgtcatgaggagtaaagagttcccatatacgcactgcttaacagagtgcctggcatgtagcgccacgctgcggactgtcggccactgctgttcctacccgcaccaccaccctcatcatcatcaagcaaggatgttccctcattctaaaagcctagacagaagagccacaccaagctgaaatgtgggatatttggccctcattttctttcccagtacagccaaaaactctcagagttagagatgacagagttcagtgacccagttagttatctctgtgtaaggtatctgacgacactgatttaattaagttaggcatggattatgaaatggatggtttcacatactccatagttacatgaaattctaattccaaactgttcctttctttaatttgaattaatctctatgcaatctttatcagatctttgtggaccaaaaagaaaggacatttgtaagtgattaattggggtgattgcagtggggtcaaatttggcacctaatgcatggccagatgttattatctactgtgacttgtccatatctacatacataaacatttcctccttttccaaattcatcttaatttcctttgagattttggtttgcttccctctcacctttacttctttgaacaatatttgtctggactgatggaaaaggttgcaaagtaagaacatcgaaggtacttgagaaatgcaacatggaacctctctgtggaacatttcccagatacctgggccatgtcttcccttgccagatgattaagctctgaagtttttgaaagcttgctctaggctgaagagaaagcacactcacccatggtgtgtatgtgtgtgtgtcagtgtgtgtgtgtgcacatgcgtgtgtgttcatgtgtgtgcttgctcccttcagccggccagtgcattgacagcccagtagtgcactgcccagtaggctgacagttgcccagaagatctccaaacctgggaggagagttcagtagcgcgtgaacagataggcgataccaaagggaagtgagtagctaagctataatcagtactgatagatcggagtttttaaatggttgatttctgctggaaattgtactgcttgtagtttcactcagcaagatatcttcatagcattagacaacctcacgttacaattgggagaacttttaagacagtagcagcagcatctccacacttgaagagcactgtcactgcgttccccccggccaggggaggttgagtttatatcgtgtgccgggatgagtgggagagtatcggttcaccaagaagcaatgccctccttaaaatttttcctgccctttttttcttgctcttctctttggtgttcacaagcccagcccgagcaagtggtctttcacaaagaagccagggaggcctcctccctcctggtcggtggggtagtcgggctgaagaacaaggttgtcaaggctgcagaaggaggaatattctgaggagatggccacatgggacctcagcctcctctcaggagagcctttgtctcatgggaggagctttgtaacagggtccctcatggcagagttctccactgagtcaggtacaccttctagcaggactcgtcagtatctctgttaggggacacaggctggcagagtttcagttgcttcataaaataagtatagaaagtgaggtaagacaaaattcttactggtaggtgagaaggcatttcaagagggaacggttaaagaaagttgagaaatctgaccttaaggacttattttatataagggagcttgatggagaaactgggcctcctaagagagtatatttagagggaaatggcccaaggtcatgggagatgagatgacccagcctctgccaacccagagggaggtgggaagtagacagagggagaaaactccgagctggaagcctccatgatggaagaggccatctcacctcaggggaggaggcattttggagcactggtcaggcaagagtggaaggtagttaggagccgaagcgcaaaagcatccgggaaaagcaagcaggtgatttagccgattgtgggttcccgaagggaaagttcaccagctgggtgttgacctggtgcagcctaggtcctgctttcaacttggggtcaactagacctctgtagggttttcaaaagcaggccctagtttaggtgacacaagccccattctccaagcctttccctccagctgctagaattctccaacaagttctcttgctccaaggaggaagattgattaagaagggcctttttcaaagtgctggctgcagcaggtatagagagcacttctgtggagtaagaagagcctggtctgtctgggattctctttgtgggatgttacccatctggcgttttgtccaggctgcattctaggccatgttgtttgctgcggttactggccttctccagtgagccatacttcgttcccatcttagtcctttaaagtgttttgatcttgattctaccctgaaaatatactaatttatactcctagctacttgggctggaaaaagtaaggagaaattaggtttggggaaagaagaaagtgttttggtgctgtcctcatgctgctgtgcagagctgatgcagaatgggcactgagtcctcatctgccttcaagggctctgttcgctgctccagggtcccttgcaagagtagagcttcttcatgatcttcctagagtaccttttccacctgctggagagaaaatttgacactgtttttttttcagttcttcatgaccccatctgttctagatttacttttaatggcaaataatacttgaaaccaagtattactgtccttagaactttacattgggcttcttgttgggctccatcctgtccttttgacattgaggtttcccagagccctctcctggtccccttcttgcctggtaagatgcatacatgccagagcgtcagtggccgcctctgtggcatgcagacctgcactgcccttctctctcctgagcttctatgcctccctgccttcaaaatgatctccctgcctctggcctcagcccttctacctactccctttgtaagcccaaagctgaccagaccactcttgcagtgatattttggcactggccacctattgcttgagaaagcatatacaattttcttagtcgaatattcaaagtcctccatgaagcactggcccctgtatatttctgcctcatttcctgccattccctccctgctatttcttcgtccccaccccatccccaagtgttggcatgctagacctttccctgcccatgcgcctctgtctagataccctgcttcctctttgttatccttgaaggcctgtgggaaatgttatcttctctgagacagcatcctcaccccagccagagccagccctgtcctctgctcatgcatccgttgggggcctactatgcaccatcgttaccaacactactccatgtctgcctctctgtttgttggtgagcagctgcttgaggtctcaggctgagtcttctgcttctggctctgtggtacctcacatgatgcctggtggtagcttcctggtggtagctcagtaagattggtggaatgaagaaaggaataaagggatgatcctggaagtgcagcctctgggcatgagacgatacctgcttttctgtcgcagggtatctgggtagagcagagtggagcacatcttcccttaattccccgcttacctttggaaaggcttttgctagttagaaagctgtcaggcatagtttctaccaaaagttggcactttgggttatcacttgggtcaaatgctacccaaataatccctgccagcatgggtaagagatctggctgccatgatcaatgacaaaaggcacattatttatataggcttctaccgatctgcagatgggagtgaatccaggcagcaaaaggaatctgaacttgggtcacttttcttgtttcccatttgcaaccgttccacaaacattgcccccttaccatgtgcaacgcctgtgccatatcctggcaagagggccaggaataagagatgtgccttccaggagcccactgtccagcaggagacaaacattgatggatggtgacaatagggttcttagacatagtggtgcttcctgaccctgaggcccacattagtctggtttatgattttaaatttccagagtcagaaatgtttctgcgcaatacatattgcatgtggctgacttgtttggtcttttcagacaggtagagctggacacaaaaataatatagatttgactgctggttccacttgagaggttctggcctcagaattcagttgtaggagaacacatcatcataggccaagaggagagagcagggagaggggccctctgttaggagccgtgtcatttcttgtatcttatcttctggttacaaaggcaatatggtgcctttggtgggagaagggtgggggaactgagtcatgccacttgacggtgattttattaaacaagaggctactaaatagggaaacagtatgtgggaagaatgggagggctgacattttctccctcccctggactcctgtcagagccacctggtcagagcctgtgatttcagccacctgccttctgcttcctagattaagggtgtcaaccttcagtccatcaatcattccaatttgggcacagttttatgagtgtgaggggtttctggagagagagtcaatgaaattgccaaaaaattccaagaccccaaggaaatattaagcccctattgtgttgatttaaacggattttatccatcacagtgcaccagcattgagaatatcttataggctgatggaaatggcctgaaggggagaacactgataattctggagagagggagagaggagctgttcaggaataaaatctcaaagtcagaggctggcctccagcacccatgtggtgggtttggcctttgggaaatgacataaataatggagagaagcggcgcacacggtacaaatgcaggcggggctggggcacgcaccacagcaggtgcgaagggcgaacgctgggtctcctccgccttgtcagtactctggaggtctagttgctacttgtgaccaagtttttgatcaaggtgtaaattccttcctagaggggaggggaaggatcactgtgctttctttagcttttgagttactcttaactccatgaagaaaagggcaggctctgcccctccaagtgtggtctgtggcactgccaccagtcagagaactgcttgttatccattcgcaacaagagctgtcagctctaacactaagcacattgattcagctggctttcttgttaggagacttcttggacgaaggaaactgctgtgttcccttacaacctgaggctagctcttgatctcacctctgactgctagtctagacctcaaaggcagcccatctctgctcagttttgccagccaagaatcatgaattcatgcaaaggaaagctagaaagcataagctgtgctgtttttaaaatagcccttcccattagacttttatacatagatcatcagatttggggctcacaaattccttttgtctgctgatagatgggccagggagggtagcagtcagtgagggtaaaatgggagagaggcactgtgatcatagggcggggagagaggtggagagttggttagaaaccacggcggttgggtgggggaatcttacattattaagattaaatttaagaagcaaacccgaagtcagtgtcgtagctcccccataaatgcacctagactgatggatggtgactagaataaacatccctactccagctgttaggacagtcagtacgtccacatcttctatactgtcgcaaaaggctgtggttctgcagtggcttcttctgggtctgtgtttgatcacaagtttctgggacctgacacctcaaagtactttttgttctggttttcttaatgcagcactaaatgtaccccgttgtaaacaggctgggccccattttatataatatgtacctgaattttcatttccaaaaagcgtccagactctttggaaaaacacagttggtttatagacagagctgttgatcttgacagtcagtccgttgcctctttggctgtctgtgcagtatctccccaccaccctctccaaccgggagcttcccaggggtgtcgagagaccacaggcactcatttagcacctgctgtgctgatgctggaagaagatgtaaaatgtccggcacatacatatagattttaagttacaattgtggggatgttgtaccctcaaaattgttgcaagatagcaggacctgaacaaacaaccagacaaagctggatgacaggcagggtgcaagttggtggacaaaggggacattgcacatgtcaagcactgactgggttcaaggctctggctagataatggggttagggaagttgggggactgaatatgcagcacagtcatcatccttcagggcttttgattggtagagctgcagacaaagaccccacattcagccatcagtacgtaagagattcagcgtcagcctgagggagtgcagacagccgggactgcgaaggttccatcagggaacatttatctgaccttgaagaagggtgaagttgaacagatggagttggggttaggcaattaggattgcagagacatcaggaggtggggaggaacctggtgctattttcgaaggatgggaaggactcctctcagcctagagggtgaaaagtgggagggaaagaaagcaaaagctgagatggaagaaggagcctattggcttctttgaaggacagagggagccctggaacatcctcttcattccatactcttttctactatagagcctgccttgacttccccacactaagcaccacccccatgacaaggagccagtgtctctgccacgacgctgtgcctcacggtgcctgtgtccccgtaagccattatctacccgtctgtgtcgtctacactgagagttctttgaagacagggacttgtctcagtcatcctgccacaaggcatggcctttgtaatacaggctggacttgcgaggactggagagcattgctggcccatttgaaggagcacagaaatggaaatgtgtgcaatacctggtgacagtgctctttaagtggggtgaatggagattctaaggaaggagtccatcagatcgtgagggtttgggatcatccctctgggtaccaggacaaggttgccaaaatgccttcctctgccctgtagatatcctgcttggtttggtgccactcaggaccgtgagtgtgtgtgtgtgtgtgtgtatgcacacgtgcgtgtgtgcgtgggcgtgcaccttctctcacacataaaggtgcacaaccaccctgctgtgcccctttccaccagtggacagtattgttacttcccctttggctttcccaccctacctgggtgccatgggtgcggcagggactcggattcgcccctatacggtccgtgtggtgggtcattcatacatgctcataaacatctgccctcgcctgctctgtccaggggtattttagtgacgcctggaacacgtttgactccctcatcgtaatcggcagcattatagacgtggccctcagcgaagcagacgtgagtatgcacctggcgtggccgccacctgtgtcctctctcctctgtctgtgcatactccgctccctgccctgcagtggcatcacctggacaagtcacagatcccagtcacttgatctgaaactaggatttcctaatgagagctgtaggcaagacgtgtttcagggtagagccttatcccagggccttttgtagacacaaatcaccttttggaggacaggcctttttgcagcatttaccctggtcactagtaggcaaggtaagataggatgtctctaattgttttcatttgctgtgtcagaagtgatacccacagtggcgtatctataacatgtttattttagggggatgtttcaagtcgccgtgtggcgcgatgctagaatgttccccttttgtaacactgtccttttcttcttttttcctgtggtgcttcctctcctctgtggcttctgaatgcttgccctaacagcactatttcactgatgcatggaacacttttgatgccttaattgttgttggtagcgtcgttgatattgctataactgaagtgaatgtaagtagcaaactttgtgtcctatatcatggttgttttcattaagtctgacatagaagagactagaggccctgcccttaaatctccacacactttagaaatccagacacaaatttattttgaaagactaaggataatttgtagtttcctctatctcaccccatctctatctccttcccctgaaaaagagtggggaagtctatgtagaattgccttttggaactagaatagtatttcaaaagatctaattaaagttataagggctgggagttaattgtgtgtccgtgtgaatgttgtcactcaccagtcgtgtgaccgtggaagtcatccgagtgctatgtgcctcagtctttccagctgtacatggagttactgatgtgcaccctcgtccccgcaatggttctgtgagggcacaggcaggagaccccacagccagctatgccctgagcctgtggtggctgctgctggtgccctcacctgtaccgtgtctgctctgagtctgactggtgacactggtgaacgtcccacacccaaagggtgatgccagccagtggaaggctgcttggggccagggaaaagagggccgagtgcaaaccagggagagggtgtcagtccgcctttgttacatccagtagattcacttgagggggaacaagtgcagtagtggcattgtagatggagtgaaccactctccctagaagcactctgagcacctctccccctgcaaaattaagaagcgtgagaaagggagcccctccttctgcctggctccccttgggtctgacccatgctagaccggaaggcctcaggcaggcagaaagggccctgtctacctgatctgttcccagttcatcagcaagtcttagtgggcgtccagtgtgtgtgccgagcctgtgcagagcctttcgagagagtgggcggagcacggggagggactgttgtgtggtattggcttttgctccacaatgtccagcccaccccctgcccctgatgctctgcctggtgacatctgcaggattgaggattataaggtccatcctggtgcccagacagcctgcatcacacaaggactgtgaaatccctgtatgccacctatctgggtccatgctgatcctggcgtgtgaatagtaagacagccaccagcctggcagtcctaagacctggcagttgcagccctagttccaaactgacttggattccagctccctcatgggccaagtggggtgaataacatctgcccccttgctgcagatatgttatagtgataaaatgatcggaatattcgggaaaatgcttgctaaaaaccccaaagttttagggagatacaagttttgtattattctaagtgtagattttccctgtaataagtaaaacagactgtcagacgtgactgtgcccatgagggtgtgatttaagcctcgtcatgccacgctatgaccaggcactcagatggtattttgctagacctaggtatacacatattccaacttctaaagcccagacatgtaaattctacttcatgtgaaatgttccatgtgtcagctataaaattgccattcagatatgtaaatgatgcttggttgtaaaataagctggtgctaatgggagaacagcaggtccctaactgggctgccctgagctctctccgaagtttatggctagacatctgccaccttaatcatctcacaacgcaaagtgcttacaatctactcggaggtatatttacatgaaaattctggaacatacccttctgtgagccagagatggcctataatggaagcgaaaatacaataaaccagcagcagggcagatctccctggactgctcagcacttcaagtgctgtgcaggtggtgggtgtaaacacttagcttccgggcaccaggatgtggccaaggtctgtccacctggggacacccagctttctcacgcctgacctgcctgctggctggcaggggtgtagcacccatgtactcagggacagcacgcgcccggcttcctggctgcctcacgtgtgctgcaggctggccctgctcctcccgctgcccctgtcccctgtggcccagctttgctcatcagtgtatcagtgttgctgtgttcaccttgcaccagtcaggaaaggggcaggtctacgctgaagtttctagttagcatttgacattggggtatctgtgcaacacaggctttcagggggccccttcttggcatgcaattaaactttcaaaatcacctaggcagacactcccatagtgtgctttcagtcagtgacctttttcctggtcagctgtggcctgagaccagatatattcctcagccatggcaatgccagttccctaccccaggccagcagaacaccaccttcagaaatctcagtgtctccttgctgggccttggaacagaggggatgctcaaggccaccttcacatttattccatctttcaacacacattcactgggcatctatcacttacaggctctgggctaggctgtggggaggcacaaagataaaaaaggactgggtgtccttaacctctggtgtaaatacatgacagtgggactgttggttctgacaccccactcccctccacatgtagttcccctggggagcagtgcacatcacatccttggtggccttgtcccctgagctgaggggtcagctgtcagctgggtgtgaacacctttggttcatcattggctggttgtagctgccataagtcatcattgtttgcaatgtttaacctgccatgctctcttccccaaactctgttgatctttcttttctgttgcctaattgattttcatgttggttttatttttagaaaattgtagcggcaagtatatataagcatatatacggtgaagtccttaaagcaaagcacttctaaagaatgtgtgcttgtttttggcctctccacctttggttttcactgcgctccacaggacgtgctaaggattggttgcaatcatctaaattgttccccatcccatagattgtcatctccagcctggggccatcttggtcagtcacacttggctctgtgacttgccaacatagtcttccagaatgaatgatctggctgagaaatgattgaattcagcctgcgtttgtattctttgcaaaaacgttttgggtagtcctttgcatggtcctgcctgcgcacgcaccagcctgcttcatcctactgtccccctcccatgtccccacaccccgctcagttcctggtttggcagcactcatggacttatctccatcacatttggtcctaacctcaccaggctgctaaaatgacacactgtgactgctgggctccctcttgctccgtccctctttgatgcctgtttgttccttgaatgatgaaatgacccagcaacatactgtccctaacccatggatggctgtcactgacatttgtctcttctcattatcattagtgtctgggaggcaaaacacttgtttagaagctgtatctgccttattattacttactttgaaggagcaggtaaaaagtcattagggagctcactctcagagatccaggaatggtccctgccttttaaggtatgctgtttggaccaggtggctgacagtctcactcatcttctttttctgaccccacagtaaggttgtgtagtcccccatttcatatgtgaaccctttcccaggagccagctcagctgggcactgggttgtggacacagacccagcaaccccaaataaagaagccctcctcccagaggtgttacctgtgagctcagaaatagtcagagggaagactggcttctccgcaatgcctcgggttacctggcccagctgttctgggatgctggtttgcttcctatctgaattagaaagctgcatcctctcagctcttccaagcacagatagaaattaaaacagaaaatgaaatggactgatttcattgatttcacttgggaacctcagggtctttttgacttccacggttgcagggggctgccccagagcctatgtggtaagagcctgcttgagagccctgtgggaagaggctcgagggaacatcagcagagccccaggaatctaaggagctttctggaccctgacatgtagtccggcctcctgaggctaaggggctgtctcctgtagggttcccagctgaagaatgtgacatcttagggtgggaaggaactgccaagtttgtcttgtccaagccctgaggtgacactggaattccgcttattgaaaactgattagtagccccttgtggccatgtttggaaagctacctagtgaagagtccttccccagtctggtgtcctctaggggtgtccagcatagcgtagcccacttgcgttccagctccaccagttcccttcatgttgaaacctcctccatcccttgtaggggagatggggatggagtctaatcgctctctcttcatccgtgtactgttccctcgtcaacccagaaagaacccactgttcagccacagcagcctgagtgggcttttctagtgaccccactctgtatggccgctcgagatctaaagggcattagctggtataggccacctgttaactactcgggccagctttaccctggcccaggactggagttctcagctctggcagcatatttgaatcaccaaggagcttttaaaattcccaacatggaggtctggcgcagtggctcatgcctgtaatcccagcactttgggaggccgagataggcagatcacctgaggtcaggagttggagaccagtctggccaacatggtgaaacctcatctctactgaaaatacaaaaaattcggcaggcatggtggcgggcgcctgttatcccagctactcaggaggctgaggcagaagaattgctgatatcctgtaggcagaggttgcagtgagccaagatcatgccactgcactccagcctgggtgacagagggagactctatctcaaaaaaaaaaaaaaaacaacaaaataaaattcccaacatgcagatacgccccagatccattaagtaagaatccctggggtgggacctgggcttcagagattttgttaaagatccccaggtggttttagtgttcaggctagtatgagagctggcctccccttttcattgggctgacatttgtcatttgggaaaagccatcctcagggttctttaaatttgtaagatattttggcaacttgcactgtccccccggggctgccagtcacatcctcccctgaagcagccccccatgcccagtggtgtgtggtgggaggggaggtgtcgcaggcgcactgagggtgcatgaagcctggtgtgctgtttgctctttccttcctccctccctcgcatgttgtgctgccctctccctttacaaatgctgtctcctcttcccttttgttcttttaaacagaatattcatggtttgaagttcatagtccataggttgtcagtttcaaagatatcagttgaagagatgtacacttcgaaattcagttcggttgctgactttcacaaactctaaggaagggggccgtggatggcgtatcagacttgaagcagaatagggagaggcccgcaggagggtcttaggccagactgtggccaggagtgtcttccctgaccaacaggccccttactgtcttgcaggtctgatacataagttgtgcacatttcagaaggataactgtagagccgtctctctcgtgcacactgcctggtcccctgaacacaggcaagcagaggtgcacatgcgggcacacttagcatgcacactcacaccccacactccagccagagagggaagagtggaaccttcctgtgcacagccttagtgagaatgatgtggaaaatgatgagaactttaaaaaattagttccttcatttgttaaggtcttaagttgaaaaacattgtctgtccctttaaggagctgatatttcttttgagacgaactaatagaagagggaaataaaaatagcaatcctgggtttttgataaacctgtggcagagttcccattctgagcatcccaggagaagcaaggaccccttttaaactctgtcagaacctgttcctcttgggttcattgtcacattactgaatttcagtttttctgtgatatgctgaaaccccttattttctgtgaactttgtagaatttccctttggtctcaggaggtagcccttgatgctagagaggcttcagaactgagctctacctttccccagatccccagggaggaggccctcgagaagtgagcacatccagacgtgcacacatgtcccttaactttgcagacacactgtacagaaagcgtccttgaagcccctaaccggaagagcctcatttctctctgtcggctcctggtgacaccactgaggggaaaagagaggctggcacatgctggctctggttccgctgactgttgctgtttaatgtaaagatgcctcctggtgctggctggagtttgcttccaactcctctgtgttctctcagacactttctgaacactcaggtagtgctaggcaccatgctgggcacggagtggagtgaggcaaggcccctgccctccctggggtgggggttggggggcaggtaagcaccagtcattacagattctgcatcctggggccgagggacaggagcacagccagaccctggaggaggtggagctgctgaaccacaggggagctggtcctccactgtttcttccaaagactcatacggacctgcactccctcttatgtgaaagctgtctgagctgtggggcaggcagcgagggtttctgtagggaagcctgcctctctcctcctcgccctgactcagtctgtccagcttttcagcagccctgcctaagaggctgttgtcagacatacaccacccaggcgtttagtctcataggaacagagtgtggtccaagggggtttgtggcccgcaggcaggcaccactgcttgcccctctgctagagacattctgttcctcggggctaggaggcctgctgcagagcggttagttcctgagacccacagccctgactaagccaagagaactagcctcctcgcgagaagcgggggcacactctgcatctgttgaggtcttgcagcactgcctttactggatgcctgtcagcctgggcacagcatgtccccagatgtgaattagaaagtggtactgtgtccatgcccatgtccatggctgcctgccctcaagtccacctccaaggagagccactggtattttctcagggagggagcaggtgtggtgtctaaagatgggaaccacacatttttttaaagggggaaatgctctctggaaccattgactccttcctggttcattaatccattttcaatctttgatttcttaaagccaactgaaagtgaaaatgtccctgtcccaactgctacacctggggtaagatcagtgactagtccccaggggctgggccttttccttaagtttatttgaccatgtcgagttttccactggtttttctgtattctccatgattgtccttccagaacagtgtctgcagtggtttgcattcatcatcagtgtccagtactcttgaccagcccagcgttctcctctaacacagtagaatacgtggacatgcatgtgctgtgtggacgcagttttccgagctctgtgttgttagcatgtaactcttcctttcatatcatgctttttaagatgaaaaggccctagaatcacatcttcagttcttacctctgtcacctttgcatctgttgctgtttttctgaaagtgttgcatgttctactttccattgggtttgacctctccatgataacccttcagaactctgaagagagcaatagaatctccatcacctttttccgtcttttccgagtgatgcgattggtgaagcttctcagcaggggggaaggcatccggacattgctgtggacttttattaagtcctttcaggtaagagccatgccaaggacttctctctttgtctttgaagatcatatgtaagtcagtgattgtccccatcctagaggacccaggctccccctgtgtggccactctgtggacctaaatcaatagaaaacatggaatgctggagagacccaaatcagcatttcttgggtcaatcacatgggattacttgcctaaaggaaacagaagagaaagcaggaaggatccgtagctgagagatctgtagcatttccaagactgagagaggtgtggggcctgcagccctgcagtgcccccgggatgcctggtggtggtggtgagtgccaggtcccagcagactgcctggaagcccaacagcctctctctgacaccttttcctcataaggctacaacagtgctgtgtctgttggctagtctagatacaaatcagaaaccaccacctgggccagtgcactatcactgggttatcctgcacctggaagggtcacagagttcgggatgtttgggcatacaccatgtctcatttgtcacctctgattctccaggctggcacagctcggttctagactttcccaagtagaaccagcttttcccgtacctgccagtaccctgccccagacattctagccttctggactgattccatttggaagagaaggtgtgggaaatatagattcttagtaaaaggtggacccatgtagggaatttgtggatatctacaagcattagaaagtgaatcctgcatcttcattttttaaattatttgactatttttcattcaaaagttataaatgtttacaataacaaatgaagctgtccaaaggtatataaagagaaatttcaaacttggccctcacccacccctggggtaaccagtgttaccctcccagtaagcatttgtccctagtagatgggattttcacaggtaaaagggagaagggacagcaagcggggtggtgcaggcactcacaagggaagtcacagatcctgctggggagaatgaggttggaggaaggtaaagtgggggcctcaggcaggtgagccttgaacttgctaaggcacagaatcctcgacagttattattcatttaaagtaccaaaacttgggaacaaactgctataaaaatagataattcagaggtaatgttatctcactttttaaagaaattcttaaagattcaatttgccacagataagaaagtcatgttccagagcagcagttcataaaagcagagaaactgtgcaaacaaaaatcgtaaacatttggcaatctaggaagaaaatgcacgtaggtatgttgaggaaagcctgaaacgaactctgtgggaccctgctgagcagtccagctgcagggagggccaggctggcaggcacaggtcaacagctggcacaggtctgaaggtggctgagcacctgtgagccactgactttctgacaagctctctcggatagtagagaaagcgggtgctttaagcatgtgttcccagaattaagcctaacactctgggcaccctgtgcaggtagacgtgttggtcacatgtgatgaggtaagacagcagttgacattcagtgaaaggacgggggatctgtcagacactcgtacttgtatttggtgtttatgaagggagccacacttggcgaccccccagctcactccttttcttccctggcccagccccccaacttagcagttctttcagaaggtgtacatcttaagagaggtattttgcatcctacagccacagccagaaagtggttcttcccctctgacccagtaattccactcctaagacttcaccttaaggaaatacttcagcagaagcaaggtggttttgcataaagatattcctttgcgacattatctacaataccgccccccaaaacatacccacaaaagaaagtggaagtactctaaatgtccagtgttctggaatggtttgatcaattataatttcaccccaaaaatccagtaatgaatttaaggattatgagagttacgtgtctgtgttgaaaatgtttagggttaggctacagggttaatgaccgtggaaagcacatcctgcctgtaatattgtaacactgggcgtgcatgtggatggtgtcttcaggactaaagtagttgggcagggctgggatttaaacggttcttcctcactgtcgatattctttcacggtaacacgtggaatagaaaggaagcatgtggccactcatgggtcttctcaggctgtggcgggccgtcacggggacagccggctggtgctgagccaagtgccttttctctcccaggcgctcccgtatgtggccctcctcatagccatgctgttcttcatctatgcggtcattggcatgcaggtaagctccagccatctcgccctcaggggccctttcactgggtagccccaaatctgtggcaagatgtaccctgaccaagtgaagtagaagcattgtgatttttcagccaaatgcctctgctgaagcctaggaagatgagaaagacaaagctgcttagtagagagctccaggggaggcccaggctcagatgaatgtggagaggttagaatgcaccaggaaaaactgcatgtcatggcagaagaattatgctttatcataacaaagtgaaattcacttgaaactaactatttccagatgccaagactgaagagagaagcaagtagcccctcgtgggtcttttcagtctgtgccgagccgtcgcgggaacagaaggctggtgctgagccaagtgccttttgtgaccattgttgtgctttagtagctcacctttaaaaagaggcatgaaactgggctcttctgtgacccaagcagaggggctgcaccctgtttcccagttcctcctgggcatgggaaagggactgggcctgcctaacagaggagccctaacatcaagtgggcagtgggatgggttgtgggtggagggaggcagcctagtctaagaatggaggcagtcgaagagcccaggtggctgtagatctctgctggcaggctccttgcagattctccacgtgtgcaggtgctgtctttcaggtaaaggagggatgtaagtcagaaagaagtaaagtgattctatgatttttggggcagagaaatggtagtgcttttttcttttttcttttttttttttaaaatcctgaaagcatagaagcatttgcagatctctgggaatcttaccaggagttatgaaacaaaagtcagcatacttgagcctctgtgattcagcagcacgtggtgctatgtgccctggaaggtcttttatcacatatgttctcataaaaaaaagccatctcagaactgcaagctgcatggcacacacaaccccagattcacccagcaggcgtttgtaagcatctgcaggtttctctagaatgtcagtctgctccctaaatctcacaagtaaaactctttagtaccttcccattgccctgaagataaagcccactcttctgcccggggctcacagcccctgcctgttgcctcctgcccttgtctccagcctggtcttttatctgtctgctcatcacacgttattttcattccctcggtatctatgctgtcaccctgctcctatgcacatggtgctccctccacccgaaacactcttcgcctttcctatcacctgatgtatctttcagttctgagtttacatgtcacttccccctagaggccttccctgacccagccccccagccttcagtagatgagcctgtctcacgcttccctgtgtgtctggaccaccccagcatcatcactggggtttgatgttgcctggctacctttgtgtctcccccaggggagatccgcgaatgtgagaccgtgcccctctggagcaccacgttcccagtgtgtaacctgctgcctggcacatggttgtgcctggcagatcttttttgaatgagtgaagtgccaggtaccatgagaaaaccctagctggtaaagatcaaacctgagttagttctaaattcacatacggattttttttgcatgacgaaatctattctctttttcctgacaacttctccacctagatgtttgggaaagttgccatgagagataacaaccagatcaataggaacaataacttccagacgtttccccaggcggtgctgctgctcttcaggtgactgcaactggcttgggcggtgctcctgggcaggggggtccgctaggcgtgggtccagagggacggaggacacaggttattaaagcagtgtgcctttctcagttgattgtgatggctttttgtttttgtttgttctgtattcttaaacacagaccctagcatttcaaacacaggaattttgctggattgttaaaactgctgtggtaatcccgattgtggctggcataaggtttattcatttgggagttagtagggctacttaggccacctgaaaaattgtaggatgtacgtttatgcatggaggcatgcacttgaacacgaccaggaagacagaaacttagcaaaaacgtcaaggccttttgcacagccagtggggaacatcctaagatgtatgatttcaaattttttgggattgcttttaacgtcagttaattaactttgtaaaacaagctgccctcatagtgagaaaactttctagagatcatgaagtatttctaatgactctagtgactgacaagtcatttgcaagttaggtggtttccagctctgccttcaacaaaattgaacagagacttaagttgttaagtattttggtcattaaaaataatcaataggccaggtgcagtggctcacgcctgtaatcccagcactttgggaagctgaggtgggtggatcgcttgagcccaggagttcgagaccagcccaggcaacatggcaaaaccttgactctactaaaaatacaaaaattagccaggtgtggtggcaactgcctgtagtcctagctactggggaggctgagcccaggaggtcgaggctgcagtgagccaagatcacaccactgcactccagcctgggcaacagagcaaaaccttgtctcaaataataataataattaattactgttaattatacaaatgtttaaagtagagaagacacaaaaacaagcatccatttatatgcagacagttagcgcgcttgcatcagatgatggctgtaaatccaagggaattgcagcaggacctccagttactgtgataagttgcacgtgaaaatcagtaggaatttcacatttccattaattcaaattggattttcttcaaatgacttaggttttgctctaattatgagtttttctcccctaagatctaagcttcaaattccttctttcccccactaaagcccctttgttcttcatctgaaaaaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctggtaagtgagcaacacagctccccctctcaatttacagatgcttatgtagcagtcagcgttcacacaaatggccttgccctgtcccatcgcctgaggacaattgatgtggatgagcactctggactccacttggcagttgagggcttttgtttaaccaggcgtgtgtcactgccgccacctttgtaagcagagatttggtgctcactaatcggcttggagcaattaccaatcaccttagcttcttagggttcctttctaaaatttcaaagccagtgcatatggtggtgacctaagagtgtgaattatttggtgataatgaaattataaaactgcaatgtgtttcagaaggccttccttccccaggacttaattaaagccattccagaaagctagaatcacactcttttcttaaacattctccaaatagaaagtttttacaacttctcttggagacatgggttcccatgtttcatgtccatgtcattagaaagcctgtgctcagttctaacgcaatccagctgcagctgaagttcttcctttcctatttgctttttcagatcatcaatctgtttgtggctgtcatcatggataatttcgactatctgacccgggactggtctattttggggcctcaccatttagatgaattcaaaagaatatggtcagaatatgaccctgaggcaaagtaggttgaaaaatatttgatttggcgtgtgtgggtggattttggaatgtcagctttttttgtggagtggactgaaagttcgggccagctggtactgttcctggaccttagattgtattttacttccaggggaaggataaaacaccttgatgtggtcactctgcttcgacgcatccagcctcccctggggtttgggaagttatgtccacacagggtagcgtgcaaggtgagtgtcctgtgtgcgtgtctgacagcctgtcttgtagaagcttgcttcatttaacaaacacttgttaagtgacacagccaggccttctgtcagttgctagggatgcagcaatgaataatatgtggttcctacctctggggaaatctcagatttgtaactctttggacaccctctcaggaaccatcagaagaggaagggaattctgtaatttgtcattgggtggatggtagagaaggcgacatttcagtccggtccagaaggaacacaggagtttgtcagaggcagggagggctcagaaggaggcaggagaatggacatcgtaatggcaaagggtgagccattgggtcatcctttggctaggacataagaggaagtcagaaggccccaggtacaagctgagccttctctgtcctgctgaggtccaggagaatggggaggaaacgtgaatttcaggttcccatgttaggaagttggctgttggcaatggagaagtagacctgaggcagggggatcaaccaggagagccagaacgaaggcagcagaagtgggaagagataggagcagtcgcttggagatccacttaggatgtggagtggggaggacttggtggcctgggtgaggggagggggagtgctaggagagcacatctcccagcctcggcattgggggacatggtgctctgtgttccacacgtcccctctgctacagagctttgtggccaccacaggaaatggggcccctttgctggcacactaggctctagtctctcagggatggatgcagatctcccagtgcaacgcagttctgtgtttccatgccagagcacgctctcaggaaccctcagtgagacttttccttccacagaactcacggtgtagcaccttacatttgttgcagcgacaaaaaagattttcctttttcaaggaaaacgcaaggtttgcctcttgaaactctgccttctagaaattcatacagtctgcatagcaactagttcttgctcctcatggatccaaggagatcctggggtcaggcgtttttaccactccaggatgctgagccagctctagacagaaaccaaggtagcagaacagagtctaaaatatgtttcagactctcaaagaaatcccttgagccagactcatgttccctgccctgaaaatccagaaagccttctaggcaaggccttagggtccttgcctctcttcaggccggactctggatattgaaacagagcttgacttttttttttccataaacttcccagtactggcctcttttctgctttccaagaacagtgtgggatcccgttcactgatgtcttcttgtgtttaaatttccagacccttttacataaagctttcaaatgtccttgaggcacagtcatccattttgctgactcaggaacttaccaggaaaagtgaacaaatgtccagggttccctggctgcctgtgctggttttgaagagggtgccggggttggtaggaggactaggaatttgggtgggatggacttatgcagacacaagattccaaatcatcaatatggaagagaaagaaaatcttttcttttggaacatgctgttaatgaaaaataagaagtttttaaatattatcaacatcaccattaatttagtgcttgccatttgcctcacacaaaactctttgtgtccgtgagtcctttaatccttgcaagttcccatccattgggcatgtcatctgcatttacaggttgaagtgactggggtccagagagggtgtacctcacccaaaccccctccaactctcattgctggtgttaaagggatcaggatatagaagaggagtggggagcatggatcctgctctgaaagaccaaagcctgggagaagccacataggctcatgcaaaatgccacaagatgtacatgatggtctaactaggcaaggtctgaaggacattccctgagttgggaatagtaatggatcccgtcggttgagaacctaagtcccaggccctgtgcctggcccattgtcttttacttcctttaaccctcacaacagctttaaaaacatgcttggagccgggcacggtggctcacacctgtaatcccaacattttgggaggccaaagcaggaggatcccttgaggccagaagttcaagaccaacctgggcaacaaagcgagacctcatctctaaaaaaacataacaaaacaaaaacaatgtgcctggaatggaggtctgaccctaagatctccattgagattagtgaaaaaaaggagaagactgtttgaacagtgaagtttcacggtttaaaaaacaaaacatcatctgcgtgttaacatttatatttcatgactaaacctttgatctttgtcatcccagagtcccctaagtggtaggttgtattaatcagggttctccagagaaacagagccaataggatggatatggaggtgtatatgtatgtatgtgtgtgtgtgtgtgtgtatttgtgtgtatatatgtgtatatgtatatacacacacacagaggtttatcatggggaattggctcacgtgatcatggaggctgggaagccccatggtctgccatctgcaagctggacctggtgttggtgtccactctgagtaaagtcctgagaaccaggggagcccatggtgtaagcctcagtcaaagggcaggagacaattgatgtcccagcttaatcaggcctatagagagagaattaaatcttcccccacctttttgttctctgtgggccctcatcaacagaatgaggcccacccacattggggagggcattgctttactcactctacccactctaccaattcacatgctaatctcatctggaaaaaccctcgcagacacacccagaaatcatgtttaaccaaattggcatctcgtggcccagtcaacttgacacctaaattaaccatcatatgcgtacccccaaatggctgttgaatggaattgagggttgactagaaaagagatgagtgataaacggaaaataaacatccaaaaggatatggtcgtggtcactcatttgcattctacaaagaaaccttcctttctgtttacagagattagttgccatgaacatgcctctcaacagtgacgggacagtcatgtttaatgcaaccctgtttgctttggttcgaacggctcttaagatcaagaccgaaggtgagcattccctgccagcaagacaagatggcaggaaaggagagagacatcacatcccatcttgccttcctcatctgggccttttcttggccaaggggaggccctggggaaggggctggcaagtagaatgaagatgtccatgctgggcttgccggctggcccctgcctcctgtttcctcatcctttatctccttcctttatgcttcactttgtcccagaatgttttgagttgactcatactactgcttactacatagcaagggaaacaggcagggtatcggagcagagacgaagccatcacaaatgaactcactccaaccatccctaactagttgtatgacctgcagtgagggatttcactggtctgagctgtagtttctttccctatgaaaaggaaatacggggatgtctaggaggtcctgaggatgaaatgaggtgatgtctgcaaaagctcctttgcagtgcctagcacacagtcagcacttgagaaatatagtgggatcagcatcttcccagctgagagaccaaaccagaatggccttcacagccatgctcagccctggtcaaatcctggtaaaacaggcactagagtgtggccattggagctggctcagtggtgacttcagaggtggaatggagagcagattgcaacaggctgaggagtgaccaggaggtggggggaggtgggaggtggagacctcaaggagagctgactctctgaggcactggtggaggagagggaagaggaggcagcaagggactcatgctgagtgcaggcaggtgacttcttacaaccctagagcccagggagacttgatccagcaaagccagcctcttccagcctaactaacaggggcgccttgtagcatgcttgtctgtacctggccccaggccagcattgttaagggctccagaaggcagaatggtcctctatactgacatgttagttgaaaagacaagtgtcagctcatataataaaaggccaaggttatgttgtatggatgagtacatatagtaggaattgagagtcttatttgggtgaaatttaggctggatcttcaaggaaggaggtacgatttggaacaacccatgaaagagcagaaggcaaagacattctgggttgggaacaatggaaagcaagtagtaggtctcagctgtgggagggcaggatggaatcagagtgggacaggccttgaatcccagggtgaaccgtgtttgttcccatggtggagggacttcccactgggaaggcatgatcgctattgctgaatataggaagtgtgtttgcccctgactggggagagcctggtgggagtggagccccatcagagggcagcatgttcatccaggtcaggctgggacaaggctgtgcaagcagaggaggagctggggaacagaaatgaggcttgcttttccccttttgttttttgaatccagggaacctggagcaagctaatgaagaacttcgggctgtgataaagaaaatttggaagaaaaccagcatgaaattacttgaccaagttgtccctccagctggtggtcagtgcagtctatttcctaagtagtccttggccagtgctttggttttaatgctagtgtctccagaaagtccagagagtgtttgcaaaatgctttatgtatcatttagagcattaaggccaactgataaagaaagccctttggccatttggtgtgattattttgggggtaatatgaagaacattccagacaaaggagaggcttcagtgaaaaaccaaaactcacatggctggagcagggattttctttttggtggaggaattaatgtttgaggacaagattgtgatctcaaagtgaaaagcctatattttttgtccaaaatgaaatattcaaaactagtttccaattacccttcagtatattgttgaaaatgtcccatgaaaaatagacagctttcaggaaattgtatttttgaaatgttcttatcaagactgaatttactaccgtaattaccaaaaatgtccttttaactaacaggcatgcttatttccttttgttatttatcacaaaataactaaccttctttaaatttttatatatataaaaaacatctatatatatacacacatacagtgtgtgtgtgtgtgtgtgtgtgtgtatatatatatatatatatatatatatatgcatactggctttgcatttttatttaagtacatgtggacttagacgttgagatggttgtttttgactgttctgtttccaagttttaaaggtgcaggatctgttcacccagtgccaccacaccagcattctagcatccttgggccgggcacgtgatgagcctttggtgtgtttcgtgaccagcgaacttttatagcgtcgctgccgccacggctttcgagactggtctggctcaggtctggtagctgacttcaggacccaggccaggacggtgaccgaggccctgcccctgagaaggtgatgagctctggctcttggggcgcagacagagcagcatgccagccagctctgctccttagcatgaagcgagaagcaacgtgagcttttgttgctgaaggggttacccgtagctggcacagccacaggctcaaagctggggaagatggcccagaaagaaatgataaaaggaagacaaaccaacaacaacaacaaaacaaaacaaaagtcctcccacctggagggccctggcttcccacaggagaaccgatactgcacatttaaaacaactccttggttttcattcttttctttttagctgcacacctaagagcttgcatggcttacatgaaatgctttggaaaaattgtaacaatgtgcttgagcttttcctgcagcctccattcctttcacctctcagtctttcagaatattctgaagcaattctgttttagggtggtggcatggaatcagagttatctcttgccaactgtattcccctacgttgtttctttaaatacagatgcatgcttcagaatagtgggctatgtctgtctatgtaaaccttccccctgcgagctgaggaccccgctcctccctcgctccacctcacatctctcttggaacgccaccttcatcacaaccagccagactcccacattgatgcccatcctcgtgaaatgccctcggagggtgtcatttgcattagtgtgaaacttcatttcttttcattttaccaaaagaaaagtccagaatttagctcgccatcgaagctcccttcctttgaaaagctgatcaacttttagctttatcagacttctagtagagtagaaatcttcttctttcttggtccaataactggacctcgccttttctctctatttcttaaaatggattggagtttaggatgacaggttttaatctattccacaacggcagcgagaggcagtgtgaggcacaagaagagagaagtggggccttaggagggatgcaaggctttgcaagctccctgcctgtgttgagtgatgtgcccagtgcagggcttatccgggctgaatctcatgtgagtgctgtggccacgaaggaagttccgaaggcagtggccatcaggctttggtgcatagactctggaagagttgccggacagggcttggttctccacattcatcatttgtctgtctttcctcttttatccttcagtaggcccatgtccccaacctttcctgcatcacagcatacttagaaaaggatatttgcatacccctctgggaacagatgtggagttcttgaggctgagggcctcagcatcccctacaccatcacctggtcaagaagcaggagactgagtaaggccagcctccactccaagtggctgggactggcagatgtggggtgctcaggaagccccttttagccctggtgatagaactgagtcagatgcttgtcttgggtggcttcgctagtgtgctgtgaggtgtggcctggctcctcatgagcctgatgatgagatcaggaatgagctgtggatctgtggatacatgtcaggcttgcttcactcccagtggcccgggggtctccgctgccccctcaccatcagtgctgagccgcctcatctctgcctctcagctcaggttctcacctctgctcttcagccttcccgtgccatcttgtgggtcctttcccttcatttcagaagctctctctcctccccaggactctcctccatccatgacctggatcctttgctcctttgccctgaagagcacactgagctgcctccattgccttcttttcagtccggagcccagatggcctccttgtattcattccttctcttccttcctgttctgtcctgctgtagctttgacttttcttgttcttaggaactcttccttgggcccagtctcctaattagcacagtgtctcaatggagaagacgaagtgacccttgagttctctcctgcagagctctgggtgggtctgcctctactctggaggctgaagggagatcagagttaggcctgtatttgctagaagcatcagggtggaatggggtgtgggtcttcttcaggtagagccagggcgttttctgggccccacagagaagacacagagccctggaatatagaggaaggctgtggcatggcaggccaccagagactctccctggggtccctggagtcattagccagacaacagcgtgtccactttttgtgtgcagcctgggaaagggatacacttgcatggtgtgagaggcagctctgaagaagcccagcagccagtgtggctggagacggccatctctggagaggtggtatgaaggataggatcccagactcaaggagcacactgtcctgtggtaaggtcccggcttgactgagctgggcaagtcatttagccctctccatctgttggagggggtggtggtgagcagatccaccatgtcagagttgtgaagaggccatgagacccacatggaattcttctgacacagggcttggcatctatagatgtccaacagtaggggctggctagagccagagctgatattccaaacataccctgagcaaatggggaggctggagagtacagcgaggggtgaaataccaggacctgagtggtctctgctcacctcctgccttcttgcctatggaccttgcatcattagacaagccgagacagattaggaaccatgttttacatgctactcagagtctttggcttatacctgggtggcccctacaccactccaggactatcttagcttaggtttagaaggaacagaacacttctccaggccagaccacctgagacagccttctcacacagtaacactgagtggcttctgacagggaggcctggagaggcagcccaaggaggcccgggcatctccagtggggaccacaagatgttggcagcacctcctggatgggcactaagtgaagcccaccccgggtacattagtgaaggatgatggttctccatgtcccccagcccatcaagcttcaggatccatgtcaatggatgccaccgtcagcacattttaaaataagggtgactctgagggctcatgatcaacatcaagtgcccagcacttaagacagcctgagccaggtggctgagtgctttacctgcttcctcccacatcatcctcacggctcctctgagaggcttatccccactttacagatgagaatacaagctcagagaggttgagccccttgcccccacatcagcatgtagatcttgcaagggtggcctggcctaaaagccagctgctctgtagcctttggaccagcaaccattcctccttccagcctctgcaagttgtggtcagtggcccccagggccccacatggccccacacacatgggacggagtactaaagtggtcacaagctttacccccaagagacacagcacactgaagatttggtagcaagcagccgtgggagagccatggggcacatttacacgtccaaagtggtttaccatgagacagccagagcctctattctgcctcatgcatcacctttaaagtcatcagcagagttctgattccccaaccatacacgttggaggttgtttctgaacaaagcaaaaataagcccagctcaactatgaggttggttggagctgtcactacagtgcagaaaatgagctgttcagaattacaaaccaagaaatggtatatggagcttattggtggagaatagggggcggggagctcatgaaaatctgaatttgcagtcacttttctaaaccttcctctccttctgagcatgtatgtcacctttctaggtctctatcttgagacatcgggatttggacggttaattgcccttgataagtttatggtagttatacatgcaaatccctatgcacaggggtgaaatgtggcccgtgaagcctctttttgttttgtaatttttattttaagtaaataaccaagacagcatttcatagtgttactaatatgctgctctattaaactcataacaaatatattattttctgcaacctagagtatcagttcatttaactgacactaattttgagccttagttgctttgcaaaaccttgctttttgctggtttgagacccctgtgttatatgctgagacctcggtgccttctgcgccggaccgcccacccgccccactctgcccctgcccctgccccagccagaagcaagtgtttaggctcttggtctaatgtgctgattcgggagagctctgtctggtctctccgtttagatgatgaggtaaccgtggggaagttctatgccactttcctgatacaggactactttaggaaattcaagaaacggaaagaacaaggactggtgggaaagtaccctgcgaagaacaccacaattgccctacaggtgaattgttgtctcattttgttttctcttttgactaacgattttacaagcttatttgaaatactagagagctgcctattcatggttgagcagtaccacaaggattttgtttaaactgagatactacacactcccccaaatgtggactagccatttctgggccacaaggtaagtgcttccctccccgatgcctaccccatagagccctgcacctgccactacccacgcggcagggctgccaggacggagaggagcgagcgctaccctcgcaccccagcccctccaggcagcatcctccaagcaggcacccaccttccccacagccctgggctccagggttctggctgcccagtgaatgaacagctttccatctgaacgcaagtgctttgttttgtttccgtttgtttcttaccccactgcttgttggtttttggtccatttcagtaacatccatcacctcctagtatgtattctgtgtgtgtgtgtgtgtgtgtgtgtgtgtatgtatgtatgtgtggtgtgtctgtctctgtatgttgtctcctgatggccaggaggccagctgtgcacatgctatgctctcatgccccagccagcctctggtccctctccctcctccacctgggccctgctgcaggctcctagagtgtggatgtggctttcaggaacctctggtaccagccagggtccttgcatgcgaggaatgtagaaacctaggaaagcccaaagctctgggatgggaagcaggtatgtggaggggcaaggaaggcaccatgaggaccagcaggaagaggggctaggaaggtggtctgtgagtgccgtggatgaaggaggcagggcaaagagggagaagatgctaaggacagggaagagggaaccacagaggctggcaaatcatctgaaacaactgacctctgctgcccagagtgctcataatccatcatggataggataaagaattttttaaaatctatttacgccacaattttatgcccctgttctcagtacatgttaaatttggccttgtagatattgataaggttcaacatggaagagtccttcactcttatccagggaaaaatgcgcagcgttgtgtgttcaaagtgatggtaacagcccaaatgagggcttatctttgatcttgctgagagagagaatatgaatatgaatatgaatatgaatgacagtgaatgagtgaatgacaaacatgagctgtgtgtgtgtatctcgtgggttagtagatggccttgtgtaacagtgacctgctgattcatggtgcaacctctgctctacccagacagctacaggggctggggaaagaggcatatgcgggttggcaggtggaccatgaatccgactgaagacagtgatcttcctgcctctcatcacgtatcctaaaggtagctgagggaatcacaggctcagtcacacagcccattggcatctcaggtggtaggatttgcaaatgaagctttctcacttccaaccaatccagtttgtaaaagtgacagcccccctcctggattgcagttcacagctagcctccgaaagacaaagcaaactgcagagatatgtttgcagattagaagaagtctctggtccatccatccttgagggcagcgtggccaggttgggtgccaggagagggagtgatgaacatgcttctgcaggcttgtccttaaaggagtcccctgcccagaagatgaggctggttagatggtttagttccatttcccagtgccctctgcttgtagggaactgcttattgttctgggagcctaattgggaccagaacttgataacttttctggagggaggaacatagtctgtcatcgatggttgatgtcctaatttacagccagcaggttagctaggtaccatgagaatcttgcattttctgtgagaggcatggcggccacttggatgcagggtcatttatactttttctgaacccccaagacttcccaattagacaatttcagcactttctctagtggctggaaatagtgttttgatgttttaagatatgcacaaacaacacacagctaagtcattaccaggtttcacgtatggggtttactgagtcttaagttgaagggtcaaatggcatgaatgatacagcggcaggttgtgggttaaaagactctttttgtgttgcaataatgttgagggtttctcctaaacgtttttcattttattgtttatagagtttcattttattgatgaaatgcaaacatttccagttagatgataccaacatattttcgcatggctccattgggagctgaagcatcgtctgtaatttatgttgagaatgcagcctggaaaattaagttgtgttcataatcttaatagagaaactgaaaatgtacttgattctgaaacattaaacatagacattttttttgtctccttgaaggataattctaattgcattttggcttcctgtgctgtagaaatggctgtgagtgtgatttgttactccatgtttaattagcatgagtaggctttcgtttctgcgtgatgaaataccgggtgacgatgtagcagttaggaaaatttggtgggacggcagtgggagagatataccaccagtgtaactaggacaaggacacagcctcgggaagcccctgagagtgggcgtggcctgttgagatggaggatggcttgcctcctcccacagcagggtgccccatggctggcagactgcgtgctaatggaaagtggagcatggccgtcgcagtgtgagcgcagaagtgcggacctaggcatgtgcgtgcttgtgctgcgtagggtgcagtctgtctgaacagcttccaggatgggcccaagacctctgcgcccccacccccagggaatgttttttcaaggacacatatacgcactgtggttttgaaccctgtgggctccatctgatctccctgtgttcagaccaactgcaatgctgcctcccacatgaaggggaatggcttgagctcctggatccatgtgtgggaaggagctcggcatccggtgtcttctggcctctgtggtctgaatgagtgtgcagtttccatccttccatccatcttcatcattaaaaccaaccttctctccagcccctctacagagggaaccagagagaagctgcatcaggccttttttaatttcctcttgcgcatctcctacatgccatgttcactttgggttgactcagcatttgctcgtcatccattgttgctacatccgagtgacccacgagtttccacgaggggcaaataaataaaggaacacagccatgcagccatgaaaattctcagtcctcctcccagcagacagcaatgcatgctgaatgtcccatcagaccttctagatgaggacatctgtgcaagttacagacactcattagtccagtgtcttgtggataagaaaaagaccccaaagtgggaaaagttttgttcatttctctttcttttaacattcaagaatttcctttctgcaaaagacatgcactccggtggaatccgaggacactatgtcccccactcatcccagatgggagcctttccatctccattgtaggaaagctttggagggatagtccttttgcctgtttggaagtttggtttaaggaggagaccattatttctagctataaagaattaggttgttaggttgaataattgtaaagcctgtgcccgagccgccagttggcgatgcaggtggttgaggggagatgtgggtggtatataagaagcaaaggactctcagcccctgatgtgccccgcgtggtcttcttagggaggctcaatgcataaagacagaagaaaatgggatcctccacagagatttaatctgtagaagatcaaacacctgttgcctggtcaccttagtctaaaaagtagtggagttttgttttgttatttttttaaagcatgattctacctgaagccatcaaaagcctctttttaaatttttttctttttttaatctaagaggagaacagatgctaacagatgagatttcactggctgattcgtttgtttcagatgcttgaacggatgctttagaattttctgcctgagctacggcaccaagctggttagtcggaaggcgtttgtggctaaggccttgaaagggaaaagtctcaagtgggcttatttctactgaaacagcatttcagaagaaatgcaggaaaaagcagacccaaggccccagggagaccccttccaagcaaagcactcctccggaaggtggaagcggggccgtggctcatctgcggagccagggctgcctgtcgcggacgttgctcacggtggttctttttcgtgaaagggaacgtacaaagcttaacagttttcccttccaagcagagactcagagaaagggaaagagtgagagagagcaaaggaggggggcagctgccccacagagaaatgaaatgaacacaacttcctgatgctggccagtaaaacaaaaaattaaaaataaaaataaaaagattaagcagacctgcctaaggtgggtatctgactccattccaaagtcctgcatccctagtttgcccgaactcccaaagactgacaggcccctcggcgctgagctgacagagttccttttgtatgccagtccgccatgacctcctgagcgtccggccctgctctctgcagagacccagtccagaatacagtgagaagtggacaggccaggaagctcagatacacccattgaaactaacacatacacccgcatgccaaaaccaatccaggcaacacctcaggttccatcttaacgtgtccacaggaaacaccaccacacccaaacctcatctaacattgtccgtctttaattcgtgctcagagccagtctggggatgcctctttggaagcagtgtggtctagtttcaaggacactgggagtcagggaacctgggttctagtcccagtttcagcattcacttgctgcgtgaccttgggcaagacacttaacctctctgtgcctcagtttcccccatctgtaaaatggggttaataatgtcgacctacctcacagggctgttgtgaggaatagctaagtgattgtaaagcactttgaacgtataattgcttattaagactacaacaataataatatcatatgcctgtttactaccagaactttaagaaattcttgttttcctttgatctcttttctgttctgtaccatacttacccattgagaaggaaaattccccccttttaaagaaatctaggcaatgcacaaagatgtcaacagaggtaaccctgcaggttgcattttcacatcttaagaatagcagatttttgcccaagatgttggtcgataagggtgtctgatcttgaattctcagctgattccaagtggtggttggagtctgtacatctgatgctgagcccaagacacccaaagtggccagtttgggttttaagatcaacattcaaagtagccatagtgcagaggtaatgcagaagaatctaaaaaaattgaagtatctgaagtgtatagagaaaagaagggcttatgagcccctttcacctgccctgatgtgtacaggctggaagctgtgtgtgtgtgcgagtgcgtgtgtatgtatgtggggtgtgcggagacaggggaagagagagccagcaaactctggggggccctattcctgtagaagtggacacccttccaagcatcctgggagggcaggagtcccaaaggctaggcagagggtgggagcaatgtcaccagtgggaagtatgctttctgcaggcttgtcctaggtgtgactgacagggtcagtcccagcctcagggtcttttccagtggtgtcttttgtgcctatgacatttgcccttggctgcagtcctcactgtaccgagaggtctaacctacctggacttcagtggacctgctgtcctcattatggaaatgggcctagctcccgactctgcccccatgtgtataagtgtgcagactagttaacatccaggagctcacagtaggtgttgtgggttctcacagcacagtccacagggcccaagggcaggtttgactgcttcgtgctgcaccacatggtgatgtgggggatggggtagaaagccaggaacactccagtgtggccaggccacttgtcaagatgttgaagcacagctgcacctggtatcaaccgctgttaccctagcacctgagtctccttccccactgccagcagcccagcccctcctgagactgctctgtgacccagcagctacaggtctagtgcctggcattgcagggagcctccaggaccctgctgtgatccaaaggcccacttctgctctgattgggcagcacctgggtatattaagttataagaatttatgaagaatgtgatgtatcgtccctgaaagggaagcccgtcagtcctgtgggggtccgtcagtccctctgtctgtctttgacccacccgacgttgagttgattcagtgctgaaggatggcacgtgcctaccccctgtatgtgtcactctgtctcagagggccggtgtgaccgaccttctagatccaagattccatacactcaggcctcggcagaaaggccccaagcgattcaagtgggcggcgtttccatgtgccttctccacgctcctcaaataagtaaaaactgacaagtgaccactttctagatgggacttagggagtgatttaaatggaacaagagagtcttctccacttgggcctggctgtgttgctggggaatggcattggctaaggttggtagccaaggccagcttaggaaagacagccaggaatcaggaaagctgcttccagcttcaactcaaaagggaaagaaggcttcctgaaacttgatttgcagtcaaactgcagagacaccgctgtcgtttctcttaaagccttggcagagaagtgtagcttctagtgtagtcaaagttgtgagagacgactcaagttcattatttagaatcttcacagacacacacagcaaacttggcacccccaacaccagcatccataggctaaactcttcagctcctggatagaagatgagaggcaggccagtatacattgtagggaggctcttctcaaatagcttatactgtttaacaacccaattaaaaattaatccacaggactattgggtactacattctatactctttctgaaagtggggagatctcattcctttgagaataataattatgttcaggagtctttgagaagaaagactgcaaagaagttaagtgatgtgacgtagtagtaaaaggtggtaattatcgtggcttgttatttagtaccattcacctagtgtcctttggcagcccaattgtgtcatgattagatgatctgtgcgaaggagctggctaagacttactaacagttctagggtgggtagaaacccaggtgagttcattctccttggcacctcttagacctaagggacacagctgtttgagatcttggaagggcacataattctaaggcatggtgaaggcaacccattcagacgtcccaaaggctggctcagggaagccataggaaggccatttcttccaagagtggagaaaggtccacagaagagtgggaatcctagatggggtaaaaaagtctacacctgaggaaaaagtagtagtgcctgttggaggatagattgatcagcagttatcaaactttttggtcttcggacccttttatactctacattattgaagacccttgtgtgtcaatatttactgtcttagaaattaaaacggagcagtttttaaaacaagaacatgcaagcacaaagacgccagggtgatgacatcatgcatcaggcagcctttgaaaacctcactgtgctctcatgagaggatgagagtgttgaaggcaaagaacatccttatgttatgcaaatcacagtgacctcatggacccctgacagtgtcttgggatgccccaaggtccccagaacacacctgagaactgctttgggggaatgctactaggtccccctaaaggcagagggtgctggagccttttaatcatctcccttgttaaagaggctcctgtgcagtggcactgccctaactggagcccttctccccctccagccccttcccagtctcagcccactccccggaggcatggagctgcctgtgtccccattcgtctagcatggccgagtcttgcggcctgtgctgatctgcaggtgtgatggtctgaatcagggcaggatagaaagtgtttttaaaaatcagctcccctaagtgcacaactgggaccaaggatgtgtgccaaacaggatccgtttcagggataacttttgatcatttgtcatctccatgctgacttaggaatataagagctctgctagggtagtcaaaagagggttagccttgatcaggtggcaccccacagtcgtgactataggtgagtaagtgtgtgattcagactccaatccagcgttctttcccagtaggtgcagtgactttgcctgggtggtggttgaggtggggagtttgggagaggtaaggcagcccagtgtcacaggaagaacaggcttaggggccaagagtcctcactgagcctttgactcatttgggcacataatttaaccacatgggaataactttggctctcccttcctcccagaatctagtggaatatttgtatgtaagctcacaatgactggtataaagatgctatcagaacagaagttgtgttttacagcttctgctaagcctaaactttacagaatgctctattatcaggaaactggcaagactttttttgattcggttgttaaaattacaacgaatcagattcctgattgcaccaagaatcaaggtggaactgaaacggagagctctcagattgtgtgcaggcaaaggtcatattttagataatttctttaaagtttcctttatctttccaagtgatgggaatagcgcaacccctaggggagcttgtgggggtcatgttacccctgacttttcagtgagggttggaatcactgtggatgactaacagagcgccaggatcccaaccctttatatctgacacaaggaccattcacaatggacacaaaggctgccatcacattatccctggaggagagtggtgacaaaataaggggtgtgcccacgtgtgatgtgctgaggaggcggacggcagcttgcagatgagcaggtttattccataagaacttaatctcattctgttttctaatggaactagtctaaaaaggtcccctctcattgggtatagactgaatcctgctaaagggttaaccagaacttgtcaccagcgagacgactgtgtgcagggccagcctaggctgagtgcagcctgcctgtgatggggaacaggctctgccaggcagggttctttggctggagtctcaaagcctggcgcttgtatcctgaagatgaatggcctggcccagtcccgactagagacatgcatctcttatctccactgctacagcgtaggtccagggcggggctctgggcacttgtgcatgcttgctgtggcgctgtgagggctggcagatggctggtgtgtctgatggagctagcttagggacacaggcagcaaaagcattgcaaatgcatctaggcaggagaaacttaaccctaaaagtgggcaggagaaagaaaggtaaatgggtgttcatatttgatgtcaaaatgtcatcatattatgctattcagaagtgttttgagacattttagttttttttggtaacttaatcattcaatagaatatctatgaaattccaactaaatggtgtctaaaattttaagcagcagtctacaggcaaagcgccaacatttcttttctaaaaattatttatgataacatctagcattttaaaatcaaccagaaactaggcttgattctgtttaatattttataagattggacatcttaaaataagtcaataatgtttatattttatagcaactctgtgtttcttcaaaaccatatttctgctgtgatgttaatggaatgactttatatggctttaattgtgttggtttaagtgctaatgaccacttttcaaattaaaatagtattttgctgatagaggtagacacagatatgagatatgaaagaatagataattttactgtttgtaaagtgtttatcccaagaaaaaaaatgttcttttttttagggctgtggaaaagtaattttttcaagagtctaagatagttttctgtatttctggggattggaacttgtgcctatggaattttgggagcagcctaagctaccttttagcttgatatgtgtgctagaaaaacttcattaccatgttttgtgatatgtaataaattcagggtgctgtgcttaagcttcatgtcaattctagtttgggaacatctgtttccctcactcccagtcgtgggggacagcctgacctggccctacccagaacacatgtgaaaaagtagagtcagtccctgactcttatgaggtctgttttttcctgcctggaacaagcagaatataatcatgatttctgactctctgcttctgtgtctgggaagagcgattcttctctcctcctctaatgtctctttaataaatatgttgtcattatttgtctttggaagtggcaacttgggccacctttcaaccttctccatgatttatgttgcaaacaaattctctgtcccatgtctgttcattgcactatcttgtcgactaaatcctaatcttgtgtatcactgaagatgtgctggagacagtttttgtttctattatgcaattatgttatatgtgtatttcagtgaaatgtcaacccgtcaacagaggatgatgttaaaaattatccaaataaatagttttctatttcttttaatcagacctagtccaatcagttgaatgacagtaaataggattatatgttgtttaaacttgggagcatttctggcctttactgccttgtaatatggattaatgtaccaaatttacttgggggtgttgacttaagtgcattataacctatgtttattttgtggaagcagcagcaggtgtcttaaaccttgtctttttgtttgggagccttagatatgtaaccgagttttcttcccagttgatccaaaatcagaagtgaaccccttgcttagctcaccatcccttgatgatgtaccctaggaagctctgaatgaatgaaatgcggctgtttagtactgccgggtatgacctttcttcacgttcctgcagctgtgctgtgtaagagcttttaccaacatagcattacagttgccttcttgatgtttccatgagaatggcaggtgggtccacctcagaaccaaatgacttcccaggctcagatgtgctgaactcgtggatcctgagagagggaaagtgtgtgtatgtgtgcgtgtgtgtgtgtgtgtgtgcgtgtgtgtgcgtgtgtgtgtgcacgtgcacgcacgtgtatgcacaagcatacccacatgtgcatatgtgtacacacatgcatcctgagcctgtgatcagagggacaggagagcaagaagcagcctccctgaccaccccaagaactgtcttggtttgacccgggacatgactgtctgtcccctataagatctcagcattcctagtcaggaagcttaaagctttcattcccagctcttccttcaccttcagaattcactaaatggaaagatctgctgctctatcttcacagaatggttcaaaccaaacccaacctggcaccatttttagcagaattgtctcaaaggcttggtgcttttgtgcaccaggctatttttataagggcctcttgggaagttcctgtgtgactttacattctaaattatcatcaccagcactggcattggcaactgcaggagaccagttttgagcatccccagaccagtgggacccagccctgatggatctggccagactgcagccaccatcccctcctcctccctgaaccacttctgggcatctgttctaccccatgcttgtctcagggatggtcatcatgcctatctgtccttgccacagctgcccacatgctaagaggtgttgtggaggaaggacagggaagcggtctcctctccgaggacccaccacttagtccagttttcctttgcaaaccaccctgaggttgaagcatttgctgcacatccattgtcttagctgttctccaggcctttagggctacagagctgtggacagactgccagtgagtgaggaggggctgcctggatacaggaccgtagacccagggcagagaggacatgccttcttcagatgcaggactttctgtggaaaagaataaagttgccatacagtccctattagtctttaactcagcatactgttttccttcaaactggtggtcaaaacatcatcattctctcagagctggagcagtaccttcctccatgcaccgtgcataagcatcttggaatgcttccctaatgaagtcgtgaacaatggaagggcttatcctgggccctgtctcaacatagcagggaccacagtgaggaaggcagctgtgagggcgccaggggagatgcagagtatctgtgacgggcccagagggatctaccaggggtgtcttctggtgggtcttgcactgcctgcaaaggctgataagccactttcagtttgttgtgatcttcaaaaagcggaccccctgttggtgagttctcagcctgcacacaggctacaggccagggtatcctgatgaccacggtggccgggtcggtgtgcgtgtcagtctgctccgtcgtggtccgagtgtgctggtggttgcagtgtgttgtgtcactcactcgttccatggctttttagcagaaccagtggcctgaggactgcttggtctgcttgtgcctctggcacctacacctaggcttcctcatcctagatgcagcaagggagtccacatcagcctccctttagatcggccaggctgtgctccttgccctgctctgggcttggagagatagggctcttgtaggcgagcctactgaagactgtcactgagacaggggcataagctcttggcctggcagatcctagcactagtaaccaggcagtgttccttggaagtgggggttttgcaaaggaggttacggggttgcaggcctcaggcatcctacctaggaccttcttgaccctctggatgcctgaccataccaacaacccttagactgccttcagtgacatcagtcagtgccctggattggcttttggggaagccttcctccccaccgctgaatcaggaaggagcaaagccaggacccaggctggccccagggcccatgtgtggtctaacctgttctgccattttcattgatctaggcgggattaaggacactgcatgacattgggccagaaatccggcgtgctatatcgtgtgatttgcaagatgacgagcctgaggaaacaaaacgagaagaagaagatgatgtgttcaaagtaattattccacgcctagctacacactggccatctggaaatagcagggcaggactccagtttgggcagttaatcatccacagaagagtctggagaatgcagcccatccccagggcctagaggggctttcagaccacaccctccccctcttacagaccctccccaggcatcagcacctcttctagggccaggccagctctttccctgagcttacccagcttcccctcactgcctgcttctgaggagctcggccacagccgctggccctgtggatgagcatcctgagtccttccggcagctgcctttgctaccctcctccttcccgggccagctctttgatctgccagctggctgtcagtcccccagcccagagagcatgcccaaccttggggccaccagccagcccagctgggtataagtcaccccaacttggagcaactggaagagcacactcgagtgacagccgacagcttgctccccagctcaggaaatcggtaaccttcctcatctcggggggaccaactgccacacagtcacattcaccctgatcattgagacactcagattgttttacagggatcctacggagcttgcctagaatttgtttttcatgtagaaaaagttacctaacatagctagtctgcatcaaatacttgttaaattacctggtgttgtctcccattattttgcagagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtaaccttgacaatgtgtttggacttgctcatgtggtgtctgcccgtgttgcgtctagtcccaaggagcaaggcgggtctgtgctctgtgctctggggcatggaggaggttccccgtaggcatttgtgtcaggatctgtgagtgccccccaggtcactgctgcctctgacactctccacgtgatggacctaaaggataagggccacgtgccatcctacatcctgtgtggggtgccgagggaccttaaaacagcagcagccacaaaatccacctctcaattgtgctcacatactgtgcgacaggggttggtgaattgtttctctaaagggtcagtgagtcaatattttaggctttgagaaccatacagtcttgcaccttctcagctctgccgttgcagtgtgaaatatgtaagtgaatgggtgtgtggctgtgcccattaaaatttccctatggtcactgaaatttgaacttcatatatttgcatatgatgagatattttttgtcttcagattcttttttatgtttttcaatcctttataacaataaaacccgttcatagcccatgggtcatacaaggccaggtggcagcccctatgtggatggcgaatcataatttgctaacccctactctaggaggtagcctgatgtttgcattgtaaatttggttggaaattaacttttatcttctccctccttcccatgttatgcctttcctggatagaacccgctattatgaaacttacattaggtatgtgctcattacctgtttttgtgttaaatactgtgatggtatgttaccagctggcctctctgagtgctgaagaatgagaaacacttctttgagccagcctattaaaggttatcataattcatggctgtggactcagaggtcagaggttgttgcttctaagcaaaggcaccttcagatccatatctctgtcgactctgttgccatccaaggactggtgtccacacacaaggtgcaccccatgggctggctcctgcaggcctcgcgatggcactaggagcatccattgtgcatttacaggggcctcagcctgtgtggctggcagctccggctgctctctggggtcaagcttcttgtgggtgctttgcagcatgacccaaacctcctgaaggtcaggaatgggatcttgtcattttccctgtagccctcaagatatgtgtagtatattccactccacatgtattgacctgagttgaattgtgggcggaatgcccattttgttgggggccaagggaggatgggtcttcctgtgtcatgttatgaagtgaagtcgggagccatgtgggcccaagttgggtgcaagaaagtggagaagtcagaggaagtgccatccttcctttggagagaggattgacatcaccacgtccttctctgaggactgaggccaggatgagccgggtttcagggagacttaccacattcctggggcagggcagcctttggaaacatggtggacatgttctgtgacagtttcccctgtggcactgtatccagaactcactcgaccttcctgatttgatacagcaggaggtcagtggccaggaagctcctttgttccaggttctgaagtcacactgggctggagctgggggactagaaggagagggagggatcagagcagatgccctgggaacccagggtctttttccctaggtccatttttttgttctgttctccaaattgcacctattcctttggctccaaggcctctggacacaatggtttgacaccaacattgtgcagggcactgagagagaccctatcctggcccgcaggcacaccacacacacagacacacacacggtgctgttgccagaagccggaacagtccagtgctgcctgaggcaggtgcgcgctgggagaagccaggagcacccgggcagggttgccggccacaggcagaggtgcagctgcagcaggaattatctgccgcctgcccaggttctcagatcctctctcccaactgcaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggtgagctgctctggctcctgtggagagcgggaggccgccctgccctggtgctcggcccactccggaagccagggccaccggcagctgcacttgggcttcccctaaaaagcaaaatgggagcagaaactccaggccagagggagagtggagctggagaaagagagccgcagagaggcagggtgagggctattctttcagacctgttgccttatttccactaggggcctctgaggccttttagtgaaggcttgggaaatgggagatgggcctgcttcgtggctgggttaatgcctttccaccacccgtctttggagagatcagtttttgctgaattaacacttggagctctggcggccccagggctctgtgtggacggcggcttggccagcctggagctgggccaggtcctcatgcacagcacctgcctcctgccacttcaaggggtctctcggggagatgaagaaatgaggggtcactcagcagaggggtccatcttgcttctgtcctacagaaagaatgtttgttagtacaatgggcactctgctttaggaggcgtagcaggcggcacaggcggatgaaaatcgccctccaccctcttctctgaaccgcacctcactgtgaccaggggcccagtgaagtggaagtggaatggcagtgaggtggcttctggcatctgagccacagcctgaccctcaccctctgctcccgcagcccttccccgtgcctctctcaaatgcctgacttctgaaaccactgactctgagccagatgaactcgtgttcccttctctagggcttttgctcacactgtggcccctgcttggatgccctcactccgtctgctggcctcatcccccctgtcgagggcctgctctagggccttgctttttatttccatgactggaattgaaatccctcccccaacccccagaaaagaaaacctcacgaaccgcatgagttcctctcttccagcactggccctttccagctcgcatttgatttctgtgtgctcatggcattttctaagcccattgagggtggggctcatgcttcatgcatcttggtgtccttggtgcccagcacctggcagagggaaggcactcaggagaggggctctcacggaggaaatgagtgggtgagagcctggctcacaggacatctgcgatccacatttgccctggagctgagggatcaaaactgccagcacatccctcagcacaggcctccagtcctgtaatggcccttggtctccatctggaatcttccatgaaactgaggccagccttgttctcagccaatcctactgtgtccaagggaggaggcggggagaggagtatggatgtcagtctggcagggttgagtgacagagcttgttacctagaaccttactgccctcctctctgacctccaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatgtgaggccagattttttgttttgggtggaacctcccggggaacagtgtacctctcccccaacccccgctctgggggccggtgatggatgtgtgctgccaggtcaggatccttagtcctcaagaccagcccccagccagagagtgtgtctgctttccttcctttctcatccatatctcacgtgatagagctctagcctcttcagtgctatgcttgactctctttgagaagagagaggctgtggggccctaagattgcacgcacacatctggtaaggggtgttttgcatacatagcattgtctttgaacctgggaccatcctgagagggaggcaaaccacacacatgcttttgctgttgtcagccctgctgcactctgtgatggggtgactgagcccccaaaggggaagagtgggctcaagtgcagagctggctgtgccgcaggcctgtcttgcaaaaccccatgcctctgagggccacctgggcattctggtgtccatctgtcctcaggcccctccaagccttatcctcctccctcatctctgctcctcctccctccctcatcttccctcctcctcctccatcttccctcctcctccctcatcttccctcctcctccctcatcttccctcttcctccctcatcttccctcctcctcctctatcttccctcctcctcctccatcttccctcctcctccatctttcctcctcctccctcatcttccctcctcctcctcctcccgcatcttctcctcctccctcatcttctcctgctccctcatcttccctcctcctcctccctcatcttccctcctcctccctccctcatcttccctcctcctccgttcctccctcatcttccctcctcctccctcatgttccctcctcctcctccctcatgttccctcctcctcctccctcattttctctcatcttccctcatcttcctcctccttcgtcttctagcatcttcctttatcttcctcctccctcatctaccctcctcctccttcttttccctccccctctcctccctcctcctccctcctccctcctccctcatcttccctcctcccccttcctctcccttgccttccctcctcctccctcactttctctgcttctccctcatcttcctgtcaagtctgtcagtgccctctgctcacggggcaggttctggacttgttggtccccttcactctggggccaggaaacccatcccacctagaggggctggggctggggctggctgcttccacctgctttccctctgcagcggtgggtggcaggagctggcggatctgggtcatcctgagcaaggaactccagctgggggaagaggtgcagccctggccccttccagcccttggctgaacagtttcattttggacatgtgggcattttgctgatggttaaggactatccatttctggaatttctgaggaatgaagcatatttttgaacaggactctaatcagtaaccaaaaatagccgtgacacatcggcttctgagtctgccaactgcatatactataaagagcaccactgggaggtgcccagggccctctgcctcactccaactgtcacagccccactggggagtgtgaccagacccatttccatggttaatatttaattcctcagccctgaacacatgcagctaaatgaagtcactcctttcccataaatactagatgaagcagatgcaggtgaggccgggtgatggccctcgcccttgtgagttccactgccttcctcgggcctcggcctttgtctactgcctacttggccaagcaagcaagcacatgaatcccaccagccacagtgccagagaggagctgagtgggcaggagtggctgtgctcttgattcataaggtggttttgctttgctgccccgcagctcagaccttggacaggaagaacatttccctcctccacctgtgttctcagctgcagggggattccctcctcctccagagagtgttgtgcagagcacatgagatggtggggatccctggagcattttagaaatggaaaagcaccacatacaggagagggaccgctgctctcctttcccagcccccagcccggccattcgatctggaaacctatgctccacagcacagttggcccctgggtggtgcgtggagggaaggctttctgatgaggcagccgtgtgtgtcccatgtaggcaactgaaccaggaggccccacagtgcgcactgggcacgagagaccaggactggctgtctcgttcctctctgctgggcagtgcctagccaaggactcagcccggtctcttgtgtgcagccccagtgtgcctgggagtcctcccctggctaggccctgggctttccaatagcggaatgaggggcatgtggagttttgccagggctgagaaaggaggccctgtgatccgagaaaagcagcggtcaagataggagccatagaaatgccttgtaaacgataggtgtgctctcgacagaggcccctgcaaggggtaggaggtttctgggaggaggctgctggctgtgtcttagggccccagaattcagactgatctcccgggcctggtgccctgtgaagctgggagctgtggattgtcttgttaacctctgtgtgagcctctgttggaagagctgttagcaggacaagcattttcttaaaattagaggtgtcctttgtttgtattcagtgctagagaagctgaatctttcccaacaaaaataatttgcttattacctggtcaagctgatcagtgcaggtaaagtccctccctttaaaacaggtgtaaacacaggagccccagcaagatatgtcagctgctggggacacttagggtatctggaaggtgacagtgggaagtgtcgtggggttctggcaggacttgtgttcttgcactgaagtgctgtgcgctccccacagtatgcagggccagggcttctgactcggatcagttgccctatgggctgccttcactcctcctcctgagaacaggcgaacgtttaaaagtagtaagttctctttgggaggctgaggcgggtggatcacgaggtcaggagatcgagaccatcctggctaacacggtgaaaccctgtctctactgaaaatacaaaatagtagccgggcgtggtggcgggcgcctgtagtcccagctactcgggaggctgaggcaggagaatggcgtgaacccgggaggtggagcttgcagtgagctgagattgcgccactgcactccagcctgggcgacagagccagactccatctcaaaaaaaaaaaaaaagtagtaagtttgtactttaaaaaacatccctcactggggcttctgccttcatcctctcctactaaagtttggagacctcactacctaatctttctcttggacaaaccgcatgcttcttcctgggctcgttgctgagcatccggggccaccctgactctgaaagacggtgtcccggcagagaacttgcttcacagctgtgtgatgccctttgctttcccagcccaccggagatcctccttcaactttgagtgcctgcgccggcagagcagccaggaagaggtcccgtcgtctcccatcttcccccatcgcacggccctgcctctgcatctaatgcagcaacaggtgagcggcccacctggccttgcccccacacctaggggcaccccacataggacccccatcaggtcactcccttctccttggccttaagcaccaggagggaaggagagaatcttcacctacagtctagttaatctttgtaacaatcctgtcaaatagctatggccatgagtcccatgctgcccaagctcacacaagtgactgctggcatttgaatccagggagccagctgccaaagctggcctcactgcccaggtgcctccctgcgatccccaccacctcttcctggcattgaatacagagcctgatgtgatctgagctcagggagtgggggccacttggctgattctgaacaagcggtgcagcccttcattttctctaagaagtggttccttcattaagtttatgggtccctccatgggcagggccctgtgggtactatgcagggttaacctcccctgcctacaaagggagcagtctggggagaacagtttgcccacgttgagggcggctgcacaggcaagagggtggggccggagcccactcactagggctttccctcaaggataacaatatggcgctttttctttctgaaaatatcacatcagagatgccattcattcgtgcacgacagggtggtgggcatggacctgtgctgtttacagacagcgttccccgtccctctctgcagagtgtgaaccccaaggtgcatctgccgtggtgggattgtaagaccggggcttgtacccagtgctttagcacatgccaaatgccggctctaggatgcattactccagagcaaagagaaccagctgttttcctataagtgctgggaagtggtagtttcccctgaatgtacttcggtatttaaacccagcatgaactgggtggtgtgttcacacccacagcttgttgggcttccctgattcttcattctgaagcaatttcatgaattagcaactgatacctccttgggaaaagccaaaggaaatgcattatggattcggggtaaaagaaagcacagtctgctagaaaacaaagtcatcaccgcccattcattcagcgtacttcagtgtgcccatgtcctttccaagtccttgcctggactgcccctggcgagcgcagcgccggtgcttggtctgtgcgcagaaggtttgaggcccggacctctgagaacctctggtctcccaacagtcccctctttcctcagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtgagtacggttcttggccgtggtgggcaggaagcaccaggagcagcagaggtgcaactgtaacagcaggaagggcagtggtgggagggcggccaggctgtgagctaggctgcctcaatcagacacttctgagcagcaggaatgtacctgaagcatgagtaaaaactggtcaccaccactggctgcagtggcttacgtctgtaatctcagcactttgggaggccgaggcgggtggatcacctgaggtcagcggctcaaagaccagccttgccaacatggtgaaaccccgtctctactaaaaatacaaaaattagccgggcgtggtggtgtatgcctgtaatcccagctactcaggaggctgcagcaggagaactgcttgaacccgggaggtggaggctgcagtgagccgagatcacaccactgcactccagcctgggccacagagcgagactcttgtctcaaaaaaaaaaaaaaaaaaaacaaaaaacaaaaactggtcaccaccgtcaattctcataaatgagctgtgctggcattatgggtgctgttccggcatatgtttctagtttatactaaatgtctttccccagtgggtttcactcttgttgggccatgtgtagttttttagctccaggacattttcaaagccatttacactagttattatgtatgaggtctagaaaacatgattgagctgcatccccaaagcacacggtgcagttaagttagcactggagttgatttttctgtcgtccccctgccctgcaaagccttataacacccccatgccatccatccctcttttctgtacaggtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtaagtgaattacagagcaggtccagctggctgctctgccccttgggtatccatagttacggttttctctgtggcccacccagggtgttttttgcatcgctggtgcagaaatgcataggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagggctgaagttttcattagaatgcactcacactctgactgtacgtcctgatgaaaacccacttttggataattagaaccgtcaaggcttcattttctgtcaacagaattaggccgactgtcaggttaccttggcagggattccctgcaatcaaaaagatagatgataggtagcaattttggtccaaaatttttaatagtatacagacaacctgttaattttttttttttttttttttttgtaaataacaaacaccactttgttatgaagaccttacaaacctcttcttaagacattcttactctgatccaggcaaaaacacttcaaggtttgtaaatgactctttcctgacataaatccttttttattaaaatgcaaaatgttcttcagaataaaactgtgtaataatttttatacttgggagtgctccttgcacagagctgtcatttgccagtgagagcctccgacagggcaggtactgtgccagggcagctctgaaattatggatattcttatcctcctggttccttcggtgccaatggtaacctaataccagccgcagggagcgccatttctcctaaagggctacaccactgtcaacattatcctggactctgtgtctctctctgttgggtcttgtggcatcacatcaggccaaaattgccagaccaggaccctaagtgtctgatagaggcgatgatcttttccaaagtcagtacttacaaactggcattcttacaggctgcaccatttcctagtatgtctgctttaagcctggttcaacctctcatcgaatattaaatttttctttgtaagaaaaatttgaagttgtagagcatggttttttgttttcccttgtcttaggaaagttttaagatgaaatgtttttcctttttggtcccctccccatctgaaaaacacacatttttgtgtccacaggaataacacatttagtttctttagtcttatgtttttcataatctcacaaaatgtaaatggcagctatgatttcaccgtcaactg

SEQ ID NO: 11853 - DNA, 24522 bp, Human
aaaaaaaaaaaaattgggttgggctcgatggctcatgcctgtaatcccagcactttgggaggccaaggcaggcggatcacttgaggtcaggagttcgagaccagcctggccaacatggtgaaaccctgtctccactaaaaatacaaaaattagccgggcgtagcggcgcgtgcttgtaattccagctactggggaggctgaggcaggagaatcgcttgaacccaggaggcggaggttgcagtgagccgagattgcgccactgcactccagcctgggcaacagagtgagactccgtctcaaaaaaaaaaaaaaaagcagtccttttcttctgatctggaacacccaatgtaaaaatccaagaagaacattctggggtttaagaagtctacatctgaattgaggctccaactcatgattggttcctgctgatcaccctatccgtttcatctcaactttcctggctgagaaagtagaagagagagaaagggaagcaacatttatgctacttcctcacaacaacacgattagcgttgccctcattttacagctaaggtaacagattcagaacacagatatttctgattgcaaagcccatacttttgcggttatgccagcctttcttgtctccaaggggcaggtggaaaccctgctcagggttggaactctcctggaacgtttctaatgggcttcatcttcactcactgctccgccttccccaaggtgttgtgatcagaggaatgacagactgaccattcacttgctattagagttgggtgaggaggaggagtcccatagtctcctgtcctgcggaacacagcaaggtggtggccttattttaaggtcacttgacctggagagggtcttctccatctctcctttctgtggagcaggagaaggggtggagtaggaagggaatgggtcctcctgtcatgagtgaccccttcattgaaacttacagcttctccaaacaccccagcaattcatttaattctccctcatcctcccaataataccaggtgacacagactccacagtaccagcaaccccattttataggagaggaggaaactgatgctcagagaggtgatttgtccggggctatacaaccagaaacagcctgagccaaattggcgccagagtctattgcccagaatctcctattcctcttctctccaccagtcatggtgggtggcatccagatcttggatgtttctccctaaatcaggggtaaaggtggcgcaattctaggtcaaaggtcatgagatctgattttaccagcttctcctctctcagctccatatttcttcctcttttctcatccaagagcagggacctcacccagccccattcctggccttttggaagaacaggggttgggggggcggtgtatcctagtgactgattagggcagaactcctggacccctgggatttattttgctgtctctattggacaccctccccatctcagcctcagcctcccaccggcagccccagagccatgttggagggagaggcttttctgtttggtttgaggcagcctgggccccacactggggagaaaggagttaaagccaggtcccaggatcaccgggaccgggaagttccggtggtccaaacaggagtgggttggggggacccgcaggaagagaggtttgggacaaaaggggggtggtgccagccatgccaatccccatcagcgctcggcatccactggtagaccgcccccccacccctcccccaagttccacgcctagtttctgccttcccgccccagcgggccgcctgcaccccacggccagtcagaggcccacctgcggccacctagagccgagaggggcttgcctccctgctgccgcacgcccattgtgtgcgccgagccggcggaggggctgcgaggggcggggccgggcgggcggagggagggagcgagggaggggcgcggggagatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcaggtgaggcgtggtggcccggcccaacgggagggggtcgctcccgcggaccgtgttaaggtcggctcgagaggcgcgggagaggaaggggttatatgccgggcgcggaggagagagggatgcctgcgcgccccccatccttgcaggttgtgattgatgggcgctgggcctggggctgggtggcgatgctgcggagcggggagggggcgggtgggctgcctgtcaccctcgcctccttatctcccccgcgtcaaggttcctgccgcttgggcaccagcttcagtgggctgagcgtgggggtgctggtggagggggatctgggccttgagaaggggaggttgaaagaggctagaaagcgagccaggcaaggggggcgacgcagagcacgctcgggggcgccaggcgggtgtgggtggggcgggggtggcacgaggaggtggccgaggcgatggtcagagggcggtgccaaatgccaacaggccttcaaagccgcagacactggttctcgagggtggggaaagagccaaccccggtcgaggtcccctcccagccacctgggctccatctctatgtcggacctgctcccctccccccacacccacgttgacttaccccacccccacccccgccccaaaaacgcctccaaagtttggaaagttggatggatgccaactcataggagggggggaagctgttttacctgggggaggggtctacttctccatccccacccgcacacttttcctacacccctggttactcccaggaagtggcattcttgggcgcggtgggttctcatggggtgaccagcaggctctgggatggtcgcgccaggggatttctttgggagtgtccttctccaaggatagcattaactcttctgttactgtggccaccagctgtaaccaccatgataatgtgactgatgggtatgtagaggggtcaagtcagacctaaaaataccttcctccaccccaggcccctttgagcctgggaggcagctgactggggccttcctttcagctgtcccctgtccctctgagtgccactccctttgcccagcctggcagtggtgggggagggtggtgtctgggattcactgggtgatcctcctaggtttgtagggagcatcacaacttgagttggggtatatgtctggtttgagagaagggcggggaggggaggatcttggaaaggtccccaggggccctcctctcccattttccatcctctttcttgtaccctgatcccagcagccaaagcccccagtctggtcatggcccctccaggttctttggccaaagaaagtctaggatggagaccaagggcggggacttggaagtctgagccctcactcactctccccattctgaactgggctgaggccaagtgtgtgtgggtacaagctggggagggccagaagcagctcttcttacaagaggactggaaatacctgacgcccttaacctgaacgtgtggcttcctgaatggtcaggcggtatttcctccacccggtctctgagactgagccagcttaccccctagagatctgtggggctgtgtcctaggctcatgtggtgcggggccgagggacatttagattgacgtagcctgatgggtaccatgggcatggggcatgggcagtggcagctgggggccacagggtagaagcttgatccctcttgcccccttggggaggattgtagctactgtgattgtgagagagggagctgagaaaaagtcctgtctgggcaagggatgagagtggggagcaaaatttgcccccatggtgccagggatcaggctggatgtttactctccaaatacagttccatgcccctactccctccccagaaatctggctctgagtctccaagagagctgtcatcccctccctactctgtgaatagcgaagggaagagttgggcacaggggagaagccaggctgggccctgggttggcagttcctcctctctgggggccaccaacacaaacagccctgctctgctcctgcggagggggagtgggggtgactttcccgctctccccacccaacacccagcactgccggctgcctctcccttcctcggaggcctctgcagcctgcccagcatcttaattagctctgctgcctaatgagcctccagcttctccgcgcctccccccttcccagcctctctggcttggtttggtggtttccgtgtgggtcttctggggctctcttgcactggtccccactcctggctgtgctctgggccctctccgtgaggatgggagaccctccctccccttgggtcgtaccacctcaggaggaatgtgcaggggggtggaggtggggctgggagtgctgttcccaagcttggctgtagctctggggctggcaagatgagggttgggaaagggcccttctgattctactcttgttcctttcctggcctcttcagggcaaatacagcaagaggaaagggcgattcaaacggtcagatgggagcacgtcctcggataccacatccaacagctttgtccgccaggtaatggggaggctgggcggagaggagggaggtggctggttggtggagaccagcattggtgagccaggtctgcggtattgtccaggcacccttccctgtgccatttgtcacctgcctggagccaccccatcaccctgacaccccatgacctcttctggatgtgctgtcagcggcacccactcgctcagcccccgcccctgcccggcccctcccccagcaccaggcaccctcccctgctgcctgctggcctgcgtcatctcattcagggacagcctggcctgcctccctccagcttgcttcgggctgtcacccactccccctgccggctgtctgcttccatgtcctcccccagaatctgtgacagggttgggtggaggcaggtcctaggaaaagcagagcaaggatgtttgggtccctgtagtcctggtgaggtcctggccagggaaacacgctcctcacctcgagacatgactgtctaagaagcacagagaaagggtgatggtgacgggggtgggggtggttgaggcatgaggctgttgattttataatagagaagatgatagcccagcacccctgcctgaaagggtgtaactgagaatagctttctggggtcttctgtgctcagtcagtaagcggctgctctcatctgtcaaccctgggccatcttaggctcagggtgagggactgagagaggcatgtggttgctatgactacttagcatctcaccaaagcctggtacccaaaaaaggcgagaggggcttgggattagacaaggaaaaggcgtgtattgaagaggaaatgggcagggcatttgagggcagaagacagcacagaggaggggtcctctggagatgagcccctcccttccaccttgggccaggagcgagggtgatgccaggcagatccaccactaattagagtgaggcccttctttccgtttcttctgtctctacagcacttggcacatgtgagcctcagtctgacttgggaggttcaggaaggggaggcttcattctagccttttctaagtataggaacagacaggaagtcctttcttcaatcaccccctcatccctcctgttgcaggacatggccagggctgggaagaatgacgctgtgcttttattgcccctcttggcagaaaaggaccttggctccttcagtgtttgccaacccagggagtcagaccccagcctccaattcttcctccttttagctccccagctctgatccccggtaggtggtggggagtggtggaggggggcagtccttgccacatctctgagctaaatataccctagcagtctgcacatgtagcaactctgcttgtaacccgagcccccaagggaacgggcagtttgggccaccccctaggccagcagggccaggcactgagggtgccgggatggaggcgcccagccggaccctggtggtggtgagctggggatggagtggggtggcagcgggtagaacagcctctcaggaaagctgacggagggcagcctttactccagcgtgtctccatgcctcctcactgtttcctgtcttctgccatttctgatgtgtgcgtgtgtatgcgcgtacatgtgtctgcatatgtgtgtgtatgtgtgcgcatgcctacatgtgtgtctgtgtgcacctgtgtgtctgcatatgtgtgtgtgtctgcccgcacatgtgcgtctgcatgtgtgtctgtgtgtgtgcatgtaactgtgtgtgtatgtgtacacgtgcgcgtgcctgcatgtgtgttggggtcagtgagtgtgtgcgcgcgtatgcctgcatttgtgttggggttggtgagtgtgtgtgtgcacgcgcatgcccgcgtgtgtgttggggtcggtgagtgcctctctgctagtctgtctccctgtctgtttccctggctctttgactctgcgtgctcccatcaggggggagagggggagctacgctggttttctctccttctctccttcatgcctctttccccacttctgttagtgacccccgctccaccccaacccttcctccgcgggtctcccattttcattatttgtctgggaaagagatgggcagctgcaccagctaatgacctgaggcccctggggagaggtgggactttgtttctgtctttcccaggtcccctccatgccaaacttatggaccttcctggccaagtgacccttttctgccctcaggaaagaacccctacatccctgcagtcctcctcttttgccacataacctcctatgccttgtccaacaccacccctgcatagtcacacaaatccacacctcttgcctcctgccctcacatgtcccccaacctcagggtcacagatgtctgggagctcccccccagtacactcacatgtggctgtacacacacagtcatatgcagccaactatagagcacaccctcctccacacacttgtacttgcacatccacacacacacatgaagaagcacgtgcattcccactaccaggtctgtacgggcaacatgtgtcttacacatatgtgtgcatccctaaaggagtcccttgtgctctgggttggtcattgtggtcaaagccagctgtctggcacccagcagccctcatttcagggaaagccctgtcccatatcctgctcttaacttgcctcttcggtctgtaccagcctggaactcttgggttctcttgtgtcctaggagagcctgaggactggggctgtaagtagtgaagtttgattctggcagtaccagttaagaggagcaggggaggtaggagtctgtctccctctacccttgaacagaagctggcaaaatctgtggtggccccatcctgcggagcaggccgtccacggctgatagtgcagagagctcaggccgaagctggtggctgcagtccctggaatggatgccactggacctcagctgagtctatctcagcgggtgctgggggcaggggagggaaggagcagtgggagtagagactcgtccctggcattcctcccttgccttgtgcccctatcaggttcccacccctccctgggccccaagcagctgtccttgggcctgccttcatctcctgcttgctgctgtcaccctcactagggccacactttccccaggggcctgagaaatctcagctcctggtcccttccacctaataccaccttgtcttagcccttgtggtgtcatgctgggctggctggggctcgaggcatccatgatgggtggcacctccatgccttcccaggcccaggagctgggaggggcagcaatggccctgatctggctctctctattttcagggctcagcggagtcctacaccagccgtccatcagactctgatgtatctctggaggaggaccgggaagccttaaggaaggaagcagagcgccaggcattagcgcagctcgagaaggccaaggtgagaaagatgtggggaggggctgtgctggcatgatttcccccagtcctgggctgtagagagagcccagacagaaccagggccaagtcttgacccagccacttcctagtacccctgaaccttgctcctctgtccttcacctgcacaatgtgggctataatacctgcctgcttatacagtataataagtataataagtataataagtgcgtgttattatactgtttccacacataataagggcttgataagtgctaaaaatttcttttttttgttttttgagttgcagtcttgctctgtcacccaggctggagtgcagtggcatgatctcggctcactgcaagctccgcctcccgggttcacgccattctcctgcctcagcctcccaagtagccgggactataggctctggctgccacgcccggctaattttttgtatttttagtagagacggggtttcaccatgttagccaggatggtctcgatctcctgaccttgtgatccgcccccctcagcctcccaaagtgctgggattacaggcatgagccaccgtgcctgacctggtcctgactcttaatagctgtgtgatcttaggaaagtcacattaaaaggaagataataataccacttaacttcagaggattttttatttttgtgatgaatataaatgagagaatatgtgttaagtgtgtaacatggtacctggaacactaaatggtcattactgtcattattgttttttttaatttaattttaggccaggtgctgtggctcacgcctgtaatcccagcactttgggaggcccggttgggcggatcacttgaggtcaggagttcgagaccagcttgggcaatgtggtgaaaccccgtctctactaaaaatacaaaacgtagctgggtgtggtggtgtacgcctgtaatcccaattactcgggaggctgaggcaccagaatcgcttgaactaaggaggcggaggctggagtgagctgagatcgcaccactgcactccggcctgggtgacagagcgagactctgtctcaaaaaacataataataaataaatttaaatatttattattttttatgagacagggtctctctctgtcactcaggctgagtgtagcggcgtgatcacagctcactggagccttgacctcccatctcagcctcccgagtacctggaactatagaggcataccaccacacctggctgattttttattttttgtagagatgggatcttgctatgttgcccaggctggtcttgaactcctgggtgcaagtgatcctcctgcctcggcctcccaaagtgctaggattacaggcatgggccactgtgcccagccccttttatttatttatttatttttgagatggagtcttgcactgccgcccaggctggggtacagtggtgcgatctcggctcactgcagcctccgccttccaggttcaagcgattctccttgcctcagcctcccaagtagctgggattataggcgcccgccaccatgcctggctaatttttttttgtatttttagtagagatggggtttcaccatgttggccaggctggtctcagaactcctgacctggtgatctgcctgcctcggcctcccaaagtgctaggattacaggcgtaagccactgtgcccagctgccccttttattttttaaaaaccgacagggctggctgggtgcggtggctcacgcctgtaatcccggcactttgggaggctgaggtgggtggatcacctgaggtcgggcatttgagaccagcctgaccaacatggtgaaaccccatctctactaaaaatacaaaactagccaggtgtgatggcgcatgcctgtaatcccagctacttgggaggctgaggcaggagaattgcttgaaccaaggaggcagaggttgcagtgagccaagattgcgccattgcactccaccatgggcaacaagagcgaaactccatctcaaaacaaaacaaaacaaaacagacaggatctccctatattgctcaggctggtctcagactccttccctcaagccagtattgggattacaggtgtgagccactgtgcctggctgctattattattattattattattttattttattttattttattttgagacggagtcttgctccatcacccaagctggagtgcaatggcacgatcttggcttgctgcaacctctgcctcctagattcaagtgattctcctgcctcagcctcctgagtagctgggattacaggtgcgtgccaccacgcccagctaatttttgtatttttagtagagacggggtttcaccatgttagccaggctggtctcgaactcctgacttcatgatccacccaccttagcctttcaaagtgctgggattacaggcatgagccattgcgcccggcctataactattatttaattaatttattttgttttgtttttgagacggagtttcgctcttgttgcccgggctggagtgcagtggcaccatctcagctcactgcaacctccacctcccagattcaagtgtttctcctgcctcagcctcccaagtagccaagattacaggcatgtgccaccacaccatgctaattttgtatttttagtagagacagagtttcaccatgttagtcatggctggtctcgaacttttgacctcaagtgatccacctgccttgccctcccaaagtgctgggattacagcagtgagccaccgtgcccggcctgctattattattattttttctgggtatcattgtgggcttccccacccccaacccttttcattcctgagtgccccgcctctaccctgagagggctgaattccacattttgctttcttgttttttattgtaaaagttaatatacatggagaaaaccacacaagccaattcagtatacattttttttttttggcggagtctcactctgtcatccatgctggagtatagtggcatgatctcggctcactgcaactctgctgccctggttgaagtaattctcctgcctcagccttccaagtaactgggattacaggcatctgccactgcgcccagctaatttttgtatttttagtagcgacagggtttcaccatcttggctaggctggtcttgaactcctgacctcatgaatccacctgcctctgcctcccaaaatgctgggattacaggcgtgagccaccacgcccagacttttttttttttagacagagtcttgctccgtcatccaggctggagtgcagtggtgccatcttggctcactgcaacttctgcctcctgaattcaaatgattctcatgcctcagccccctgagtagctgggattacaggtgtgtgccaccatgcccagctaatttttttgtatttttagtagaggcagagtttcaccatgttggccaggctggtctcaaacgatccacctgccttggcctcccaaagtgtcagtatacattttgttgttgttgttgttgttttgaaatggagtcttgccctgttgcccaggcttgagtgcagtgacacaatcttggctcactgcaacctccaccttccaggttcaagcaactctcctgcctcagcctcctgagtagctgggattataggcacccaccaccacgcctggctaattttgtatttttagtagagacggggtttcaccatgttgttcaggctggtctcggactcctgacctcagatgatccacgtaccttggcctcccaacgtgctggaaatacaggtgtgagccaccacaccctgcccatgtccatacacatttcaaggaactattataaagtaaacatccaagtaaccaccactactgtcaggaagttgtacattacattgtggtttgccctctagttgccatcctcccctgtgtgcctcctctagaccaagccagtggcatttgctgtgcggacaaatgttggctacaatccgtctccaggggatgaggtgcctgtgcagggagtggccatcaccttcgagcccaaagacttcctgcacatcaaggaggtgggtatctggagggagggcagggaagtgggtgccaggagacaggcagccagagtgctagtggacaaaaggcttctgagccaagcagagccaggctgaatctgctgtgtgaccttagacaaatctctccacctctctgagcctcttaattttctactggaaaaatgaggtggtaatgcttaggtcagaaggttgttgggagggtttgttagggggcctgaactggcatggcggtgtgccagggacatgtaggtatccgcatttactccagcggcctttgtagagtagggtgggcacatggggagaaggactctcagaattgcattgggccggtggcagggtggtccatggccagaaagcatgctggtcctggagttgtcctgagaattggcagctccactcagaggctggagccagggctggggatttttgagggtgccacccctgggctgggaggtgagtctgggcgtttcccctagagagtgactgctagcttgcccctgcagtttccctcttgctctttccacccacctgccatattctttgcagaaatacaataatgactggtggatcgggcggctggtgaaggagggctgtgaggttggcttcattcccagccccgtcaaactggacagccttcgcctgctgcaggaacagaagctgcgccagaaccgcctcggctccaggtgtctgggtggggcaggggaaggggatgctgccaaccccaggagaggccatacagcctggactaggcctcaatggttgtccctggccctgagggcacagagctgcctgtggcatcaccagtggggctggagcacctccgggggtgccgcatgtgagaggatgagagccccccacgcccacctctttgctcacaagctcggtttgcctctgcccacacagcaaatcaggcgataactccagttccagtctgggagatgtggtgactggcacccgccgccccacaccccctgccagtggtaagagccatcgccatgcaggggtttgggaagaagctcctgggtggggtggtctccccactccctgaatcctcctttccctgcagtaggaaacaccccaatcctgagtcccccaagcacatgcagtggttccccctccatgaagagtaggctacccctcaagctgggcctgtcatgtctctcctctcccttttctttggtagctccatctctctgcctgattcccctgccctgcccccattcatttctcccagccctgttccattcacctcttcttctttcttttttccccatccccatccctgcgttctgtacttgtgtctccacgttcatctcactccttctccccacctcgcctccctcctccctctctcctgactctccggtccaggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaaggtaattctcgctgtgttcttgcaagaggtgggggagtcagggccagcactttggtggagggaagggggctgtaatggattcagatgtggtaccaacctgttctgtgggcatcagggcttcctgctgaggtggagggaagggtagcatgggcacatccccctccacacacaactccaccctggcccgatctccaggaaggagatcttgcccttggaaggttgcccccacacctggggcagcagggtttggtggtcatgaaccctgacctctcccctcactcccaggggcctgctctggtgttggtgtctaccttggcatgtgaagcaggacatgggatggcattccttctttgcccttttttgactctctgggtgggcacatagtgggggggggctgctggctgcaaagcaagacagttaagggaacccctaaaatgggcatgttggcatgcactgggggcaggagatgggcaacaagataggggctgtcaccctctccagctcttttccaagacccagaagagggtaggatatgtctgaatattcccacatccactggactgactgtcagtcctgctcccagccctgatccagggccacctctggctcccccttggcgtggggtcccgttccccgtctctggctctgtctgtcactaacacgcatgccctgttatctctcctcgtctgcccggctctccctccctctcttgtcctggctcctgccttgccctctgcccctgcctgggtccccttccctctctcctcccccttccctctcttggcaatctctggacccagccaaacagaagcagaagtcggtgagtatcacagctttctgtgtcctcctccccactccctgggatgagctagggggaccttctaacacccattcccacatctgtcccccatttcccccacccttcctggttctccctggccatccctccccacccccaccctgatccctacatctgggctctgggaccagggtgggggaaggctgcatgggggagcctggagtctgggggagaggatctaatgtcatctccactctggggtttcccctccctgcttccccccccagacagagcatgtgcccccctatgacgtggtgccttccatgaggcccatcatcctggtgggaccgtcgctcaagggctacgaggtaggacttcctagaggggagtggatgcagaggggccttagaaagatcttcagaccccagagagatcccctagaagggcccgatcccaaggcatcctcccaggagggctacagactttcagagacaacccccagggggcccaatccacagaaagacccactcagaggagccccgtcccccaaagaaaccctcagaagagccctcccagagatgccacttacagggaccttggaaccagagaccccagtggaggcccctcagactcagacccccgcccgccgtaaaggcctgtccagaagaaagtggaacgtgagggtacaaatacccagcgactcagagtctgagcggctttaaatgcctgccttctcctccctccctccccacaaacccccacccccaggttacagacatgatgcagaaagctttatttgacttcttgaagcatcggtttgatggcaggtaagatcctgggagctgctcctcgcacctgccgttgctctctgctgctggggatgggcaggatgcctcgaatcacaatcctgggactcggactgaggaacagaaggcgggcctggaactggggagtgggcagggcattccagcccaccctgacccctgactcccctcttgccccattccccaggatctccatcactcgtgtgacggcagatatttccctggctaagcgctcagttctcaacaaccccagcaaacacatcatcattgagcgctccaacacacgctccagcctgggtgagcctactcctgctgtcttcactccccctttctgggccggatgtgggaggggtgggaggtgtgggaggtagtgggcagggccatctccagaagtgttccctccacctgctgttcctgggaggccacctgacattcccccatccacatgactccatgcccccagctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtgggtgcaggagcctgaccctggccaggacagcgtggtttgaaagggctgcttgggtttaaatcccagctccactgcttactaattacgtgaattaatctgcctgagtcttagtttccttctctgtaaagctccatcgtattgtcaagtgtttcaacctcatatgaatgtatagcacttagcaaatggtctgatacaacatgttagctattatttactattattagggtcatgcagaccagtcccctgtctccactctgattgacttcccacccttggactgaaagaattctgtgctttttgttccagtgccacccagctacttggcagttgggaggtctttcctttcttcttcttcttcttcttcttcttcttttttttaagtcaggatctcgctctgtcacccaggctggaatgcagtgatgcaatcatagttcactgcagcctctacctcctgggctaaagcaatccacccacctcggcctcccacgtagctgggactacaggtgtccaccaccatgcctggctaatatttttattttttagagatgggattagctgtgttgcccaggctgctttcctctcttgatatcagccctttttgctgcagtgtcctcatttggactttgatagaggggaaatcggtaggaaggccgccttactttttccttgtattgcagcaccattaactttcccttctagatgccagtggggatctgagaaacacggaggaagagttgaggtggaggatttgaagttagaagacagcatgggcttgaaattcaagctctgattggtttacgtattgatttattcttattgttggttgttttttattgaacttggaatcttgggggaattatttagcctctgattctctatttcttcacctataaagtggggttgtaatccctctcgtgttattgttgagaggattgctgtaaggagcccagtatactctctgatttatttatttatttatttatttatttatttatttatttattttagacagagtcttgctctgtcaccaggctggagtgcagtggcgcgatcttagctcactgcaacctccacctcccaggttcaagcgattctcctgcctcagcctcctgagtggctgggactacaggagtgtaccaccacggcccggctaattttttgtattttttagtagagacagggtttcaccatgttggccaggatggtctcgatctcctgacctcgtgatctgcccacctcggcctcccaaagtgctgggattacaggagtgagctaccgcacccagcctactctctgatttatgagggcagccaatagtggtaaccattatcatcccatgagctgggctccctggaccagttacttaaccttttttttttttgagacagccttgccctgtcacccaggctggagtgcagtggtgcgatctcactcactacagcctccgcctcccaggttcaagtgattcttgtgcctcagtctcccgagtagctggggttaggattacgggcacacaccacacctggctttttttttttttctttttgagaaggagtctcactctgtcacccaggctggagtgtagtggtgcgatcttgctcactgcaacctccgcctcctgggttccagtgattcctctgcctcatcctcctgagtagctgggactacaggtgcatgccaccacacctggctaatttttatatttttagtagagacgggattttaccatgttggtcaggttggtcttgaactcctgacctcgtgatccaccggcctcggcctcccaaagtgctaggattacaggtgtgagccactgtgcccggccacacctggctaatttttgtatttttagtagaaacaggttttcaccatgttggccaggctggtctcaaactcctgacctcaagtgatttctcctgcctcagcctccctaagtgctgggattacaggcgtgagccaccgcgcccagcctacttaacctttctgagtcctctgtttctaatgagataaaggggatgatgggatttaagtacttcctgaggggagttgaaaggaccaaatgagataatggatgcaaaaacactgaactagaaagtaaccaatgcttccatttcccccactgaggttaagaggagggactctggaaccaggcagcctggaccttctactccagggctgtcacttactggctctgtgttcctttggcaagcggccaaacatctctatgccttggtttcctcatctgcagcataggcatactgggtttgtgaagattaaataaatgggttaaccatgaaaaatgcttggtattgggccaggcacggtggctcacacctgtaatctcagcaccttgggagcccgaggccggcggattgcctgagctaaagagttcaagaccagcctgggcaacatgatgaaaccctgcctctactaaaattcaaaaaattagctgcgcatggtggtgggcacctgtaattccagctactcaggaggctgaggcacaagaattgcttgaacccaggaggcggaggttgcagtgagccgagattgcatcactgcactccagcctgggtgacagagcaagactctgtctcaaaaataaataaataaataaataaaaataaacgcttggtatcccagaactatatctgttccattttgtaagaagattttcattttcaaataatttcagatttacagaagtgtggcaagaatagtatcaaaaaaatcttattttttgaatattcttcaccaggattcactaactttttaacattttattgaggtagaattcccataccattaagttcagccatttaaagtctataagccaggcttggtggctcacacctgtaatcccagcactttgggaggctgaggcaggtggatcacttgagctcaggagttggagaccagactgggcaacatggcaagaccctgtctctattaaaaaataaaaaataaattaagtgtacagtctaatttttttcagattcacaaattttgaaacatttacttttatctttctttctctctttttttttttgaggggggacgaagtctcgctctgtcacccaggctggagtgcagtggtacaatattggctcactgcaatctctgcctcccaggttcaagtgattctcctgcctcagcctcccaagtagctggtattacaggcgcccaccaccacacctggctaatttttatatttttagtagagacagagtttcaccatgttggccaggctggtctcgaactcccgacctcaaaagatccacctgtctcagcctcccaaagtgctgggattataggcgtgagccaccatgcctggcctatattgtgtttcttaagaacaacatcattatcttacacaaccatgatgcaattgtaaaattcaagaattatttctaaaatatagtccatatttggttttttttttttttgagctagggtctcactctggctgcccaggctggagtgcagtgatgcgatcttggctgactgcagcctctgcctccctagttcaagcagttctgcctcagcctcctgagtatctgggattacaggcgcctgccaccatacccagttaatttttgtattttcagtagagacggggttttgccatgttggcctggctggtctcgaactcctgacctcaggtgatccaccaccacccctgcctcccaaagtgtagggattacaggcgtgagccactgtgccggtatagaatgcccttcatagcaacatttcccccaatccaggaaccaacccaggatcacttgttgcctgttgttttttagacagagtcttgttctgtcgcccaggctggagtgcagtggcatgatgtcagctcacctcaacctctgcctcccaagttcaagtgattttcatgcctcagcctcgtgagtagctgggactacaggcatgtgctaccacgccaagctaatttttgtattattattattttttaataaagacagggtttcaccatgatggccaggctggtcttgaactcctggcctcaggtgatccacccgcctcagcctcccaaagtactgggattacaggtgtgagccactgcgcccggcctagttttctttctttctttctttcttttttttttttttgagacagagtctcactctgtcgctcaggttggagtgcagtggcgatctcagctcactgcaagctccgcctcccaggttcacgccgttctcctgcctcagcctcccaagtagctgggtctacaggcacctgccaccatgcccggctaatttttttagtagagacggggtttcactatgttggccaggatggtcttgatctcctgacctcgtgatccacccaccttggcctcccaaagtgctgggattataggcatgagccactgcacccggccctctttttttttttttttttttttttgagacggagtcttgctctgttgtccaagctggagtgcagtggcaccatctcggcttactgcaagctctgcctccattcttctgccccagcctcctgagtagctgagactacaggcgcctaccaccacatccggctaatgttttgtatttttagtagagatggggtttcaccatgttagccaggatggtctcgatctcctgacttcaagatctgcccgccttggcctcccaaagtgctgggattacaggtgtgacccaccgcacccagccagtatagttttctttaatctggaaggcttcctcagcctttcttgaattttccagagactgacatttaggcagagtacaggacagctattctgtagactgtctgtccctcagtgtgcgtttgtgtgattgttcctcatgattagtttccggttttgcattattataattatggttcttgttgttgagatgagaatgataatagcagctatctaacaggattgttgtcaggactcaattgatcatgtgaaaagcacagaacaatgctggtatgtagcaagtgccccataaaggaagactgttgttgttgccgttgttaatatagagggtgtggctgggctcagtgactcacgcctataatcccagcactttgagaggctgaggcaagtggatcacttgaggccaggagtttcagaccagcctgggcaacataataagaccctgtttctacaaaaaaattaaaaaaaattagtggggtatgatggcacgtgcctgtagccctagttactgaggaggctaggctgggggctcgcttgagcccagggtagaggtgaactatgttcacaccactgcacttcagcctgggtgacagagcgagaaccagtctctaaaattaaaaaaaaaaaaaacaaaaaaaaaggagagtgggcgggcctacaaacaatgttagagaagttgagaaggagaatcactgcccttcatatagcccctaaggaaggctggcataacaccaggagagagcctgagctttgcatagggtagacacagggctgctgaggtcctttctgcagaggtgcccagggctgagagttatggagcattcaagggtcttgacactggctctccatgctgatccaaccaggacccgcctctctgactgggtgcattgcctgagtccctctagctcctcttccttttctctctccccaaaccaggtacttcaaaggctcatcaagtcccgaggaaagtctcagtccaaacacctcaatgtccaaatagcggcctcggaaaagctggcacagtgcccccctgtgagtgcctagatcccagggaagggaatggagggagaacatttgggttgtcctggtttcctctggcctacatgagagacagggtgaccaggaacacctgggtcaggcctgtgggtgcagactggtcttctgggaagagcgcaggtcccgtcagtcaaagactgggttcaagccccagaagcacccttctgcgtggagagtcaagccctgtctcccagccttggttgccttatctctagaatgagggagttggactgagtgccaaaacttcttgcagttctgccaatctgtagatctgagagctctccttcccttctacatccagaggcctctttttaaccttgtccttcaatcccttgactctacccactgcacccaggccacaccctcaacccccttggccatgccccactcatcccagccctgccccctaaccccgccttcacaggaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcagcttctggtgtctgtggtttttgatgggtctggggcttctggtgctgtcttcctgggcctggtgccataggagcgcatctgctgcccgctggatatgaggcctgatgggagcgcttttaagacaagggactaggaaggacatgcgaggaagactgataaactgattcgctggactccacaccctttttagacccaacagagcaggggccttcagagccagggaaacctacgttaaacctggactctccctccctggagccctgactccacaaggcccctcaagagggaccaagaatgtggcatcttctatgacttgatgctgaaccttccaccattctcccagttaaagtccaggaaaggacctcccatgggagacccatcctgccttgccctcctcccatgggagccacagcccacctcttgatggcacaccattaagtataaggtcttaagagccagaagaaacccatgaaatcattctagactgtagctttcaaatttgttttcagcaacagagcccatttgttcaatgaatcttacgtggaagctgaggatgttagataatgcatccttgctctgccctgagggagccaggggaatggcctcccctccacctccatggggacccctgaagcacttctgtgcccttcccacccaatgccaccccagatctctaggtaacagtttggaaactgctactcaggtctaacccccatcacattacaaccaagaaatgaggccacagagaggggaactgtttgcttagggtcacacagcttgacatggcaggggagggactggaacccctcttgtgccccacctccacgtgacatttgatgataaggacactgggccacctcttcatcttcagtaggagggggagacccagcagccttccccagcttgctgctttgagtgcttgttgggggcaagggaggaatcccatcagccttggagatggtgtcatccgactagggaatggtgggagaagcatggggttctggaagcctgagattggggtttggtgtgggtcgaagaagccagggtcagcaggtttgagctgaaatcccgttaatatatttggaaaaccaaaggcaatgactaaccgaatcaaccgctaatgagtggcaatactgagctgttaatgacagttagccccaagatagcattaatgacctgcactgaggaagcggtgactcatggctcacggctgttggccatagttgccctgagagttcatatgtcctcacatctgttgaaggtcgggtgccccctgtcccgagagaggagcaaatgccctgaggtctgtcctctggctgggctccagagccgtttgtccccggggcccctcccctagagccagcaccctcttcatccaggccggacctcttaatgctgtcactaacttgccttgctttgttgtgtttttctcacccctgcctgatctgcatggtgtgtgctgtccgtctgctaaccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggag

SEQ ID NO: 11854 - DNA, 16198 bp, Human
acaaacaacaagagagggctcagaggctgcagccatgtcccagcttctgggaattccccatggagatggtctacccacctggtgacaggcagtttctccacgagctgaagcaggggcggtggcatatgtcaacagtcagtcagtgatcagtcagttgtgatggattagcacccacagggaacacagaggtggggggacagggaggaagggaagcagagatgagaacagtggggagataagctctcaggagattgtaatatgtatgagagactgattttaaaaatatggaagtttggatggaactgcaataagcacaagccagtggctggagatgcgagggttcagctcagccctggggctgttcaccaggtagtcctggctcctcacatctcctctctgggctgcagattcctaatctgtcacaatagatcatgaagtttcttcccagttccaaccattcgttatgactttgggctctgggtcctgaaacctggattcctcattttctcgctgtgtgaccttggacaagtgacttcatgtctctgagcttccatgtccttgtctgtgaaatggcagtaaccgttgtagtccccttgtggattggtgtgaagagtaactgtgacaatggatgaaggcttagcagggtacctggtagatagtaagcactcactgaagatgagccactgttctgattatcatcatcatgaactttctgtgattctaaggctggaggccgaaacatttctgtccacatgggcagagtctctgtaaatcgtgtcaatctgaggccaggattttgaagctcaaggccccacccagctcaggaggctattcctggtcatgcgtcagcctctcggctacacccaaaaagggccaccctgtgagccgagaaggaagagatgacacaacccaggagagatgtagaggctggagcctcggagaccagcctgggggccaggcgggtgcacaggaccgtcggagggtggtcgatcccgggctttctgtgttctctgcacgcccatgagctcctaatgatcccctataaatcaacctattcattcttttttactcacacacttatttttcaaattcaaacataactggaaagtcgttatcacctgctgttaatagaaggcaaaaccaaacacagtgccctgaaaaacagaatgaccaagtccagcaggattcctcgtcctcttcgggccgttctcgctttgtttcaaaggacactttacaggcaataatgacactgacctcgaacagagctttgctctggacccagttttggggatggaaagagaattgaaaaggaagtaatgttctcgtggagggatcagagttgggtaaggccagacctgggaaccacctaaaaccttcctatggtttgggggatgccgtggggtttgtggctaaaacgcttgcctaagaggtggactccacaggccctggactgggttcccgggatgtcattagacagaatcctagcccctcagatcccaggatgagaacctactcactgccctgccggtaacaggcttaccccgtgggagcccgggacagccgtgcagcccgcagctcctggtctcctcccctggcctgggctgccctttcccatcagcccagagcaggcagatccccacccccggggccctgctgcccacctctcgccctctcccaactcaggcaccctgagctgctactcacagaggcctcaatctaccatccagagccttctctccttgccaccctgccccgccgcactggggtatttctggctcccagaggggcagaaaaccctgaaacccgagcagaagctgtcctcggtgccacgcctggagatgggcattaatagcagcctccctcaggcccctgacgcgtctgggcagctgctcagcacgtcccgcgtccctcggccccaaggccagcccactctggctcagccaggcacactaaacttagtggccactcccagctcgacaaccactgccaccccccaagctcggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccgggggtaacgtacccaccctccgtcccgatccccacctcctgctcttccccgtcatccccctggcaaagttgcccttgcgaaggaaggcaggtttctctgcctagaaatagggcagccgcccagccttttctgcccagggaagaagatatgaattgcatgtgtggtgctggtggctggggctgggttgtaagacgagggcgtttgtcccagctatttctgtctggctggaccttggggctttttgcccagagcagagagctgggcaggctcaagaaaggaactgcagctctaccagcccagggacttctgggccccacctgctcactctctccctgcaaagaaaagctaggtggctctgtgtcctcaggctagggggacccatggggctggcaggtttgttcctggcctcaaggcaggagaggagagagcataggcgatggaatttgcagggtcctgtgcagaatgaaaatgcagggttccttgctccaaattaccaaggatttcaaggcagtgacagcagcacatgaaaccacacatgggcccttgtgggctctgggcctggagcagctgcacaggttgaatgtctgtgaagcaggacatggctgtaggctgtaggtgagccacctgcccccaccttctttttttttttttttttttttttgagacaactttgtcgctcaggctggagtgcagtggcatgatcttggctccctgcaacttctgcctcctggactcaagcgattctcctgcctcagcttccccagtagctgggattacaggcatgcaccaccacacccatctaatttttgtactttcagtagagacggggtttcaccatgttggtcaggctggtctcgaactcctgacctcaggtgatccacctgccttggcctcccagagtgctgggattacagacgtgagccaccatgcccgacctccacctgtccttttgtcaggacttcagtcctctatgcatcctgtcttagctcagaccctgtcagagttacaaagcatttcctcaccctgtaatttaagcgtattcctcgatttcctaccgtgtgaccgaaccacacgttgaaggtaaggtccttttcaggagtacctggtagtcgcgtgactagcctctattctgcaaatgcagaggcttctggattcttagcaaatacagcactttagaggaaagagtgctcatggagaccaggcagccagggatctaatcgccattgcccactaccctcaaatgaccatccagggaggacaaagctcatctcagcctctgcttcttcctctataaaatatgggactgactctcagcaacgtgagatcccttcctcggcttacagacgcccatccacagtggcagtggagcagagtgatgtcagtgtgatgtcccacctggttttcaggattatttcctcttttatcagactaggtgttccttgaaacctgtccttcaaggacactagggctaagtccccaaagatcttgcagtctgcttgtgaggcaaagagcacagaccccatcctcccttgtctctgctccctcttccttccctcctgcttgctccagagatcccctcccttgttcagccccactggaggcccagaagactcataagtgcccagctgttgtagaaacaccaagtcccagggctgagagtgacaggtgtggccatgtgcttgcagggtatcgcatagcccggatgcccatgccccttggccactgctgagcacacccataaacaggaacagcctccagccaactcccctgggcagggcagggcagggcagggcagggcaaggcagcttcttcagggaccacacatggggacgtgctgttacagtcctgttcacccgtccttggaaccatctgccttttaaagtcagagcagaagactgggcagtgagcagaatccacacaaggaagagacaggctggtgagaggtgactggaccaattgcagggggccaacaggcattgcttggccttgagcctgacaggatctacctctttgccttcttagcctaaccagctatgaaccacacctcccacacttgtgacactgagcactacctttcccccagtaatcttccaaaatatgttcctgcctttttccctctcttttctctgcaaatggacatctttctccttccccatctgcccttcttgtgctccctgggaccactcttctctggagggaggaagtgggttcatatgtggcccgtcatctattattaacaacaataataataatggcacatacatgtagccctgtgtgccaaatattgttgtaaacgctttacatatattaactttgaaagacatcaggaaaaaaaatgatagaaaaagaacctccaaaaataatcttctccataatagtaatgagaaggctggcagaaatggtcagaatcaacattttcagaactctggaaattaaccaaagtcttgcagcaatccagcaagaaaaatgggtgaatctcaggaggaccagtgagttctgtggtgttttaacttgccttattcctgtttccctttcccagctctgtggtaaccttgcaaaccaacattccgtaatcacagtgaaaatcagcatcccagtagcctctggaggggagagaatggggttggatcaaaggcccattcccagagagttgtcattatttgacctgtctggtgattccctgaaaacccccacttgagaagctgtttctgtttgacctgactctgagctcatccagtgcaaatagtctttctccctggggatgtttgttgaaaataattagagatgattgattaacatcatggctgtctgaggcagtagataacagttagggaaaacaacaggctaaccaaaaaactggagactgaaatgtccataagttgctttgaaaagctccaacatattcctgggaatctaggaggccacatgcatgcacaatgctttatgcatgctcaggaaagacctgagaaggccctaagcactctctgccttatcttgagactctgttcaagcaggaagtgaaggctaaggcagagatgtgggtggcttagctgagcatgaaagtcatatgcacagagcccctcagtaaagactgggagaggcattgttgccaagcgttttaggaaatttataattggtcactaagctaattgaacagggatctcagtgatcacacatgacaaaaaacacatactttaccatcttagttcaaaaaagtcactaaacaaacaacgggaacaaatcttcaagaagggggaacaactgatttccagagttgccacattatattgtttaaaaaatactggctgggtgtggtggctcactcctgtattcccagcacttttggaggccaagtgagaggactgcttgaggccaggggtttgagatcaacctgggcaatatagcaagaccctgtccctaccaaaaaaaaaaaaaaaaacaaaaaaaaaaccccacaaaatatccaggagtggtggcatgtgcctgtaattctagctactcccaaggcttaggtgagggaattgtttgatcccaggagttagagactacagtgaactatgatcatgccactgcactccagcctgggtgacagagcaagactctgtctctaaataaataaatacatacataaataatacaagacacacaaagaactaaaatgataaggggcatacatggggcagggagaagtcaatagatctgtaaggaagccagatattggacttactagacaaaaactttaaatcagctatagtaaatatatccaaagaaaaaacaatcaaaacaattaaagatgaaaatgatgcctcatgaaatagaaactatcaattaagacacagaaattatttttaaggacaaaatagaaattctggagttgaaaagtacaataactaaaatgagaaattcactagaggggctcaatggcatatctgagcaggcaaaagaatcagtgacctttaagataagtcagttgagattagccagtctgaggaacagacagataaaaagaataaagaaaaatgacgagagcctcggagacttatgggacaccatcaagtttatgtaaagggagtcccagaaggagagggaaagagagaaaggagcaaaaaaggtatgtgaaaaataatgtccaaaagcttcccaaattggatgaaaaacgttaaaaatcgacaaatttatgaagcttaatgaactccaggtagaataaactctaagggatccacatctagacacatgataatcaaactgttgaaagatagagacagagaatcttaaaaacggaaagaaacaactcaccacatatgaggaatccttaataagatggacagccaatttttccccaaatctatggaggccagaaggtggtgggatgacatacatatattagctcacctaatcctcacagaaacctccgtgaaggccatgctattatcatcatcccaatcttacagataaagaaaatcaaccactgagagttgagatatttgacaaggtaacacaggtgatgagcagagcagccaggactcacactcagaccctaacattcaccgttttagtcaatacattaactactttacaacaacccagtgagtgggttcttattctacaggtggttcttattctacaggtgggtctcattctacaggtggttctcattctacaggtggttcctattctacaggtggttctcattctacaggtgggtctcattctacaggtaggaacagggaggctgagcatagccttccccaggctaaccagctaacaaatagaggttctccacccaagtcttgaatccagagcctcctttccctccagttccttctcacaccctctattgtgcatgaaaacacagctcctaaaagctctgacccaagtgaacacaaggagtccagcttttgacatggcatagtttgagggcagctggaccagaagctggtgcagtggagcagacttctcaaggtcccacttagtcttaaaatgttggaggctcagtgggcaagagttgtctaatttttccaaattagacagtcttagactccaaacagtcttagaaggacttccatgtacaagatcaacatccaagaccaattccaatgcctccagaatgagagtaggagcctctcccaaaggagagactatgtgttctgaaagtccaaatgaacccgcaaagaggccatcccctgcccttgggctgggtgaagtgctgcttctttcagactctgcctctttagggcaaggaggcaggttgccccagggcccactttgcctagtgccccattttccctactggtccatcttctctcagtgcgggaactgggattgtataaaagagcatgatactactgaccccaggaatttcatgggctcacttcaccacccacagaagtccatgccagaggcctaggccaaagccaggcttctcccatggaagagcagtgctctgaagctctagggtcaggtcttggagatttccagcccattttataaaattcttcaatcagagatgtggaaggagacacagcccagagaaaccactgttgggagctgatagaacttcttttaccaaaaggctaaaaacaacactgacatcaatgcaagttagaggcttccttgcacccctaaagtaccagtttctttggttttggacaaatccacaaagtatctttgaatatatgaaagtctccatggacagtcacttggcacactgatacattctcagtgataacccaaggcatccactaatcctgccagctgttccaactatcaaagaaagatccctattaactcaagttcagcttggagctaaatgtggcttctgctctaattctttgaaactggcacactacacatggttctgcacagttactgatgcccttaaccagaacactgggttagccagactattccatcccccagtcaagtctgagagctgagttcaccatatttttaataaataacccatttaatatttttaaaccgctgagtcttacagaaataaggagattaaaatcagcataagccatctgcagagacaaaggagaatggcacgacctcagagttcctaacaccccagatcatcatcctggcattggaatctttgctgacttagtcggaagcaaagctgcaatccctgagctttgtgtaagtgtgatggaagccagggcagcggggcagagaggggcatcccagaggcagaggcaggaagactgagagtctgcacaggaccgtcacggtccctctcctcttgacccatgactaagatgggtccacctcggatgtccttcctctttacgttgccctggatgctcagtttcccaaataatatccacctagacccaggaacagggcagggagggaaggggctcatagtagggtctgtccatctgaacaggaccctgcaccctcttgagtaacatgggcagatgcctggcctgatttgtcctaaatgaggcctgggtctgacgtgcccccacccctacaggggccattagagaccatgaaagggtttatggtctccaatgggcagccacatagcccaggagtggatgtttctctcaggttcagggcaggagacaccggtctttttcacatgctaagcccaagaaaggggagaggtcagcccatcagtcctcaggcccccagttcagccatgtaagagtgaagctgaggcttcctgttaccctgagaaggaatcctacccaccggaggccccctccctccatttgaggacacttaatggagaagagggaggaggaacactgtacctggaccaccaaaagaaaagcatccccccagaagctcacaacctggctcctgcagacacgtagcctacccctgtgtctgagttaagatcatttctatccaagcagccagcagccaggcggagcctggcgtttatctggtggggatttggtgagccaaatgctacctgtgtgagagtcacctcagcaacccaccaggtgcaaacagctgtgcccccagcaaggcactccatggccctcatctcagggccctccgctgggaaggattttaacttatggcttttgagcagtcagggaggcagctgaccatgaaatacacttgaattcagtcaattctgacaactgaaattggcccttcaagaatgaaacagaaacagaaatgtttctttgtccagagggagacacatggagacttatgacatagcatgggccattttgaagcagtgattcgagagatctacagccaataatctaacaaatagaagagatctgcattatgctttaaaatagcaccggatgcccagagagaatagcagagcaccaattctgacatcaccaccagcagtcagacaccccaggtaacgcggttcaaaaggaaagtgatttaaatatagaagcacacagagaaggctgtttatgccaggaatgggtactgctgctaaaccagatcccatctccaggggtcatttgcttcctcaacctcaggagaggcagcagccctggctctggggggaaggaggggcatggtatgagaccacaggcttaaggtgcaagaagaatgatttaggtccggttaaagaaagtcttcatcccaaagaaaagccttggtatcactgcaggtacatttccagaaagaactaggcatcaaccgccttatgagcacctaaatgaagcctggaagtgaagaaatgaattggcaaactagacaccatctcaactagagaaagagatgtttttctatttaagggtcactgatccacaggaaaagaaatcaatgaagggcctccacaaataaaaagcaaactaatttagttttggaaggaaacataatataaaataacccattcatccacttcctaaatcaagagcaaagaagataaaccgtatttagcaagaaataagactgtgctttttttttttttgagacagagtcccactctgtcacccaggctggagtgcagtgacacgacctcagctcactgcaacctctgcctcctgggttgaagcaattctcctgcctcagccttctaaagtgctgggattacaggtgtgagccaccacgcccggcctgtgctttgattttatagtatacctagctatgagagagagactgaaagagaaaaatggaaatgaaattatattttaaatcagcatgaatttccttgtgctgagcccctcccctctccctcatcaaattcagatttgcgttcctactgcccacagactttccatagcttttatgacaattatcaggtgggccaagcggctttgtgggggcaggtctcatctgggctgtctcgcaaagaccagggacccagtgaaaccacatgatggtcacattcagccctcgtaggggttccatctgcatccaggccatcccaatggccactcggaaaaagccctttgcagggcattttaaggggcctggagcagggttcccatcctggctgcacatcaggctctcccagaaagcttttgaaaaacactgtttcccaggtcccaccaatgaaccagggtgtgcctggattctgatgagaaacacagtcccaggtttggggttgatccagggtttctcaaccttgacactcttgatattttggcctggatcattccatgttgggaggacctgtcctgtgtgtcttgggatgttcagcaacgtctgtggcctctaccggctgggtgccaggtgtacccctctcaccaccaccataaccccaggcatcgccaagtgtcccctgggggggcagaatcggccccaacagagactgctgtttggttctttgttgattgtgcaccctgcacaccctgaaaaatggcttgagcctgggcctcggttaccctgtctgcctaatggggtgcagaacccacaggccgtctgccctgcagactcatccagcctcagctccctgaagacctcccagccctgcaggcaacctcattatcccactgagatgttgttctaagggtcaaagacagatgtttcagcccagattaaggatctggggagaagagaggctgccagagccccctgcatgccgagcagaatgacaccacgctctctgccaggcctctgtccttgctacgggttgctcccctcaactcacagtctgtctcctcctttgcagagaagaactgttcctacttcaggcattttaaccccggcgagagctcggagatcttcgaattcaccactcagaagggtgagcctgggtggaaaggggtctggggtgacaagaggggacttctgtgttgtgcaccactgggccagaaagtcattggcaaaagcactgacttcctcacgcctgatgagaagaagcccgtggtgcatttgaacaacagccttgtcagctccccgctccggaggccccaggcagccgccttccatctccagggcccggagcttccacacctcggggccagggagcgtttgcagaagcagcacctcctggtaggcccctacacaagggcagctgttgtgacgggaggtgtggatgtggaacaaatgctcagaagccccgtggtggctcttggtggcatgtgatagttagagtctgcagggacagtctgagtccctccctggcctagaaatccctccctgagtaccaggagggtgcggtgggctctgggagcttttcaggatccgcagagctcagacgcacacccattgtcgggagtacagacccgtgcctgcctgcgcccagacagctgcacacagggtgagtgggcagacacacagacacacactgacacacacagacacacacaacacagatacacacacacgacacacacaagacacagacgcacagagacactgacacacacacatgacacacaaaatgacacacagtgacagacacacactgatacacatgcatgatgacacacaaaatgacacacagtgacacacacagacacacactgacacacacgtacaatgacacagacacagagacacacactgacacacacgtacaatgacagacacagagacacacactgacacatatgcatgacacacaatgacacacacagacactgacacacacacagatacacacatacaatgacacacacaagacagacacagagacacacacttgacacacacacatgacacacacagacactgacacacacactgtggtgcatggtgtggtccctaacgagccatgacaagagctcccgtgctgaggccgcatgctgggtgtcccttgtgtttgcagagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtagactgggggatctgcctgagcgccggggccgggggaccatgtcgcgggggattctccgctccaccctcatgcccaccgcgagatttgggtgaggggcatttcccaggctccatccccatccaggggcaaacctggccaggccatcagcgactccaggtgggttggagggagacagagcttggcggtttgtccattcctctccacgactcaaccctcaaggccccaaagaaactgcccagagaatgattaacaaaagaaggaaagaaacgtggtcacctttctttctttttcttgggggatgaggaagagggtctcgctctgtcatccaggctggagtgcagtggcacaatcacagctcactgcagcctcgaactcctgggttcaagggttcctcccgccccagcctcctagtagctgggactacagacgtgcaccaccacacctggctaatttttcattgtattttaattttttgtagagacggagggctcatcactatgttgccaggctggtctcaaactcctggcctcaagcgatcctcctgcctcagcctcccaaagtgctgggattacaggtgtgagccaccacacctggccacatggttgcccttctgagggatgcaggaatagggtggtgggtggacaaatggatccttctgcaggttcccatctagaacctgccttgaggcagcttttcccccaaggcaaggtcaccgcctcctccatgcacacaggctgggatggggctggtggctacggcagacgcccctcggtccctgagcatgcctggctctgcccccaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctcctgcggccctagcgaccctcaggcttcttccccaggaagcggggtcttggcctggaaccttccagagaggaggcgggagcaattttagccccaccctgctcccatctgcccccctgcaacagtcgcaggctgcttcctctctctgagttcctctgggctgccgcaggctcccctgggaatagagcaagacgtgagtcctaacctggccacagttgggggaggcagagccagcaggtggacaggtgtttgcaggggcccaacttcccctggagctcagaggtgtccccactgtaccagcctctgataagctgcctccagttgtcctttatgaacattgcagggacaacctgtgtttgccagctgggtgttccgtgtaaatagccagcctgtctctttctcggtgataaaacacaccctctctggtgagcccagcgtcccctccttggcttccaggagccctgggaagcatttttaactgggtagaatctgactgtggcttgaaataaaaagctctcagaaaactcatgctttcctggagccttgcatagaaatcgctcggattcccagtcacatcaggggctcccctgacgccgaatgagaaggaaaggccggtcacccgggtatgttgaggtcttttgtggggacaagagggcaacgcacgtggcttagaggctctgaattccaactcgtatctctaggccctgagattgttttcgggagaaactagaaaccctctgatgaagcaagggtgttaaaaataggaggggttatttctagagcctggcatgcaacgcacctggtgccaacacagcgctaaagcagccagccagtgtctgatttctgatgttggatttttcttgtgaagaacatcaggaagcagggcttagcagttagacacttagggccacatggagagccatgatttgcactcttctgccttccaaaaccccgcagtacttgcccaggcttccaaagtggagttcagacatgatcggcagatgggatccttgccttgcaccccggagaacccactggagttcacgcttctagggcagggtttggcaaactatggcccataggccacacctggcctgccccctcttgctgtatggcccacaagcaaaaggtagtttttacagttttaaattgttaaaaaaataaataaaattttttttttttaaaaaaggccaagcgtggtggctcacgcctgtaatcccaacactttgggaggccaacataggtggatcacaaggtcaggagttcaagactagcctgggcaagatgatgaaaccccatctctattaaaaacacaaaaaattagccgggcatggtggcatgtgcctgtaatcccagctactcggcaggctgaggcaggagaactgcttgaacccgggaggcagaggttgcaatgagccgagatcacgccattgcactccagcctgggcgacagagtgagactccatctcaaaaaacaaaacaaaacaaaaaaacccccaaaacaatcaaggaactgggcatcacggctcacacctgtaatttcagtaatttggaaggctgaggcaagaagattgtttgaggccaggagtttgagaccaccctgggcaacacagcaagactccatctctataaaaaataaaaataaaataatttacagataaaaagaagaagaatatctcatgacacatgaaaatgataagaaattcacatctcaatgtctgtaaataaagttagattaacaccaagccacgcccattctatggctgctttcgtcaccattgagtagtttcaacagagatcttccatcccgcaatgctgaaaatatttactatctgaccctgtatgaaaaatgtgtgattacgcctgttctggaggaaaactacaaccatcagcccccatatcaacctcttactggtcccatctaaaagctgaggggaagttcattatttcagttcgcctgcggtatctcgggggtgtgggctgggctaggaggggtgtcagaggagactcactcaaagacgcaaagatccagccaggaaacaaacttgctccaggtaaaggagaatcagaagatgactgtcctggccagccagggagctggggccatgatttatgagtaagaaggaagagcgataacttcatcccattgataaccattttggaggttgatattattggtgtttttctttttttcttttttgagacagggtctcacgttggagtacagtgcccaggctggagtacagtggcacaatcacagctcactatagcctcgagttcctgggctcaagtgatcctcctacctcagcctcccaagtagtagggactgcaagcgtgcgcagaccacacccagctaatttttttttgttttttgttgagacagggttttgatatgttgcccaggctggtctctaactcctgggctcaagcgatccgctagccttggcctcccaaattgctgggattacgggcatgagccaccacacccagcctttttttttttttttttttaacagatcg

SEQ ID NO: 11855 - DNA, 91933 bp, Human
  misc_feature (1)...(91933): n = A,T,C or G
tgcaccctaaggtcctccacacgtgggaggggagaatctgttcaggaactctctgaagtcagtattcatcaagaaatgggtatttgggatgatcacaccacatgagcatttctatgaagcggacattttcactccaggcttcaatgtccttgattcagtgagagaaaagtcaaaggcctgaaggttttccttgatcttttcaggattaaagcttttaggaatgacaaccaccccttgctggatgttgaaacgcaaaataacttgagctgtgatcttattgcacctttttagaagtgcatcctttaacgaaggcagagaagacatatttgtccaggttggattcctagtggtccccaaagggctatatgcaatcatgacaatgtcatgttgttggcgaaatttcaaaagttttggttgggtgtaatatgggtggcactcaacctcgttgctgactggcttgggtttgagtcctgggttgttctggatgagctccagctggcctgctgttaaaactggatactccgagggatttcaccaagccagcatctttacaagcttccgaagtctcccaagtggcacacagatttgacttgtgatataaccatttgccattctcacctatagggtagattttgtcttctggcttagcggccatgggtatttcagtgatgtaaagatccacacaatctagctggaggaccttgagcatcctctctaggctcgggcagaccagctctgggttgtgatttgtagcccacagttttccacagtagaagatatccttcctctgcacctttccttctgctattttccccctgatggcctccccagctgtgtcttcattttggtatatgtaggcttcatcagtgtgtcagcaccccagaccaatgacaaccttcactgatgaagactcagactaaatgtagagacagactacttgggctgtagtgacatctctacctaccacctacttgctgtgtggccttgagtaagtcatcggcccccttaggggtcaatttaggctctgagtaggtaccaagtctgatgatgggaatgctgtttccatcacttagaggtatgcgttgatttgcaggactcactttcttcatagtgtcctttgatgcacaaaaacttttaattgtgatgaagtccaatttatcaattttatgttggattgctgtgactttggattattggctattcttgtacattaatttttttcatatcaattttggaatcagcttaacttgttctaaaactttttgttggtattttcaatgaaatagattgattaattaagagagaatggtggtctccttaaaagagagcttcctatcaaagaagggtatgcctttccatttacccaagtcctttcggcgttcttcagcaatgttttaaagtttgtttcatatagatatattacaatttttagacgaagtttatgtctaggttttaatgttttattattgtaaattactctggtgtttaaatgttgacaactaacacaagtgtttaaaatactatgtgagctacagtatttcacacaatgatccaaattcaggccaagttcagatctgcaacctcagatctactccagctctttgctttatagataaggaagctgaagtctagagatgttgagtgactgactcaacgccacacagcaagtaggtggtaggcagagatgtcactaaagcccaaggaatctgtctctacatttgtcctggactctaatccagggttctgtcattttgccagccaccataaaatatttgacagtctaggaaaacagcaaatgttcttacatccatcgagaacttgtatttgcctagagatggactttaccaatcaagataggaattagataagaattattttttttaaaaaaaggagcattaaaacaatggtcaaatgagagaaaaagcaaaattcagacagacagatacatacacacaccccaaaccctcaaacctccagggcttcctgcctgtgaaccgaaagggggagtgcgaatttcttggccctgtcggcaggtgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacaggtagggccgacgtgtcgacggcagggaacttctagaaactctttgtgtatgtgtaggggagtgggtgtgggtagtggagggtggtgaggggctggggtctccttcaaatcctgccctcctcaaatcaatgggcaagtgagcagtgaggggtccggcccggtgctggcatctgctccgtcacagccgagttgggcatcagttcagagccagctgctagaatacacagctcctccaggtacagatttttcgagtgataagagaggaaggaagaaggaagcaagagagcaaccgaggcaggcccagggtagagaaacggagagggagtgtttcacagaagctggacaggatcggaaaatgtcagccaggccatgtttcgtgctgcgacgttctagtcccttcagcttctttcaccctctggctggctccgtcactcagcccctttctttcttcctttgccaacaaagaagattttgttggtcagtcaaggtcatggcctgaaacactccaatgggcccgggagtaagtggggtaaccaaggaggagaggggcacaggcaggaagcaccgggtggcagcctccacagcgccttcgccacctcatggccaagcgtccgtgtctaggctcagccttgtcatggctgtccccacacccacgcctgggactgccgggtgacgcaccatcccaggctccgtgactcaccccagcctgccccttaggcggccatctagcccagccagagggcccggcattgacagaacacggggcagatgagacgatgtgcctggttaagtcaccaccacgagcagcgcccagccaacaagagtgcttgctcctcacctcattcccgatcgtgggagcccagctttgctgcaagcctttagcttccaccatgttttctagcccaggtaatgaggaagaaaaccagtgaaaagaggacaggacaaactgctcagggggatcagcctcgtggcatcttcctgagaagtggggcaggctgaatttcaatctaaagaaacagggaaggtgaagcaagcaaatgtcctcggcccacctgatcgctcctggtaactcacctgggtgtgggaatttgtttaggggccctgttgggagggcaggagaggccatgggcacttctgctcccaccagggagccaggcacagcccgggccagcgcctcgggggattctgaggcccgtgcagctgcaggggtttctgtcaggtcacagctgttttctcagaaaagccttgtggggtctaagtcacacacacagtgtggcagagtgagggtgcctgagcttgctcagagcagcccatccttgtgtgctggggacaaggggacccagaacgctggaatttagtgacttcaggggagacagccaggggcaatagctccagcctctgagcttcaggcttgagacaccacaccagggagctcatataacctttcagggtctttacctgcagtttcctcactggtccatttgtgttcggcttggagagaccaaggtaggggcaaagtgaagttagaaagaaaaatgaaagattgttgggtggcggtggctgccaagcgtggtaaacagaaccccacccagcagacaagatgggggccgtgcctcatttccacaaatagggggcaggaggagaaaactgcacattggctggattttttgcttctcagtgccacttactttgcctctatggagactgatattttagctattttagataaagctaatagacaaaagtgtttcaaaatatcctagcccagaaacgaggtacggtaaggcaaagcgcgactcagagaggccttgacaccgagggctgcgatggtgcttttgctgcctgaggggacacctccacagtctccccggaggaaaggccgcacatagaatttcagtcaggtcttctctcttttcttgctcagttaagtgacccattgcatacatcccttttaaaatgtctactttttactaagctgttgcatttgcatttctttggaaatgcccagattattaggatcaaagcaaatgatgacctggtctgtccacatgaggaggcctccctgagagagaatctaccaagacagtcaccagggcttgaggccagaagatcctaagatggcgtgcctagtggcatgggcacacttgtgcctgcagagccctcagtgcctctaactccctactctgcagtagccaagaatgcacccagcggtcagtgtggtgtttgtcttttatcagtgaggagatggagctctgacatgcagccttggggaatgcaaagcttccaggcttgtgagtggctctgcttttaggaaggtggctggacgtggtagaaagagccaggctaatttcaggtggtgtcccagtgctgccgcttcctagctgtgcaaccttaggcaagttacttaacctctctgggcctcagttttctcacctctaaagaaagacttgtaataccttctttgcagagatgtgacaatgagaagtaatgtaatgtgtccaatacatagtagacagccaataagtaaacattgtatttactattactattattacatctcggactgtcttcttgttctcaaaacaggagatggaaacccatggctgggattcttcatttgctttcaatatgttataaagcagcagtgggcattttctccatctgttgcaatccaactcatccctcttctgatttctgggcacacccataccagcacagaaacataacaatgattgcagaggtaggcccgatagtgaaaaagcagcaaagctctggctggtcataggatgactgttacatccaccattttcattttttaaagatacttactctgtaggggaatattctcccgaagtaaaaacatgtctgaaaaaatatatgcaagatgggggctgtgccccatttccacaaatagggggcagggggattggctggatttttttacttctcagtgccacttactttgcctctgtggagactgacattttagctatcttagataaggctcatagacaaaagtttttcaaagtattactttgaaaggaatcagaaacaaaatccacccagtcatcactggtccgggtggccacctagattctgaagccaaagggctattgtgggtgcacagcgactgagtatctaaatgcaaacttcttgaacactaaatctttgctaaaattgctgggaggtgaatgtgaggcaagcttttaagtgataccagtacaaatttttcatcaatggcattttcaccatcagattgtttcgccctccaatcgcctagctctgctcatccaaatgagctatttcatttttcaattttagcgtttctcaggcttactagcctagagatcacatctgcttctgctaagcatcccccagaaacggtcctggggagctctggcttaggtgaataaccactgctgtatttaattttaaattctttgtatttttgcttttgttctttaaaaaaatacatgtaattattgttggatatatacttttccagtcaaaagttacccagcattgtgtcttgtgctttacttagaagggtccagttgccctgagggaactctcttagattagagttgtccaaacacgcactttgggaatcgtttctcccaagccttatttatctaaggcttaggaccttatataggtcagataattgatttaataaataccggaaatagttcaaaataaatttcttagctctgcttcggccaaggctaatttttattaacactaaagtgatggtgttcgtcactttgaacaaacattcaatatggttaaaaaaaaaaattaaaccggtcattagacctgttaatcaaaacaaaatgatcgctttagtcagcgcatgtacatagtatgtcttccggtctaaaaaacaactttaagttccctgaaaacaaagacgcccctgtcacgctcacagctctacccagcacttagcatggtacctggagcagagtcaatgtgcaataattatcaataagaattgttgaatgcactctgggaggccgagacgggtggatcacctgaggtcaggaatttgagaccagcctggccaatgtggtgaaaccccatctccactaaaaaatgcaaaaaattaactgggcatggtggcacgtgcctgtagtcccaactacttgggaggctgaggcaggagaatcccttgaacccgggaggcggaggttgcagtgagctgagatcgtaccactgcactccagcctgggcgacagagcaagattccatctcaaaaaaataaataaaataaaataaaataagaattgttgaatgaattaaaaggtgagtgaatgaaggaaatctagatgttttcatacgattaaattaactttaatggtttatttggtgggtatattgaattggcattgtttggacctttcctctagagaacgtagtattaaacaatgttattttaaaaacaaaacaaaaaccagaaattaaaccagtggaggggacagggcagtttgagtgattagaattatttgaaatgagttgtaaggatggtttaagataaaaccctgccattattaaagttttctggttggaccatatgaaatttccactatttgtttatttcagatctacaaaaaggataatttcatatgattcaactaacattataactaaaaataaagaaatatgctcattttttctgattaggctttaacaccggaggaaagcggaaaataagcaaggctaacactgttggagattgttaactaatgaactaaaaataaactaatgaaaggcatcaggtagcaaaagactggattatagtataaaccacagtatccaatcacccagtttcctcaaaatatagaaagaaaaaaaagcaagatacttactattagtctggtttgatccaggttactaaataaatatttcaggtagccaacatttttctgttctcttagtttgagatattttagtaaagatataaaaatcactgacggaagttaaaatttaattaaatttttttcaaaattcctaccaagccagcccaataatattgcattctcacttctttatattccaatccaacattttttacaagtgtaaaaaattttactatctttttatagttaacataaaaacataagtcatatcataatcaaaacataaaacatatcattaaaaagtttcaagtgctttttttcttaatattttattgtaagcattgttttcatgtttagcctttgtgattgtttttaattgctatgtaagcttccatagcatccatgcatcgtattttcttcactatttccttattgttgtacatttggactatttctgatttttgttattttagctaatcctacaagaaaatctttacatatgtagcttttgttactttcttgggcaaatccaggaatgacatttgaaagaataggttaaagtaaaacagcattttgcaggatgctctagacttctgttgaaaacaatcccatcaaggaaagaaaatgtttctctaactctctgttaccatctccaagcctttgtgtctcctctggagcaggcactatggtggaaggagaggaggctctggagccagaagtcctgagccgccttcccctccccacctcagagccctgttcttcctctgtgagatggcggcaatggtgcctcttcacgcaggggactgtggagtggagatctgattcggaagtgcctaaacacaaaaggcacttggaaagccagaaccattagcatgtgtgcctcagtttcccaatctgcaaaatagaatatcattttcccaatgcaataatgggggaacactggactgacatgctttttttcttcctctgtcattacattgcagtgtatacttgggcagaaatttctctctaggctttagttttagcatctgtgagataaattatgagaggattgaacatcccttttagctacaaaatgagttgtgtgtggtcttgaaattacaaagttttaaagaacatttaatgactcagcccccgatccttaccccaccccacaggtattggctctcagaattcagagcctgaacttccttcttccttgcctctccaaatactttttaaatctgggctctcaccttaccacaatatttttaacattctaagtgggagcctctgctgtgaaaaatccaaggacaaagtccatcccttctgcttgtgcgtcggctgcagatttattgggggccgtgcaaggacttcggttggtgagaacagacttgaagagaaagcaaattactgcccgaagcagccaaattgcagtggtgaaaatgttaggcgtttgcactgtccactttgcttgcctgttttgatttgtgctactcagcaactaattttcaggctcaaggagaaaaaaataaatagaaagcattagaacaaagacaagcaggacccttgccagtccagaccgccgttctctgagtgcagccatccctttacagttgcaaaatgagtttccatgcctttgtttactggatcctcataaccatcctatggcaaatagcagaaaaagcagcaggatctatctcttctcgtaaatgaagaaagtgaggctcgtaggtctggtgacttgcctacgagtagaaccaggccgcaaacatggtttctcggggccctcgtacagggtctgcaccttgaacagtgtgcagccgctcgcccaggtccgtacaccatcatatacccaaagactggattctgaagcctacttctaaaggtattccccttactaagcacttactcttttcctctcaatttttacagtaaaaaataattattttgatgctgaatattctcatttaatatacattttctgctgagtatgaatattaggttattaatatagaactatatgtttttctagaacgtattatgatggttctaaatggagaacttacattttctccaaagctgataaatccatagtttccattttactctcagaaaatgcatctattctggaacttccttagagggatgcgcctcaatttgcagttcaacccactcctgtgtgtgcaggtatgcacaccgcttaccaccccactgtatgcagaggttataagtaaaatgtaaattaaatcatatttgagaggttttgccctgaataaattgcctgtaattaatctgcttggtaagagtggatctccatatggtgtgaaaggttttatgtgtatgagattctctaaaagaacagcacaccgtcacgcacagactctgaattgagatttgttttttcactaactcctccaggactgggagagttatctttgaatgacaaatgtctataatctattcacaattatttacgtcatattttagcctggggttcacctgcaggctcggtgcaggtagtgcaaatccttgtgctgttgactggagcaaagcaaaagatggttttctggtgctcagaacaaatgcatgaagcattaaacagctggagatgtgaatatctgagactcttagtgggccacccccaaagctggctgagaggagggttgggaagaggggaagtattcaagtgctgcagcaggatgtctgtgatgggctgtaggtgctgttgcctttgccaagccatggcaggtggggaggagggctcagaatggaaaccaacatcaccatttaagattaacaaacccctacccccctcttttgctgtagatactagagtctactgtgtcttcttgtattttgctaattccccaccatgcaaaattgtactggctccaagacagaatgtgaatgacagccctcagttagacctgccctttcatcatctgggctgggcatgatgggagagaagtatgataggggaaagagtagaaaagacaggctgggggagggggtagaggttgcaacctgttcccctgggttgactggcctgagctgcctgctgcagggagaaggcagctgagccaggtgacccatcacgtgaaaagcctgagcccaagccccaggggttgcaggtcagtgtgggtgttggcaatgtgcacgccagcatgtatttacccataggctctggtggttgcaggtgtctgtgccccctgtgggcatatgctggcgcatgtggtgctgtgtgtttgtaggtgtgtcctgacatgcatgtgcaggtgtgcatgtgttggtgtgtgtggtgcactgtatgctcacctgtatgctgatggatgtgtgcctgcatctgcagggatgtgtttttatgtgcagcagtgagtgattttgtatgtatggtgtgtgtgtttaggaggagtttggtggcagcaggacagctccatagaaggaagggcaaacattacttcaactcagggctggcagtctgggttctgagtaggtgagcagaaagtcagagatgtcacagatcatgttccagggattctgtggagaagggagacaagaaaacctctgtcggatcatggagaggtgtgagtggcttcttcatagctgcatagacttttcaggttggtctggcctgactcccgtcagaggtctctcatcttccaagtaagcctggggtctttccttttttgtagcttccttcctctcaattctcccgacttagaatgcagacgccactccatcccccacctgcggaaaccctgttcaccccttaattctaagcccagatgtatggggatctcccagacccactgttgacattgttaccagcgttaaagtgacacaagcaggtggaaaattgttgttctcagaattcagggtcaaaaacccaacagaaatagttccctagagtgaggcgttcccagagaagagactcggcacccagatagtttcaggaacatttatctgtcagcggaaaatgtcaacagctccccaaattctcaccagttcttcccacagtgtccatcctatgtattttggctaaaataggcaaacacgcatttaatcttctttttttttcaccctcggaataggttggcaaacaatccaataaggtggttcccaatgacctactttgcccatcaagataaccagatggataatgatttcttttcttttctttttttttttttttttttttgagacagagtttcgcttcgctcttgttgactaggctggagtgcaatggcgcgatctcggctcaccacaacccccatcctgggttcaagtgattctcctgcctcagcctcctgtgtagctgggattacaggcatgtgccaacacacccggctaattttgtatttttagtagagacagggtttctccatgttggtcaggctggtctcaaactcccgacctcaagtgatccgcctgcctcggcctcccaaagtgctgggattataggcatgagccaccgcgcccagccatgatttttaatatctgattatttaaaccatctgacaggccacttgacttaccaattgagtaaatatttaccaagcacctctcatgtgccccaaatcaaaccaacagtcctgtagatggttggctcaaccagcccactggccaggccagtgttttgaagatgaaggttaaatgattgagagcccataagcacaagaaagtgtccctggtcccggaaaccatgttctcaatttttgcaaaaaagtctaaatttgtcttcaggctcacttctttatggtctcatctaattttcatcattgtgtggggcctgtgctaatttccatgctgagtttagtagcaaaggaagcatatatggaggataccacccaggacttttgagtcagccaagagagcttcagaaattcctcctttgatttccacagagtcgagagaaatctttgtcttttctcccacttaactatcaacacttcaaagcccagacctacataaaatacacaaatgctttctggacaaaatgaatcttgtccgttttctttgggtttcattgggaacaataaagattgagctacaaaaggttggcaaagaggattatcctttttctttctattaaacatagaggcttcaaaagaacagctcagaaagtcaaataattgtatccaccatcgctcacccatccatctccctgctgacctggcctgtgaaatcccctttaaaaacttagccagctctcacctgcccattgcaaatgctgtattgttaaatgttcccatctataattccatgagggaggctgctataaagcaaactccttccatttcaacggagcatctcgtcgcgcaatagctctttggggtgggagtggtggggtgcctctaattttcaaagctttgtaatctcttgttggaaagggagctacttggaaaccagaaatgggctgtgaatagagttatagccacaagctcttgcagtccaaaggggctggtggggaggacacggagggtaagattttggaagccatttttgatcttcatgacaatttcttgattttgtcggtttggaagacacatctgttagtttttagctatggctgtaaacacaaagtctcagacttgaagctgacctaattcctcgtttggtttcagaccatagcttcctcagaaaattcctgtcagccattttgaagagcacaaaatggctcctatatgccaagagatagagagaatttgctatttagggatttttttttttttaagatagggtctcccttcttcactcaggctggagtgcaggggtgtgatcacagctcactgcagcctcaaaatcctgggctcaagcaatcctaccacttcagcctcctgagccattggaaccataggggtgcaccatcatgcctgactaattttttctttttttgtagatacaggttctcactacgttgccctggctggccttggaaactcctgggctcatataatccaccagccttggcctcccaaagtgctgggattacaggaataagccaccacgctgcctatttagagatttttaaatttggagttgaacatttaatagcagcattcaagtctggaataatttcagttaagaaagaaaagaatagaaatctaaccttctaattggccaaccatctaaaattctatgtggaatgatcaacaaaggaagacagtattgagttgctgggtcctctctacggggtcagaaaagaggcctggttcacctggctctccatgttttccctgtagagtccttcaaacccatggtctttctctaccaactttgaccctgggtcatcatctctctctccaatcaccattccttctctttgaaggttaaaaaaaaaaaaaattcaggccaggcgtggtggcttacacctgtaatctcagaactttgggaggccaaggcaggtggatcacccagggtccggagtttgagatcaacctggccaacatggcaaaaccacatctctactaaaaatacaaaaacaaaaacaaacaaacaacaaaattagctgggcatggtggtgtgctcctgtagtcccagctactcaggaggctgaggcaggagaatcacttgaacctgggatgcaggggttgccgtgagccaagatcacaccattgcactccagcctgggcgacagagcaagactccatctcaaaaaaaaaaaaaaaaaaaaaatcagagggaacatacaataagccatatttaatggagttctgaattatgtaaatttgaaaaaaatgcaatctaaaaattcataaggtctcactatttgtagtattcaagataatgtaagattttacatttattcctatgataaattaatcagaattttgcaaagtctttaggaatgcatctctcatgtaaagtgtagctactttgtagtcagaagtggcctgtggcaatatcgtgattaggctggggtaggggttaggggtgctgccacttagttctaccttcagtgataagaagagtagacagcaagccttggcaacatagcaaaaacctgtctcttctaaaatacaaaaaaaataaaaaagagagagagagaaaatattcgctgggcacggtgacacccccctgtagtctcagctatttgggaggttgaggtgggagaaatgcttgagcctgggaggcggaggttgcagtgagccgtgataatactactgcactttagcctggacaacagagtgagagaaaaagaaagggaaggggaggggaggggagggagaggagaaagaaaaaagaaaagaaaagaaaggaaaggaaaagaaaagaaaagaaaagaaaagaaaagaaagaaaagaaaagaaaagaaaaaagaaagatggcgtctctctgggaagattttctgtgaccagagtgggactgggctggtatgtcagaatctcggaatatttgacctggaaagtattatagataccttcaagttccacttctggattttaccaggggagaaatgatggccctagagaaaaataatacagatcaagaaattgccatgtcataagcaaatggcaaattcagcccttaaacccaggacttttgattcttgctctagctgcctgtcctctgggctgacaagctgccctgttataagtaaatggcacttctggagccagccacttgggtctcaggtgtgtgtgatgagaccctacactagaatgacagccacaaaagagctgcaggtggctgggccaccttagctcatcctgtccatgaaggggatggctttcaactgtttcagggggtacaaaaaggcattggatcatccccacagtgaggaaacccctccccactccccctaccagatagctgtcagtgctgctgagaagcctaccttggtctccctccactccagcttctgcaggccaagtggccattgttgttagattttttgccctgttgtgccataggccctgacctgcctacctgctgggcaacaggctgccggagggcgaggggcagcccttgtgccttgccccacatgagctgcactcatgctgccttccagagaagatgaatttagccttccacctgaatcctttcagaaacgaagcaggcaggcaggcaggcagcaagaaagctatagacacacacatacatgcaaacacatacaagtaaatttagccagagtgcttttagtctataaagatgttcagtaaaagtttaatgagtgaagaagtgacaaaaataccatgtattattagtatatctaggctcagacaatgtcttatggtatgtaaaccgtatctcaacaacaacaacaacaaaaaaagctactcaggaggctgaggcaggaggattgcttgagcccaggagttccaggctgcagtgagctatgatcataccactgcagtctaggctgggagacagagcaagaccctgtctctaaaaaaagaaaaagaaaagaaaatgtcagctatgtacaagggaatcttcactcaccagaggaagcccttggaaggttttgtgcaagagaatattataataatatgtaaatataggtagaatatttaaagaaaagctgtcgtgagttatttggtattgtgaggactcttcttctaatctacttgttttcatgagtatgaattttcatttattggatttttgtagaatcgacagatatattaacttttcaaaaatagagacgtgcccagattttcctgtcagttgttcaccaacggatgagatcccaaaaggtaggcaagattgatcgctaggttttagaagggtttccttttaagggctttttaatgaagcccattctaactgagattcccactgccccactgccctagcgtcccgttaatgacaaggagaggcagataaatgcctctttgtgccaataaatcaatggcatctctgcttctctgctgggactgtccaggaccatggtaaccataaggacagtgacccactgatcttaggccttggcaggcaaactagcctttactagtgatggtgtgtcctgttaggctatgccagctggggagagaagactaaaaccaatgagagaaaaacaagtaattttcctgttagtgaagagtgcctgttttaatcatacatttcatcgtcagaaatattatcagagatagaaataaaatgcagaacatagctgcgcattaattcactttcagtgtattttctgagcaagcgattgtatgtcagcggctgcattacagttgctgctctcaaagtactcacatttctagaggagagggatatgcctggctggtaaagtgatagaggggtggtaactgtgaacacttgtgatgccggggcttgttttatgtgctgtttgcatgcattaggtcaactaatcctgtggcacttttattgatgtccccacttgataggtggggaattcagccctgggggtccatggctagcaggagcacagccagcctttggccccaggcagcctgccctcgctccccccgccatgaaccgcattgcctatacacagcaccccgggagcccagaggtaagggtctccctcatatttgcttgtcacggacttggagggaggagttgaggtttgtctgccacatggagaagggaattagcaaagggaagatctggtggtaggaataggattttctgccccagaaaaccaggaaacaccagccgtgactctaatccctaccccatccctgaaactcacttcccaccctcaggctagatgaagaggcgggggtaggggggcatggcctttggcaccctaaccggtagcctacccctcctccaggccaagtcctcacctggccccatggttcctggtcccaggcagaccctgttgccacctgctcagatgtgtcacccttccttgtcccaaggacctggctcctaaacaatgtgttcagtgacgtttataacaaaggcactcttccccaatctatgttcagcaagatgttaatactatactacaaaaaagaaggaatgtacattttggaaacagtagtttaagtgcactgaagaagggttttgtttgttgttgtttaagtgcaggacttttccaaaacttctgtctgcaaatgtgcattacacgttcccagggggaagggaggaagatagagttatgcaatgcaatggaaattaatttcacccctcttggcatctggtttttcagggaacacctattaagtgacctgcagaatacagagtgagggctctaagaggaagttatgagaaagctgggctagaggattaaaggaaagcatcctgggaggtaggatatgaatgggtaggatttaatgcaaaaaggaggaggaggaaactttgcaattcagggcatggcctcagcctgatgacaaatgccccagggggacctcctaaagtcggttcattttgaataccggcaggagcagacgcaagctgccacccctcctgtgtaaggctgaggtagctgttccacagtttcctgggacttgccagcaggatgaagttccagttgttaaccacagtagctaacctcataatgattccttccttcacctgcctcacttcccatgttcttactgtattcatttcctagggctgccttaacaaagtgccacaaactgagtggtttaaggagcaaaaccttattggctcacagttcggaaggctaaaagtccaaagtcaaggtgtctgcagggttggttccttctgagggctgtgcaggagaatctgtcccaagcctctccccagcttctggtggttgctggcaatctttggtgttccttggcttgtagatgcatcatcccaatctctgccttcattttcatgctgcattctccctgtgtgtgcatggctgtctctgtgtccaatttttccctttttataaggacaccagtcatattggattagagcccaccctaatgacctcatcttaacttgataatctgaaagcaccctatttccaaataaggtgacattcagagggtgttaggacttcaatatcttttgaggggacacagttcaacccataacacctaccaacggtttctggaatcatctctcaaaataaactatctaaactctaatctttgtttcagggtcagcttctagcagaactcaatgtaagacacccttttaaagatggtacctcagaggtacagacagattgtgaaccttccctagcacagtgtaacaagtcccttgcaaaaatcctgatttgagtcaacattgtaatttcttgcttaaatctaagaatatgcctcccagcttcttccaagactatctgggggagttgtttctagggtggctcaatttattcgttttgaacgctgatggccgtgcaccacaccgtggctcaatgggtgttgaggacacgttcacatgcaataaatgcacagggctttgccattaggtggcattaggggaaggacacttccagcatactgcagaggcattctcttccagcctggttgcctgtcaagcacctgctgagatgactggcccagacggagattgtggggttgctgagccagccctgtcccctccttatctccggaagatggaataaatgcgtgtcagaagggagggtgcctcccatctcgggagcaccggggttgcccttcagaaaaacattgcctgcacattttgtagtcttgaaatgaatctgagtggcaattcaagcgggcagagcttgttttggattttagacagttctacctgcgtgctcctcttctctgctccagctctgacatctcggctccacatacagtggtctgaagtggcatacggaccctgagaagaggagaggcaaaggtggcagctgtggctggcccctcctgccttctggtctccttggctggtgagggaagaacaaacacagttgtgtttccaggtcacagctgccagggctccacctgtggggtgggtggctccagttctgttctgagttaagaaatgctgcaaatacgttctccttgaaagagacactaggaattgaccatttctttctgcagctttctgtagccaataagcatttgaggaactggagaagggttcagccctgaattgcaagggaaaactgtgtgagtgtgttttagttaagaaaaaagttaattctagtgagacctgcttgtttacaaaacagatgtataggccagacagatgtacagggatgaccttgactttcttttgtcattgcaggaaggtggggtatgtatgacccctggttaagaacaataggaggccgggcgcagtggcttacgcctgtaatcccaacactttgggaggccgaggcgggtggatcacccgaggtcgggagtttgagatcagcctggccaacatggagaaaccccgtctctactgaaaaaaaaaaatacaaaattagccaggtgtggtggcatgcctgtaatcccagctactcgggaggctgaggcaggagaatggcttgaacccgggaggcggaggttgtggtgagccgagatcgcgccattgcactccagcctgggcaacaagtgcaaaactcggtcaaaaaaaaaaaaaaaaaaaagaacaataggatcagaagtcggatggctgggtccatatatacctccacctcttctgactcccagttttccatctctgtttgaaaatgagtctgtaagcctctccccacctctgcctgttcccatcccatagcaccaggctgacttaggcagccacacagctgggatgggaagttggcctcagtgagcagatggtacaggggctgagcttaaaacaaaaatcacaaacatttcttggggggtatcctcaaggccgataaccctcttactagagtgaaatggaaaaccaaatgtgattgagctgcctgagcgataaaagcatttgctgttattctctgatttgctctgttcatggagagtttagtcataggagtttctattctcagaaactcacagcacatcacaatacgtagctcatttgtcctcaaaataattctgccctgcataaatgggtgtgtgtgtaggggggtggtaattataagaaaccatgtgtgttagaattgatgtcagtgctttgagatcatcagataaaagctaataaacaacacatatgtgtacaggccacctctctaattcataccagaagcgctggttgtaatcaaagcatggcatattttattttaaactattttataaataacctttgaaactgtgttgattgtgaaagccaagatctgatgtcctgttaaggaaagatgaaaataggctagaattaaagagcaatatgagtctggataaaagtgacaggaattactgtaggacaataaagcattgggtcatgtcaagttttcatcacatggagaatggaaagctgcatcataaatgctctccacctaatcatcctgagcattctcattttagtgcgatatattgtcctcttggaagcaataatctcatttaggtcatgagtaaaataagttgggttcagcgtttccatttcaagatatagagaatatttctccagtgcagcataagaaatagaatatcacccaggagaagctttacataggcagtgataatgtggaaaaatctaataaagagaacccacgtgccccagggaggagaagccctctgtgtgtgtgattgtcgtcaggtgagcagttatggcacactttgtagttttgccagtgcttttatgtaaattactgtatgcaaaatccacagccctcggggatgtgtgggtatggcctctgttactgacagaggaactgaaacttcaagaaggcaagtgatttgctcaagattggttatcagtagagttggggtttgaattccattcttctggattcaaatctaagctctccctctgcacagttacatgtgggcaggctgtgcatgcatatctgtggcctggaggagtggggtgagtaaccttacaggaaggaataccctgcactaaaatttgcacctaagcttccattattacgcctacttttcattttctgtttgttttcctcttagaggttaaattttccattcctgattttaacccaaagaaaggctaagtaaattccaggggccactcttgaataagggcagctggaaaaaaatacacaatgcccaccatctagcttaacaggatgtggacaccttcagtcgtggctaaatctatacagtttaaccctagcaacaatttcccagaaataaaacagctgctctttctggtatttggttagtctccagctgggtcaagtccctcttgatcgaatgcttggagcagggtttctcgacctctgcactaaaacacctggggccagataattctctgtggctgtgggcaccagggaggctgttctgtgcattgtagaatgttgagcagcatccctgacctctacccactagatgacagtagcactccccaagttgtgacaactcaaaatatctttagacgttgccaaatgtttcctgggggcaaaatctgcccctggttgagaaccagtggattggagtcatcatttgtgttgatcaatcactccgtgatgattaggccatgatggacaattcaggctgactttattttgctcattaggttgaccagaagactggcaattgatccactgctaagcactttcctgacacaagctgaaatgatgtcctcaggagccccgtgtgcgcatggcttttgggatggttcttcccaaggaggacagccgtaaaccatagaaagcaaccacttgactctgggtgtccctggtttgcaagtgcctcttgtgtccgccatctgcatttctgtctagatggtaaggttgagggaggtcagtttcagcagaaagtgcaaagagcatagattcatgaggcaatcagacctaaattaaagttttggctttatcactacccagcaacgtgatcttgggcaggtttcttgacctctctgaaactgtcctcttctttataaaatgaagattacctaccttgcagggtcattgggataattaaagaaaatgtgtgtaatgggcccagatggagctaggcccatagcagcactgtaataaatgttttcgattactgtacattttacaaaaatgaatgactgaatggaaaggtagaaaggccaaatagagtgtctgaggcatctccatggaggagggtgccagtggccatgtctgtctgtggctgatcgcaagactcttttgacagtccctgaagcctgtgctcatcttcagctcccttgaggccctcttcacctggcctcacccagtgtccctgctcttctgactcctgagggacctgagcattccaaaatagatgttaggaagatgtggattcatgtagaaggatgtcaaggcattgttggttttagcagttgatcttacctggggtgtgaaagacaaccgaagtctgtgagctgcagtgatagaaatgtgagcagatgggcaggataggaaggcacttcttgacgggagcagcaacagaagccactgcctttggccaggactgggggagacacaacagaacaggactggcagaagatgccacatcccagggtccccaagaccaagctatggcaccatcacccatctacagcaagatctgtagcaggaaccagggagaaaagtctagaccctcagtaaactatgcggccaggacagtccgaggtcaagccgtaaaggaggcttttttggcatcttttttcttctcccttgggcatcatggaatctgtgctgggtaaagaaccttggagatcccctttgccttgactcctttgtttcactggccctcagaaaggagatggcagaatcacaaagctggtggctgagccagaaagatattgtaggtggaattcaggttatggatagggttaggttccccttgaagagggagtactgagtttgttccttggagagtttgcggttctagctctgtaacccaggactgactctcagcccagtgctttttctgttgtgccaggatgcatcctcatcctatatcttattttaactcatactgtttccaaatcaaataccaacaacatttacaacctttactttcttatttatttaatgctccccctgaaagtagtaatttgccactaagaaagcctcccctgccctagaatactaaagaaaacgagaactaagcgaaagaggacctgtagtcagcgatttcactgtatcctatttaaaatgaaatggactttattttctgctttgagaacctaaaacaccacactttaaaagatgatatttatcatatcttacaaggtcaaagcatacttattggggaaaacttggaaaaggtagaaaagaacaaagagaaaataaaaatcattttaaaaaatgttacccccaagactgattagtatgttggtgactgtccttctaggcttggatatgtgcattttatttcgtaactgttctttttacttagcaataaatcatggtcatctctccctgtcatgaactatgtctctacatcaactttagtgcctgtaaaatgccgtaatttattttaccactgtcttttgtcagacatttagatggcttcatgtttggacgcattatgaatagtgtcactgtggacattcctgtgcatacatctgtgctcacatttgtggctatttctttggaatgcactcctggcagtagggttgctaggtctcccctcactgtcagtgtccccgctctccggggcctgcttttttcatcacccgcctccccgtaaagattcctaagttccagggctatctccttctgatggagatctcctgggtgatgtggtacacgtcacccacacccctgccaccagcctgctgtccaacagatggagctgataaccatttaggaacaatccttaaacttctaaccgactcagtccctgattagacttcttgtcttgccttatccctggttatgtcccttctccctcccaacccttacccacttctcagccccatgcaggaggcccagtttgtcagctggccttgctaatttctctcttggcccagccagagatcgtctaggttccttcttcctactctctgcccgctctgtagagtcagactctccacgggatggagatcttcaaggccagagagatgcaaaacctccttgcttcaggatccggagacaagctgctgcttttaagcagatcccctctcaggcaggttcaagtactgacccaaagagcaggggggttgcagggctctagtgattcttgtgtgaccccagcagactcaagctgttgcagcagtcagacatttggtgatacctacaaaatcatctagtccaacctctcttccaacagaactcacactcgatagcttctttgatgaatggaaatccagacttctgggaacactactgtgatgagcaactcactacctgcctacctacctaccttccttccttctgctttatttcacaattcttgccatacaaaatgaacaaacacacaaacaccactactaatgctattcattcatttatttattcaaccaatatttattatttactatgtagcaggaacagtctaggtgcttttgaaacaatcatgaacaaactgaaccacagcagcaacaaaatcccagatcccatatagaactaacaattaaagacggagacaggcaataaacgaggtaaactgaaaaatatgtagatagttgtgatacatgctgagaagaaaaataacacagagaaggtgcataggaagtgtcaggctggtggtgtggggatacagttttgggtagggtatgcagggatgtccttgctaagatggtggcattctagtcaaacccagaaggaagtgagcgagcaagccaagtgggaacctggagaagacggaggtggcagtgcagactggcatgttcctggaactgcaaagaggtggtatgagtgaggggaaggccagtaggaggtgaggtcagacgtattgagttctgggggtttggggagagagtgacagttgcaaacaagcttgaaggacattttgctctaagtgagatggaggtcaaggacttggagcagaaaagatacatgattatatgttttggcaggatcattctagcagctgggcaaggaacatgctgagggggaataagggcagaagtaggcattacttagtgatgtttgttcaagaaacatctgttgcgctcctatatgccaagcactgcgtaggtgataaggattaaacgggagcacactcttcttccctctggtaggttactgtaacaactactcccacctctgtcatttatgagtatttacccagtcccaagctctggggtgagcacacccgtccattattgcatttattcctctcagcaaactgtaaggtaacaacctcaggatatcctcattttacagttgaagaaactgaggcttagagaggttatgtaacatatcgtagaccacatagatactaggtagacagccaagatttaaacccaggactgtctcactccaaagcctgcaatactaaccacaatgctgttgctggaaactttttcttacgctggactttgaaagttcacctaagacagcatgagaagtgatggtatcttccaggcagccacctgggccaccagccctcccctccttgggatctgccttcccactttgtctgaattgagggtccaacactgctcctcggacacaaggtccaggtggggagagaacagagtccagcccagccaaggcaagtcacctgggctctctggaacccggactgctttgctgtagagtaaagtcctggaataggtctctaaccctctttccagctctgaaatccaaggcgtatgtgatctgaggtaataattgtcttgcctctcatgcttggtttttgatgagaccttcacattctttaataaacatttatctgtatccaggaattataggagatacaaaatgccgaggaatgcactactcatgatcttttttgatccttttaacaatccagagacatgggctgtgtaaagccacagtgcaaaatacaattaggaaaacacagcaataagaccactgtagctttgaatggtgctgttcactaattattacctccccacccattttctcatctgaccctcacagcagccccatgaggtcgacagggtgaggacattatccccatatcacagatgggaaaactgcagcccagggagctatgcgatttctcccgaggtcctcctcacactagtgtagtggagccgctatgtttattgaccccaaatccaagtcaacccaacagtctctagaacgttccaattacctggccagtcctcacttagataacatcggactctttcagaaaagattaaacaaatcctctatttgttgacagaggttttgctgaactggccctggggatccgaattgatcatggccatcaacacaggcagcaaagacccttcagaagtgttttattcactagccacctccatcccccaaccctccatcgtctaaagtgtctcctgactcagttctgtccccctgcttgtcctcttctcctattagctctgggtacccagtccagatcatagccccaagctctgtcatcattttgcagcctccagcctcccccacccaactcagcagagccctgagaagaaagtcctgggtcccggaggctgcacctgcagacacaacagattctgcaatggtgagagcatatagggtattttgggtctccagtggggtttttgctgattctgtgcctgaccagggcacatgcttcctggaattaataattctagataaagaagcctagcagatgcccacctatggaaaatgcttcttaaataagaagaatctcagaattaggaggccagcttcttgttctcagcactgcccctaactagctgtggggcctcggacacgtcacttgatgcctctggtcctgttttcttctgtacattatggaggatttggacagagatgatcagtaaggtcccttctagccagactgtcaaggttcaaatcctagctctgccacattccagctgtgtgatcttggacaagttactttatctttcctaagcctcagtatccccaactataaaatgggcacaatagcacctatctcatatggctgttgtgaggacccaaagatacaatgaatgtcagccctcagcacagggcctggcacagagacagtgctcagctaagtaactgtttctaagttgtttatgatttgaagctaaggatagagatgcttattctgagaagcagaaaggaacagatggagaaggaaaaaggaagatgggacaaaaggagaaaaactggccaggtgcggtggctcacacctgtaatcctagcactttgggaggccgaggctggcggattgcctgaagtcaggagttcgagaccagcctgggtaatatggtgaagccctgtctctactaaaaatgcaaaacttagctgggcatagtggtggacacctgtaatcccaactactcaggaggctgaggcaggagaatagcttgaacccaggaggtggcagttgcagtgagccgagatcgcaccactgcactccagcctgggcgacagagtgacactccatctcaaaaaaaaaaaaaaaaaaaaaaaaggagaaaaattagggaaaatagggcaaaattgggggtggagaaaggcaggaaaaatttgagggcagcaactgcaataacttcaacagaaaagtagaacaataagcatacagccccaaaatactcagcccctttcctgcctccccttcctctctgcccctagcagacgccatgatagctcctggaatgatgccttttataactgtggggcatgttcctccaggctgacaccttctgggggggcccctgaacacagcatgggctcagccttcctcccacacacctaccctggtaggcatccctttgagatggatctgagtggtttcccacctccttctaggggtgaactgtcagttcaagaaggaggtttagggggatgggatgtcccctacctggggctaatcggggcttgggaggtggcttacgaatcgaagccgaagacagcagcctacgtgaccagaaaggaaaattcccctccctgctagttaagaagcttcacagaagctcaccagactgttgttttctttctttcttctttttttcctttgtgcacacataagcgtctaaattttgcaaactgttgcctacctttgtctctgagagcagtggaaaatattggactaacaaaaataagcaacagccagtgggagaataatagagaggcaaggtctcctggtctagttggcgccgcaggggttaagcctttctgtcggtgaaacaggctaacagcaccccctgagcctgctgacctcttccggctctcctggtccttcacacatgtcaactgtgagcacgctccaatactgacaagactgtcttacacctgaggcaattttcatagcacaggctgctaatttttcctccaggttttttgtttgtttgtttgtttgcctggtaaaatacacataacataaaatttaccctcttagccatgtttaagcgcacagttgagtggtgtcaagtacattcatattgttgcgcaaccatcaccaccatccgtctctagaattcttttcattttgcgaaactgaaactctgtacccatgaaaccataactccccattcccgcctcctcccagcccctgacaaccactattctactttttgtctctatgattttaactactttaagtaactcatataagtgaaatcataccatatttgtctttctgtgtctggcttatttcacttagcctaatgccctcaactttcatccatgtggtagcatgtgtctgaatttccttccttttcaaggccaaataatattccactgtatgcatctgccgcattttgctcatccatccatctgtcaatgagtgcttggttgcgtccaccttttagtgattgtgaacagtgctgctataaacatgggtgcacaaatatctcttaaagaccctgctttcaattcttttgggtatagaaccagaagtagaattgctagaccatatgatagttctatttttttttttttttgagatggagtttcgctcttgttgcccaggctggagtgcaatggcatgatcttggctcactgcaacctcccttcctggcttcaagcaattctcttgcctcagcctcccgagtagctgggattacaggcatgggccaccatgtccggctaattttgtatttttagtagagacagggtttctccatgttggtcaggctggtctcgaactcccgacctcaggtgatccactcgccttggcctcccaaagtgctgggattacaggcatgagccactgcgcccggccagtagttctatttttaactttctgaggaaccaccaaaccgttttccacaacagctgtaccattttacctttccgcccacagtgcacggcattccttctccacatcctcaccaacacttgtgattttctgttttttaaacaagtagccattccaacgagtaaagggtgatataaattttttaagaggcaagacgtgccaaaactaggatttcaaaaattgtaaatatagaataaaatagactattttaaatgtgacaaattaacaaattaattttagcctgcttatatgagttctttcaaagataatttctttttatttattattattattattatttattattattttgagacagagtcttgctctgtcaacccagactggaatgtagtggtgtgatctcagctcactgcaatctcggcctcccatgttcaaacagttctcctgcccatgttcaaacgattctcctgcttcagcgtcctgagtagctggaattataggcacccaccaccccaccaggctaatttttgtatttttagtagagacgaaggctggtctcgaattcctgacctcaagtgatctgcccgtctcagcctcccaaagggctgggattacaggcgtgagtcactgtacccgaccttcaaaaataatttttttttcttttttgagacggagactcgctcttgttgcccaggctggagtgcagtggcgcgatctcggctcgctgcaacctccgcctcgcaggttcaagggattctcctgcctcagcctccggagtagctgggactacaggcgtgcgccaccaagcccagctaatttttgtatttttagtagagatggggtttcaccatgttggccaggatggtctcaaactcctgacctcgtgatccacccaactcggcctcccaaagtgctgggcttacaggcgtgagccaccgcgcccggcctcaaatataatttctaaaggaagaaagagatagagaggggaagatagaaagaatgagagaagaaaaattaagaaagatgaggtcagatgacggggaaggtggagaagctttgcaggcagagtctggaatactgcttttggaaatgtgaggccaggccccgtgccttccaaatgcacccgatctttccgccgccgtaggtcccggatatatggatttgcttggggacattgcttgctttcacagggaggctgtgtactagcaaggacacaaagatgagcgctccacagttccctatttgggccagaaggtcaaaaaaaggggtggggtggtgggggggcacaggcagctaaactggctctgcctcctggggccaaaaggccagcttcctccctgggcctggctgcccagaaacctcggcgcgggcacaggtcagaggccgaactgggtggtattcaatcttgggtttaatgcattttaaaaactgcttttgaaggcgcaaatgcatcacagttctttcatttcagggaaaccgcctgtgagaaagggggaggtggggaaaacgctgagcccaggagggggctgccctgggcttttgtctaacaaagccgcagctcctcagcagcggggctcttgccctttgaaaaccaatcgggcaggaacccttcagcctcctttctgagagccagtcacatcacattttacagatctcagaaaagtgagccaagtccctgcgctatgtcactctgggtttgcgtcccatgtctctgacaccctgtttttctgagcaaacagcctctaggtgaacaacagtattttgcttctctcatcactgaatagggtcaaacttcccatggaattccactaccaaaccagatgaatagaaagaaagctgagagaccactaaatagggcattgctgctatctcaatgagagtgtcacctacccacaaagcaggcaggaaatctttaattaaccctgtttctagacacaaaagccctcaataacatttcatcctatttaaataaatattttcaaagaaggtgatgtgggaacacttttatttttgctattggagtgctaatttaatatcatatatagtttaaattatcatataagaacctataagcagagtttggggtggggaaggggggttggatccttctaggaactctcctttatctctttcatttttattccactgtgacacttccctcttgggaaattcctgccccggatttttattagtcttttgtctgctgtccggtgttaaaacctcacaaatccattacgtgcttctcggcgctgcctttcaagttacctctccacgaggtgtggactaatgaatcaaacggcaagggaagcagctgccctcagccctctcagaagaggcccggcccacagccatccttcagaaaaccctcctggcaggccctccctgggctcagcacaccctcgcttccctgggtttttattcggagctgtctgagctacaagaacatactcacgtacgtggcataaaaacacgcacgcacatgcagaaagggaaatacttgttgggctccatcagagagaatatttttcaaaaatctctcaatattgtcattatgtcaactgctaaagattccctgcttgacaaaaacttaatcaggcttccaaactttctcctaggcccatctgtgtactttcttgcaaaatccaggtttagcaaagaactctgcccagttagttgagcacaaccatcaaccttcaatatccggttcccctcagtgtctgatcagggtcctcatcccactccatcccccaggtgaggtctgatccccctggcctgtgttcagctagagtcctgttaggttggtttagccagaatccctctcactctttttgggaattttctatccattgaccccctactctgctccttggcataaatgcccacttgctgtacttggagttgagcccaatctttctgtcccactgcaagaccccattgcaatcatccttatacctatcatgacagttttgaatgaagtctgccttactgtgctttaacaggtatcattgaattatttttctttaacacatcttagcagtaaaattatcttcaaaattttcttagaatgtatgatcatcatctcttatagctgtatcctgatttccactttacaatagagtgctcatattatcatctcatttgtgcctttaacaaaccttttggggtaacaattgttatttccatgtgatagctggagaaactgagtttgaatgagttcctcaggggaacacagctagaaagtagtattgtggggctggcacacagtggctcatgcttgcaatcccagccctttgggggccgagtggggaagactgcttgaggccatgagttcaatactgacctgggcaacatagtgagacccccatctctacaaaaaaaattctaaaaataaattagtcagatgtggtggtagatacttgtaatcccagctactcaggaggctgaggcagaaggattgattgagcccaggaatttgaggccacagtgcacagtgatcgtgtgccactgcactccagcctggacaacacagtgagaccctgtctcgaaaaaaacaaggtagtgtggtgggagtaggacccacacttctcactgctagcctggtactcattctttttgataatgctgttgtgtcatgaaatggcactcaattagtgttgttggaatggtgggttgtgcctgcctcatagactgagatcggagcctactttggtcagtgcctccagtaaggttatgcggtttaagcattggatggaggtgccaggctgaggctgccagtgggtcctgggacttgcctgtacctgctccctggcagtgtgggtccagggatgcccacctggaggaaggggcatcagctggcctgaacctgcctgccatggagctgccttttctttcttcgttttttcttttgtttgttttagatggaatctcactctatctctcaggctggagtgcagtggcacgatctcggctcactgcaacctccacctcccgaattcaagcgattctctgcctgaacctcccaagtagctgggattacaggcgcccaccaccatgcctggctaatttttgtatttttagtagagatggggttgcaccatcttggccaggctggtcttgaactcctgaccccgtgatccacacacctcggcctcccaaagtgctggaattatagatgtgaaccatcacacccggccgttttcttcctttttttttttttgaaatggagtcttgctctgtcacccaggctggagtgcagtggcatgatctcgactcactgcaacctccatctctggggttcaagtgattctcctgcctcagcctcccaagtagctgggattacaggcaccctccaccacgcctggctaatttttgtgtttttagtagagacggggttgcaccatcttggccagactggtcttgaactcctgacctcaggtgatccacccacctcggtcttccaaagtgctgggattacataggcacgagccaccatgcccacccagagctgccatttctaactcacacagaggtatcagagcagcttgcagtggcccgcataagtggccagagctctttcctgggggttgcagggggtttctctgctgacccctcagcaggcagcaagccccataagccagagtgaaaggatgtggtagcagaaactggcctctgaagcgtgggaaacagatctgcttgccgtcagtggcatgcctgccaaatcatgctatccgcaaactcgaggcgggccctggaccggcggctgggcctgaggtcatctgggctttagtgctagttctgctgctgacactctttggttttatttttttcagtttacaaagtattttcacataaacagtctcagctgatcttcacaacaacactccgaaattgtccagtccctcgattttgctccagtgctctgagaggttaagtgacctgctcatgtcccgcagcacttcctctccctccgaggccagggcactttccccagagttgcctctctctggctgtggtgattcgggcaggtcctgtgtcccttctgaatttgacttctcatttgacaaccgagggggctggtgcaagaaccaaaccagtttcttgatcttgtgatgaaaacatgttttctttccactcacttttccatgttgctaatttctttggcctgacaatgcctgttctcttgctgtcttgagagcagcagagctgaggccacctgcccctcggagcatggtggtgtgtccttgcaggggtcagagtggtgtgtggatggcagtgggggccgtggaaggaggcttctggaaggcggcccacaatgactcttaaccctcccctccccagcctccagtcgttttctttcagttaattacctggttgttcaacctccttggcagctccatagtttctttccccacccccaacatccacagccctcttggtctcagagctcagccagaaggaggcagagagtaaaagtcatattgttttggtgggaaatagttaagatgaattatacccaccattcttggtgggttggatttggggctggtgacaggactgaaaggagggattcctgagcttgtgccccttaatttacctcccaactgccctggcgtcaaccacctagtaagccatgccgggataccctccccacgggagcctagcacgccagccagcatgctgacaaaaggaggagtaaggcagctccctaatctcaggcagctctcagtgtttcaggaaaggcaggtgtgtgagtgggtcgttttcctgggtctccctcaatccacaccctagactaggtttttgcttctgcttccacccccactacaatccaagatgggagcttccccacccaaaaacaaacctcagcctctccactttgtccttctccttctgcaatgtcaagcggtcaggccatcccattcattcattcactcaacaaatatttactgagctccccagacgcagcgccaggccacagcggcacagggacagagctgtgagcagggcgtgcaggggtctgtctgctcttggatgggctgagttggctgctctccctgcaagctcccttttcattttcaaatgccccccttagatcttccaataggtccacagaaggcagaaaagaccccaggtgagtgtgggttgtaaccaagtgaaggagtccatgccatctgcatccatgagggtgtgatgtgcctggttgtccctcacaagggggtgctgaaggatggggactaaaggattcaggacagggccagtgtttggcctgattgttatttcctgggttccctagataccaaatacctgggttctgccaatgtgaggctttcacctctgaacagtctggcagcagagcagcagggaatgagcccctccctggacagccaaggaccaggcagtccctcagcctcagtctcctcagctggagagtcatcccgcctggtttttcttctgaggttgtgagagacaagtgaacctctaaaagcccttctcttttttgttttgttttgtttttgagacagagtctcgctctgtcgccgggctggactgcggtggcgcgatctcggctcactgcaacctctgcctcccgggttcaagtgattctcctacctcagcctcctgagtagctgggactacaggcacgtgccatgacgcctggctaatttttgtatttttagtagagacggggtttcatcatgttggccaggctggtctcgaactcctgacctcaggtgatccgcccgccttggcctcccaaagtgctgggatcacaggcgtgagccaccgcgcctggctgaacagggctcttaaaatgctcctgccagagcaatccagacagtgcctcctcctcctccagaaacttgaccttggcctctgggctcccaaaggggaagggtgtacagaggggacttcagggagctggagaagcccctgctgtccttgtgactgagatggagctttaaggagcccccacaacacagtcagcctatagggaagaggaggaaacagagggaaggaagatgggcagggagctggtggtgtctgctgattgggggtaaaggaagtggtctctaaaaggccaaattacccccagagaaacaagaaaggaacaaagggaggactcaagactctgcctgtgtggggcacgaggaatgaggcttgagagagctgtgatctcacctgcgattttgtattctccactctgcctctgaaccccacggcccccggcctggcccaccattcaggctccccagccttgactcccacacggcaccagcggtggcagagcagtgggacacttgctgtgggcagtctgggcagcctctgttcaggaagcctcctgctaccactgcagccagccaagtgggcaagccatttctcctgttcctccggaagtggctaaggtgatgtgtgctggggagggagtggggaggggaaccccttcttggactcagtgcatgccctgggttcaaagctgaggggcactgctgcaaaatgctgtgcaaatataaaatcctttcatagttattgtcatcgtcatcactgggcacattgtgccacctcccagagcaggcactgccctgcaggtgatgtggccttgctatcttatggaagagctcctctaccaactagctgtgtgacctcaggcaagtaagttaatctctctgagcctctgactcctctatgagatggggagagtgtggcctattttctgagccagttctgaggattaaatgaaataaacatttataaccagtgttaggaacataggagatgataataaattccagctcccttgtgggaaaaactagcatgaatttttaacaaaatatcagaatcttcaaggttggtgggaaagcagggtagggagggggagggaggctatttttagggtctagataccaccaccctgagaagagccctgattttcttcactggacactgtggttgatcaactgaagtcattagcatattggttagctcactgggtgcggtggttcacgcctgtaatcctaacattttgggaggctgaggcaggtggatcacccgaggtcgggagtttgagaccagcctgaacaacatggagaaaccccatctctactaaaaatacaaaattagccgggcatggtggcgcatgcctataactccagctactcgggaggctgaggcaggagaattgcttgaacccaggaggcggaggttgctgtgagccgagatcatgccattgcactccagcctgagcaacaacagcgaaactcagtctcaaaaaaaaaaaaagaaagaaagaaagaaagaatattggttagttcctttgcagcccagtttgtgtggttactggatcagattaggcacctcagagagggccaaaaccatgagccaaacaagggcttacccagaccttccccctccccacattttagtttttcacccatccttgaatagacctgggctctgtcctaacaggctgtggtagcctgggccggataaactaccctcacctcatcttcccttcccagggtacgggcagcccaaggcctctctcccaggtgaataggcacacagccctttggatatttgtccagaaggattccttaaggtcactccatggtcctccatggtgctggaggcccgaggtcccagcctccctagaagttgttgctttcatagcagctaggtttcccctgctgtggagtcacggttctccactcttagaagtcagtccctggccccagccagcatgggctttgcttctggagaggctgaggggagaaaggaagggagtggcaactcttagtgcagaagtgtgtttggaagacacccagagaggaaagacgttcactccaccccacccccacagaggccagggcagattcagaacaaacccaggcaaagccctgaagaagctgccttgactctcaagcagcctcttggctgttggtgagggaagacccgccttctttcttgatcatcagagtcttgtgagcaccaggggggaatttatgggcctggtagctttaggttcagaaaggtcactgagaaaggagatgccagcttgaccccttcattccagagcacccagggatggcgttgtctccagtcgggtggtgttgggggctgaacctactgtgggttcatggtcatcctcaggccagagaacttttcacaggacctagaagacctatcattcatgctgagacagttcagaggttgagcctccttctaagagttgtccagagggtaaaaagaaaggtccccagaagtcttggttgagaggcagaagagggagtgggcaggttcttaggcagggatcacacacagtaaaagatacaggcaggtcctgctgcagaaggccccagatcaacttggtcagaggcctagagtcctactcagcacccaaccttgggttccatcgctgcctgccctgggcctcagtgtgtcccctttgaaatggggcagacaggagtccctggccaccctcacagaactgaatgcagtgacaggtatggtcctgtgaccgccccaccccaccactgcttttcctggaggaaatggggacagtggtgccatttgcaatgtggctccatctggagtatcacgtgcaccaatcaattcaatgagacccttgtgctcactgctggattgtgcgatgaacttactgcatctgtcctcaagaaatgtatggtttagaaaagaagtaagacatttcacacaaaatgatcagagcagtcattctgagtttctctttccgcccccacccacattatagacggcaccaaaatgtatgtttctcatgggcttgtatgaacccatcctccccctgctcccaactttctcccctgcgtcatgaaatcttttggaaagcaaatgagtaaaaatgattttaatataggtataagtttgactctacctgttttaatagaagtaagctatttccaagttttagtattctaactactataaatgacagtttcctttcagtgcctctttttgtttgtttgtttttgagagggagtctctctctgttgcccagcctggggtgcagtggcgtgatctcagctcactgcaacttctgcctctcaggcttaagtgatcctcccacctcagcctcctaagtagctgagaccacatgaacatgccaccacacacaggtaatttctgtattttttgtagagatggggtttcaccatgttgcccaggctgacctcaaattcctaggctccagcaatctacccacctcagcctcccaaagtgctgggattacaggcatgagccaccacacccagctcaacacctcttagtggataatggttgagaatcaatatatgtactagaaagcgaatctaagacaatgttataattgtgctatatgtcagccttgttgtttcacatgtaaatcttagagttttatcacgtcacaaatgttcccaagaatacacaataaaagccaagaaattgtagcttgtcatgaattaaatgaattacttgtaaccaaataatttcaaaagcaaaattataaaaatgctttcaactgttttcatagaaaaataaatatatatttaatgtttaatgagcatttatcttcacatttgatttaatgcagggtgagctgaagagttaaaagggtttaaaaggtcttgcttaaaccatcctccaaactatgtccctattttctttaaaatcacctgagcaggatatcccacagtcactcttgtttacatgctccacagcctgaagtttcaggtttaagacattgcaaaacaaccttttagagctggaagagatcttgttagctggaaggctcctaggctggttgagcaggaggagagctctgggggtgtcaggggcaggttggggacaggagacgttcttaagagcagaagtagtaccagtagcgtgcatgctgcctcagtttttcttggtgtattaaagacttgtgtggcctcatctccactccttctccaactaaattaaccctattctttttatttttattccactttctaaacggtttcccattttcatcgccctgccaagacctcagcagctctctaaaccaaacactgaaatgctcaaagtgagaaaactgtttctttctctccagggcaggattgtgtcttaactgtggggctgccctgacaaatcacctttaactcacaggtctactatccttccagatctaaagaacgtcggcctaatcggttcttggcctattttggaacggggcatcagaccatatgcagtggccattgagtaacagtgatccagcccgtgctgttttggattctgagtccgctctcagcagcaagctagatgttttggtctggggcatatgaggcaaaagagaagtagaaaatgtggctctgcagtcacgaagctcatgccaaaggggagaggcacgaagcagtaaagaatgcagttgtgccaaattatttggtgcaggcaaagaactggcgtttgcagaagcccagtgcccctggagcaacctcaaccaatgggtagaatgtggactggcaggaggaaggggcattccaagtcagggatcagcggcagtccagacagggagagggtaggtgttggtgagttcccaaaggtgtggacctggctggatggaagagatgtggactggggacacaggtggaaagtgaggtgaccagaatatgaggccctaaaagccacatgatggggagcggggaggtctgtgatgtgatgcaaaaacaaacctgaactcctggggtgatttttgaacagggggaggcatggccaccgctgggccgtagtgtgtggcagatggaggcggatatgtcacatcatgtaatcgccaccattgtgtggtcacagaatcatggtcggggaaactagatcagcaggtctatggggcccttcaagctaatctggactgaactccttttttaaaaatgtctttttagtttaattttcatttccaattaatcccactcctccccgttttcaaagtaatgcacatgtaatttagaaaactctgaaagtacagaaaagaatacagaaacaaacaatttctcatccacatccccagagtaaccataaccagtgccacctgtttccctccagtctgcattttcacgtgctactttctttacatggttgggattaaacagtatgaataacccaactgtccattagctatgtgagtttgaatacttttagtaacaggatggtttatcttttttggtaactaggatctcactacatttttaggtatgccatgcctttttaaatagagagcaaaataaaaatgtttttccattatgaagtaatatatgcttatctagaaaatatgcaatattaaaaactgtaatactttaaatcactcataatccaactgttcagaaattaccactgtgaatattttggggtattttcttcgagtattcttccaaaataatatgcattttaaaaacaaaattggaattacaccatatacaatttgaatcttgctgcctttatttatcaaatcatagatgtttccatttccacctcacatttattgagtacttagcatgaaccaagctatttaaagcattttacccatattaatttacttattcctcacaacaactttttgagataagtacaactttttaatctcgccttcacagacaaggtaagaggcacagaaagtaggatttggagacaaatagtctgactccagactctgcgttcctgtccacactactgcctctccaattggtttttagtgaaacttccttctaccaatctgacccgtgttccactggtccttgttcaaaccctcgaagccccccaccaaacacacacacatacacaagtccaatctcttttccatgagacagcctttcaaataggaaagcagctttaaagtcctcaagtcttttctaagcttaacattcttatctctgctattcttcatgttccgaaggccctttgccatgttaggtactcaggcaggtctggttcttccatgtcccattaactgcgtagctagaaacaaatgcacggctgtggtgtaacctgcccaaggaagtctggggtcagcctctccatctgtgtgtgagagacatcagacagctgtcagtgtagccggagctgcactggcttttccatatagcagctgtgctgcagtaaacacagtgcttctccacattcttcagcccctcacagctctatggtctggctcgtctggccttttgattctttgcctggtcctgcagagcacagcccagaagaaaggaagagttgccaagggctttagctcagctgggctgagaactttcatgacatcctggtggggaccaaaatagtcatcaggacagaaggggagacccagggctggtcacaggattggcagcagggccagcaactgccccatcagcaccagcatttctccatatggcttccaagttttgcactaagatatcccaagaaattatcaagacttcagagccaggccaggcacagtggctcacacctgtcatctcagcactttgggaggccaaggcgggggaattgcttgaagccaggagtctgagaccagcctggccaacatagtaaaactccatatacacaaaaaataaaacattagccaaaagtggtggtgcacacctgtagttctagctactcgggaggctgaggtgggaggatcacttgagcccaggaggtcaaggctgcagtgagctacgatctgctgtgctggagcgccactgcactccagcctcctgggtgacagagtaagaccctgtctcaaggaaaaaacaaaaaacacttcacagccagtgtgccagagtccaagcccacaggagggatcagtgaggaaggaagctctgggcactggaactacacaaatggcactttcaagtcaggaccatcttccatctctgggtctgtttggaaaaaaagaaaagcagctttgtttgtctttcttctggcactgaccactggaatttgggctcaaggcaggctccaggtaaaattgtcaaggtcatgggctttgttcttaacgtcttcctcccttttgctttctcctggcccagccgctcctattttctctaagggtcctgatagaggagggagagtaacctgataatttcatattaaggcattccaggtaggcagaggtttaatttgtcacccctctcagagtaatatccttttaacagtaatctcttggattccaaaatgcttctatctaaaaatattttcagcaggaggagagctttcagctatccctcaaattacaacagtggggccaatagcctcttccatctatgtatgataagaacaaatactacaaatttggcactgtaacctttacatctttgccccttaacttccacacgtgtgagatgaggataatcataaaacatacggcatagggttttatgagaatcaaatgagataatgcatagaaagcccttagaatgaacctgaaacataataaaccttctatatgtgttagatgttattattattattattttgagacacagtctcactcttgcccaggctggagtgcagtggcacaatcataactcactgcagctttgccacctcagcctcccaagtagctgggactacaggcatgtgccaccacgcctggctaatttttctatttttttgtagagatggggtttcactatgttgcacaggctggtctcaaacttctcagctcaagagatctgcccgcctaggcctcccaaagtgctgggattacaggcgtgagccaccatacctggctgctagctattattatcactatgaattgttattttaatcacagagaagaatcctatatattatactattttatcctcacaaaaatcctgtgaattaagaatcattggtcctattttatagataaagaaagaaaattaagagattaagtatgcagctaagtaagacatgacacagagccaagagctctctgaaaggctcattctatttgcttggtagggcttggggagagtgcacagtgggccatccctgggcctggtgtaccagagggtataagagaagccaagattcagagtccaccctcaggaagctcagcagaatctgagaaggtgtcagcagcccaagaaaggcgccatttcaacccataatgttatagcgcttcacttctcaccaactgcttttcttctgaagggggaccccaggactattttccaggacaactcttcctgtttcaacatgtagaaaagtaaagaaaataatataataaactacatatacatacgttagtgtgtatttccaaaagataagcaccctttaaagaaaaaaaatatatactatactaccattatccctcctacaaaatttacagtaattccttaatatcatcaaatatcaagttggtgttgaaataatttctctgtctcatgttttttacttcacagttcattttatccaacaaagacagtttctctgtctcttgcatatctagaattccttcccccacagcccgacccctctctttatttctttgaactgtacgaagctaggttatttgtgccacagaatctcccacagtgtgaatttttgctgattgcatccctgtggtgtcatttaacgtgttcctctgcctcctgtgttttttctaaactggctgttgaatctggaggttgatgggattcaggtttaatgtagcaagaacatttcaaggtggttattgtactttcctcaggaggcttgtgatgtgtcctgctctttcttttggtgacaccaaaagccactgataatcattgcctagagcctctatttcattagggattatctttcctttttcatttgtttgctggaatatttctatagagagaaacttacccttgttaactatttggttaccctgataaatgcccaggataagtgttcgatttcttccctttatttataatgatttattatttatagataaaatgacatgatgcctgtgatttgattcaaaataatccaggggagaggggactgggtagggatatagaaaaacaggaagagccgtgagctgatcatcgttgatgttgtgcgacaggtgcacagaggctcattctactattccactcttatgtgtgtttgataattttataataaaaatggtggggttttttcccagtaaaaagttaagtaataatttggttccttagcatcctccaagggtgagcaataagtatgttggttggttggttttagggttgtgataaatgtaggaacataaaaatatttgacagttttgccgggtgcggtggctcacacctgtaatcctagcacttcgggaggctgaggcgggtggatcacctgaggtcaggagttggagaccagcctggccaacttggtgaaacctgtctctactataaatacaaaaattacccgggcatggtggtgggcgcctgtaatcccagctactcgggaggctgaggcaggagaatcgcttgaactcgggaggcagaggttgcagtgagtggagatcgtaccactgcactccagcctggggacagagcaagactccgtcaaaaaaaaaaaaaaaaaaaaagacagttttaacccatggcagtcgtttttcttatatgctcaagttgttccatcgttggccagtgggagcctcttcaagctggctcccaaatactttttgaactgagtccagtagtcttcgctggtgtctgtgctttcagcgggccaaggtgtcccatttgtgtgcatttccttcccagaccgggggctcagccagttttctgaagtagggctcttgtctttcactaaagatcttttctgtggcatgactctcatcattcctgcctggccactgttatctaaaaagatctctttgagcctccagttaggttctgtggccagaagcagaatttttctccccacaccccaaacaagtgtgcctctgccaccctctaaccccactaccgctaccctcccacccctacccaagcaggtgtctcagtgatgcgttgactgtgctggtgggtgggtggaagggaaaggagattaaggagattaaaatctgactttaaagtctcaggcagtaactttgcctgaggctggctcccccttcccagccccacccccagactcagagccagggagaagcaaaagagggcagtgagactattcagtatctctatccatctataattaggcagatttctcttgcgaatgaaatcagagagaaatatttaggaagaaggaagtggggtatctctggttcacacggctttatctagtcttccgggggtggtgaagggagagggtgtgcagagcaggcagagccctccagagacaagtacaagatgaaaacggcatagaagaccaaaagggcacaggccaggagcagccatcagatatgcaaggtgcaaccaagtagaagatgagagtgtagtggttaatttccaaggccagagctagcagatccgtgagtcagtgtgacaaggaggctggtgaccagtaaaaccccccagcaaaggagtgaggggctgcaatgtgcaagaaggggttccccttcacagtgagagctcctcaaagtctggggggtctccagtcaggaatgcttaggtgaggggtttctataccctgaccagacacacatcataatcttgcagagcacagtgacccttggctgaaagagagaacgtggacttgcctgtggcagagcagaaaagacctaggactcccagttctgcacgaactccccagctgtgtgaacttggtctgggctgttccttcccatttttttttctaatgggaataataacagcgcctcattctcaagctgcagttggggttgaaggagttggcgagaagctctgtgaatcactggctgtgagcgcggctaaatgacatttctcctagtagcctgtgggcgtgggtggtctgcaggtaggcaggaagcaaccttattttcgaaacaatatgcaggttgcagctgccctcagatgggccttggaggagagaaaggcccagagagaaggagatggcaagcagggagcaggagaaaccacacttgccccctgggcggtggagggcagctcgggacagctggctatctcaggtcagagaaccacccagagggtgtaagagggagtgtgaacacagaaccacagctcttcaaggaaaggcctcagaatagatctccctgtaagactacagatgggtgtgtgtgtgtgtgtgtgtgtgtgtgtgtgtgtgtgtaaaacttgaagaagacgcctaaggagtagacatctgatatccttcaaggccccagctgtagaatacttgtgtgggctggagggcaaaggtggtcaggccagaggagcaggtgggcaggggctgccgggaaggccaaggaattccacacactagcaaatgttcactgatctttcatgcaggcaacacaggtgtggacacacaaagaatcctctctaggccatgggggtcactaggccatgaggacaccaagccgaacaggccctcacagtgtgtgggagtggcaggatcagacacaagagggtcagacacaagattagtaatgttgtgtctccctcaagaatatctgcatatttagagcgcttccaacagatgcctttgcccactttgattttacttctttaaagaaaactgtgataaatacacaatctgcagtaggacctgacttcaacagccagcaaaatcctaatagatgtgcaacaataccctccctcacccagctatgaaacagaattcttcgcttcgttgttactgtccccttgaaaaaaaaagtccacattttgctttcttaattgtaatgcatttaaatagataaaataaattttgctagacttgctttcccgcatgtgcacacactgtgtgtgagtgcatacaaacacatttggccataggcataattctgccaacctgaactgcagcctaaaacacttcctaatttttttattgtgagcgttttatcaggacattgaaaatagtacccccaagaaaatataagtgaatgatctttgatctcaaaatgaggaaagattttctaagcaaaaatctgatgacttaaatttcaacttctatgtgccaaagacaccaaataaaaggtagatggtaaagagggaaaatattcacagtatataccataggaaaaggatgaatccttaatatgtaacacgctcttagaaatcatttagggctggacacagtggctcatgcctgtaatcctagcactttcggaggctgaggcgagtggatcacctgaggtcaggagtttgagaccagcctggccaacttgatgaaaccccatctctactaaaaatacaaaaaattagttgggtgtggtggtggtcacctgtagtcccagctactcaggaggctgaggcaggagaattgcttgaatccaggaggcagaagttgcagtgagccgagatcgcactactgcacttcagactgggtgacagagcaagactcagtctcaaaaaaaaaaaaaaaaaaagaaagaaacagaaagaaaaaaaaaagaaatcactttgtaagagggtacatcaaaagaaaaataaagccgagtgtagtggctcatgcctgtagctccagctaccctggaggctgaggctggaagatcgtttgagcccaggagttcaaggctgcagtgagctaggaacataccactggactccagcgtgagagacagaatgagacccccatctctaaaacacataaacaaaatataagcaaaagtcatcaccacacaattcataaaataggaaatacacagggtgaagaaaacacatgaaaaaaatgttcaacattgctactattcaaaaaaatgcaaattttaaaattagactatttttgcttactgggtaggttgagttgttttgtttgctgtgtgtctgtttaatgataatacccagtgtggtgagaacacaatgaattagagtctctcaaaaactgctgaatgtaaattggttttgtctttctggaaagtaagtcagccctaagtttaaatagcccagaaaatttagagctgaattactttccagaaagatagagccaattttctttaaatttaagggtgagttactttccagaaaaatatatttgtcttttagggtacatgtttccatgtgtcttaatttattctgaagaaataatcacgctgagcgcagtggctcatacctataatcccagcactttgggaagccgaggcaggcagatcacgaggttagaaaatcaagaccatcctagctagcacggtgaaaacccacctgtactaaaaatataaaaaattagccgggcgtggtgatgggcgcctgtagtcccagctactcgggaagctgaggcaggagagttgcttgaacccaggaggtggaggttgcagtgagccgagattgtgccattgcactccagcctgggtgacagagtgagactccatctcaaaaaaaaaaaaaaaaagaaagaaagaaataatcagtggaataaaatatttgtgttcaaggatgttgactgcagcactataatactaaaaatcaacgataacctgcatttctaacaataagggcatagctgagtaaattattatacatagcaatacctcaaaatagtcaaaaaataggtaatactaagaaaaatcaaacaaacacaaaccctaacatatgatcctaattttgaaaaaaaggaaagcagtagaaaaaaacattagaagaaaatatagcaaaatgttaaagattatgtttgagtggttggtttttggctaatttttattttcttttccacgcttttctgtattttccttgtttctttttttttttttttttttttttacaattaacatttttacttctgtaagcccaaaagtcatataggaaataaaaaaaatatttcccccagttttggattgagaaatcaaattcttcctcatgttacccaatgaccctggaaaaggcaggtttgctgggggagaaataaggagttctgcttaggacaagtagagctgagttgtccgttagatattgaatggatgttcaagtctggatttcaggagagaactggggctgtagatctaaatggtggggtcaacagtatacggatgatattttaaagtactgagaaaaggccaggcatggtggctcatgcctgtaatcccaccactttgggaagctgagatgggtggatcacctgaggtcaggagttcaagaccaacctggccaacatggtgaaaccccatctctactaaaaatacaaaaattagctgggcatgatggcatgagcctgtaatcccagctacttaggaggctgaggcaagagaatcacttgagcctgggaggcggaggttgccgtgtgccgagatcgcaccattgcactccagcctgggtgacgagagtgagactccatctcaaaaaaaataaaataaaataaaataaagtaccgagaatgaatagatgaaatcacaaaagaagtgtgtaagattagagaagaggtccaaggcctgagtcttgattctctccaagacatctaggagaggcagagatgccatccaaggaggctgtgccccagtgaccataggaggccaatcacaggctttcaaacagctctgtaatgactaggacatatttattctagaacctcagatcatttgcttgaacactttcctttatctctcactctgctttcaggcctaattattggaagaaaaaaaaaggggtgaggaggggagatctgcattgttcttgaaaataaaatcgcttggaaaacagaaaatgtcagattaaaaaatgcagagtcaatgcccgtgactgtcttaatgagtgtagttaagtgtcccaacatcaacaagaaccacttaagcatactgggaagtaatccaatgccagaggacagggaaagactcgatttccttctccagtgaattcccttgtttaactggatcttacaactgaaaatcaaatacgtctccatcttccaagacaactccttagctctgtgggcccatggtttggatctggacatttggacgatttaaatggactcagtcccacaaatgtataaatgcttcttgccaaactttgggaggctgcactttttgggaggctgagggggggcagatcacttgaggtcaggagttcaagaccagcctggccaacatggtgaaaccctgtctctactaaaaatacaaaaattagccgggcactgtggcacacacctgtagtgctagctactcgggtggctgaggcatgagaatcacttgaacccaggaggtggaggttgcagagagctgagattgtgccactgcactccaggaaaaagacaaaacaaagcaaaacagatcacgtattttttagtggtaggaactcctgttttttttttttttattgcagtttgctcttctctatgtttgggaatgtagcttcctttccctgcttggaaggaaagagagcactttattttttggttcccttaattcacaacaaatcagccgggtggagcatctcagtctaggagcgactgcatgactgggaattttagccactgtggatttgttggttacaatttagcagaaggcagggctaagaacaaaggtgggtaaagaaaagtgagggttctcagccttggtttccctttactgggagcaaagtatcaagggtagaaataccagcccttcccaggtgtctggtgagtgcctgagatgagccaggtgacctgagctctctatgcaagtcactgactgtaactgaaggaagaagactctaaaacagttcctgctgggctaccaggaggctcactttgaggagtcttcgaattaaactgattgatggtctctctgtgtctggaagaggtgttttggcttcatgtcagagctcccatcagagaggcctgagctatgagaggtttgaaaaatgattcagaagaaaaaattgactctgttcaataataaattataacgatgctttgtatttatagagcatccttcaactgagggagtgcgaagttctttatgggtattaacttgcctttctcacaatagagaaaagataattttgtcaattcaatatttgtgtatcttttttctttccttttactgggggaggaggacagctattacagggacgttttcttatattaatttggaggcaataaatcttcccctcattttttttttactggaaatcttttctcattgggtatcacataaagaattaaaaataaatagctatgcctaaaatgtatgtgtatgtgcatttatatgtcggtgtgagcgtagtatcttcataaatatttaatttttactgtctaagccttctccctcagttttcatgagctagaatttattcgccactgaacactgaagctattattatttgcttttgcgcctaaatgatttaaaagtcaattatgaattggctaaggggattggagaactctggcatgtaatacgcctctcatgcttctatttgttaccaaatgtctggaatgagaaagtgtccatgatgggaaatagcccacagaagtaccataccgttattaaaccgaccagacggaggccctaggtcactgggatacgagcaaactgtgctggggttcatgtgggtgggttaggaggctggggagagcatgacaggggatgtgcagacagacaaataaatccgataataaagcagaagctcagaactgtccaaaatgatgactgaaagccagcagcccaaggagaggctgctcttaacagccagcccccaacgcttagggctgtgctctgcaccaacctgccctagtgtcctggggagggaacgtaaacagttcagcgctttctatttaactgcaaagtgctcatcttctgagtcaccgaggcaaagaagcaggctggaaagtagtaataatccaatccaacagaattatctgttgaacagaaaatcccctttggaatttgtgtccttggaacgttccaaatggaaaatgagagttttcaggtgggaaagcaaggcatggtttcatgagtcagggtgactctgcgtttgcatgaagggccgcagaaaagcagattatgttaaccttgaaattagccaggagcgaatggcaaatctttgttaacaagcttggagtccacgataaattttaaaagtgcaccgcaatgagcatctgtaataaatcttccgttgcctcctggttcaggtctgggactgaaaaggataaaggggccgggcgcggtggctcacgcctgtaatcccagcactttgggaggccaaggcgggcggatcacgaggtcaggagatcgagaccatcctggctaacacgtgaaaccccgtctctactaaaaatacaaaaaattagcagggcgcggtggcgggcgcctgtagtcccagctactcgggaggctgaggcatgagaatggcgtgaacctgggaggcagagcttgcagtgagctgagattgcgccactgcactccagcctgggcgacagagcgagacttcgtctcaaaaaaaaaaaaaagaagaggataaagtacttctagaacaggagctaggcctcccgaagcctttgcatgttaactaactaatcaaggggctccagcctgttgggctcacattgcctggtctttactcacttgactttccacaggcctcgctcttgaaaactgaaattgctgcatggcattcattacacacacgtatgtatatatgtgcatatgaaaatacatttgcataggtacctatccatatgtatatacacacatacacacgtttttcctcataaatgaaactggattaaattttatttccaatattcaggtgactcttaaaactgaggggaaaaattggggataaaaagcaggacaaggcaataattatcctgtagcttatctcaaaatggaaatttccccaacaacattagttctaaattctaatatttaaaaaaaaaaagacgaatgtggtacagtattaaaatggacttacatttaatacacagaacatctagcagcttggatcagtacaaactgattttttttctaaaggctatcagagttaattggcaaatagtcagaaaactgtgcaagggggaggaattcttctgtttgtgcatttgtttgattttaggtacttctaagtgctgtgattggtagtaatactgagatctgtgctgagcctcgaactccaaagttgcaactcaaatccctgatgaagttaattaagtctgagtcttgggctctgcagctagttgatgccagaataaatctaacgtgttgtcagcagactgaaccagaagagcaaagctccaaagaggaatttctatgcagtaaatatcacttaaattcctctcaaagttggagctggtgtcaaagtccagaaaagcaatattccctggcaattgctgtcaggagtgtgtgcatgtgcctggccatgcatcatctgaacactcaaattagcagaggaaaaagatagtgagttaatatcacccagctgactgctcaaagaactgctttaactgtagccagagaaatatggagggggcatggccagtcatcaatgacctccaaatgactagatgctcagaagtgtctggcagcctaggctagataaataattcctgctgctgtgaaataaataaattcccccaaataattcagggaaaccaattctttcactgcccagttgctgagctacaagaaactagagcaacactacaggtgaagaagaaagaaaggggctgggtgcggtggctcacgcctgtaataccagaacttttggaggcctaggcagatggatcacctgaggtcaggagttcaagaccagcctggccaacatggtgaaaccccgtctctactaaaaatacaaaaaaaattagccaggcgtgatgccgggagcctgtaatccagctactcgggaggctgaggcaggagaatcgcttgaacctgggaggtggaggttgcagtgagctgagatcaccactgcactccagcagcctgggcaactgaacgggactccatctcaaaaaaaaaaaaaaaaaaaagaaaaagaaaaaaaaaggaaggtggaaggcatctatgagtgactttctatctcactgatctccagtttataagggactggccactggaggcaggttggcctagcagggtggtggggagggggctggcgccttctccaacaactctgtgtatgaggcttgtaaacacatgattctctgtctggataggtctctgaaggagaagaaaggaggtggggaaggaaggaaagaaataaatatatggacaggaagattgagtattggagggagaagagaaaaagcaagagatggtgaaaccaataaaaaggaaataaacgtaaaatggagacagaggggaagaaagagctggaataatactatgtggctctctaaaagttgctgcagtttttttttgttgttatttgttttttgtttttgtttttgttttttacagagcacacactgcagataaatagtgcgatcttggggccttttcggtaactgtacttctattcttctttccctttgcttttgtctaattaaaagtgtctgcctttaaaacagagacaattgaagtttcaagttagtgttgtcatcttctgtccccaggcatttcagagctagaaaaactacaggcaaaattctctgtagatcctttttgtacccctcttcttctactcaccctgtttccccagctttctacttttagaataggagtgggggctgagaaagataaaaatagcttttgagaattcaagttatttgggcccctgttttgggagccagcatccttgtccaaagcagaaagcagccagtcctgagtttgagggaagcttctccccatggagtttccttaggggactatttctgagccgttcttggaggaagcaacccctagagatgttcagaactggaactaaacccatcttcccctgaagaaaaacaggtttttaggaacccatcactcagcagggagccctctgtgtttggagccaagtgtttggggaaacaaataagctgccttcaatcagcctgagttggaaacgcaggaaaaccgcatcttcatgctggactccactgcaatcccaaggtgattttagttcaaggagagtggcatctgcttgggggaaattagaaacttcttatttccatttataaattaggcttcactaaggaagagaacttaaaaacagttttattgttgtccactgaaaagacaattacttccagccacaactggcacattccatggtaaaactagcgcaatcaaacacacaacactttccaccgtaggggcttctttttgaggctgtcattaaaggcatgtgtcttattagccagtgtcaggatttctgggatgttttattgtctcgagtaatgagaaggccatttccagggctgtgtgctttttaagtcagcaaacaaaacattaaaaacaaacaaacctccttttctttgtcaccatttctctgaccatcccctgtaaattcgtaggacatggtactcacagaaaaaggaaaattcattagccgaatgaatcgctgatttaaattcaggcaataggttgacattatccttaattgaatagttttagaaaatgaatctatgtagatccagatcaaattctaaccaatcattgcaatggggtcttttttcttgaatgttcaaagttgattttcctccacaaaataatgactctttggtgtccaagtaataaattagcacagttcagttcaagttcccactaaattggaggctgaaatgtaggatcaagagaaaggagatgcaagttacaaacctagattctaaatatcccagcagactaactccatgaaaccatcttttattttttgtgaataagtgtatgtgtgttagcctccctctccctttctccttttaaaaaaagaaatgatgactttttcaggtctctgcttccagatatgaggggctttaggtatttgaagtcagaagggaggcaggaatgagcactgctaattgggtgcatcctggtgtgctaatataaaggacagccaatgtaatcgtgggtttctgagtttgctgtctgtacctggcctgcctggagactaagaaaggcttgctggccccaggccataggtcacattgcagccttgactgtaattccctggacaattcctgcaccagaacagatagtgtgacctcctatgctaaccagccgagagcaacccatgctcagtggcaacgcagaaaagccacaaacagaacccaggaagggttcctgggatggcccggcgactgcccatcctccagagagagctggatcaagcaaaagaagcagtccccaaattcttagggccagggatgccaggtaacctggcacccaaggctatctgaggagacaggcaatgaggctatcaagagtaaagatggaagagcaagcacagatgatggagaaaaaaataaggctggtgggagggaattaaggagggaaatgcaaggaagagacaactgagaggaaaaccagagggaaggagtgtatcagtctgaagacaggatgacacaggagaaggggaggatgagggccggaagggcttcaggcctgcagggagggagggcagacttttccagggggtgggagaattgccctggcccccttttactggtcccattctttggacattgtagagagaactcaggtgggggaaatggcccagcggcgggaaccctggcacacctctcccagcagggatcggcccccaaaaggaacagttctcctccttttctggcttagaccagggcaggccccctgtgcagctctctcccttgggttctcgtgtatgtagatacacttgtttacacacacaggctcctacacaggcacatgcagagacgcctaggtccccaacctgggttgtgacttctgtgtcgaggagagccataggaggcacagctttgccagagttcctgcccattgctgcggcctgttccctaaaccacactggtctggcttcatcgctggactcactgtgtggcccacagaggcctcttctatggtcacagggccccagtgacattttgggaggggcttcagggatgctggctggtaacccaagagcaaccctaaatcccaacttggtccatgtcctagaatatcaaaggagaatcttaaaccctgagtgggatgaggagcctcctaagcttgaagggagccaggtggggagagggcctgggctccatgcaggttgggcatcagttaacctgtgacagtggccaagtcccatgagacttacaccatgctaaatattcagctttcctcctgtgggcatcctatactctgtgaattggtcagaaccaatctttaatccagcatcctatcaggcacacctccctcctgctgctgtgtgcctgaagaatgtggagtgatttagatattcattgacctaaagtgcaactaaggtctgagggtgggggacacaaaagggaggttaatacaaggcatcaaaaatgtactttgactattttctcctttttttttgagcctgtcgcccaggctggagtgcagtggcgtgatctcggctcactgcaacctctgcctcccaggttcaagcgattctcctgcctcagcctcctgagtagctgggactacaggcgcccaccaccacagccggctaatttttgtatttctggtaaagatggggtttcaccatattggccagggtggtctcgaactcctgatcttgtgatccgcccgcctgggcctcctaaagtgctgggattacaggcgtgagccaccacgcccggccgactattttctcttatttcaaaattacatattcttatacactatggaacttggaaaataagggaaagcataaagaaaatttaaatcacccataatttcacaaaccagagatgaaaccactgctaacagttgctgtaatttcttccagtctcttttctacagtgagatctgtatttctagctggctacacatagtataaatctaggtttagaatcaagtagaaatagctctagagtgctgccgatgctgccattggctctgatagtggatctcatttatccctgggtccaggtgagaggtcctgaggacccaaatcatgggacaacagagagaaaaagagaagaggtgacatgcctaggggcggcccggctgagtttggaagccgcaaggtgaactccctcccatgggagaaagctgccatgggaggcggcagcccagcagtctgcctctcagcccacgatcgcccacgtccccagcatgtccccagcgtggcagctgcaggcacggcaggctttgtggggcctttgatccacgcaaagtacgtcataggcgaatgctcacagcgcgtgggctgggcacaccaagggttgccaaactgacaaacacacctccaggaaagccttttggctctggctgggcttcattctggctgcctggacagcatggcctgaataggaaacttgcaaatgtgtgtgccctgtccccctggtgtctcccagcccagactcaggagtaactcagagataactccccgagagttgaacaatgagaacacatggacacagggcggggaacatcacacaccagggcctgtcggggggtcagggggctggaggagggatagcattaggagaatatctaatgtaaatgacgacttgataggtgcagcaaaccaacatggcacatgtatacctatgtaacaaacctgcacgttgttcacatctagaacttaaagtataatttttaaaaaaagaagaaataactcgccgaggccgtgggagtagttagtagtggggcatggggccagctgagaagctggctctcctttctgcacattttggcacacagggcagatttttctgaagcacaggtatattgcccttcaacatctgagacatacggctcttggtcataatcttatttctttttttttatttttattttttgagacagggtctcactctgtcactcaggctggagtgtagtgatgtgatcttggttcactgcagcctggacctcctcgggctcaggtgatcctcccacctcagcttcccgagtagctgggactacaggtgcgcaccaccacacccagataatttttctattttttgtagagacgggatttcgccatgttgcccaggctagtctcaaacccctgggctcaagccatcctcccacctcagcctcccaaagtgctgggattacaggcgtgagccaccacacctggcccataatcttatttttgttcaaactttcagaggattagggagggagagtagaaaacacaggaatgatgccaggaaacctaccctgggttcagccccaaagacaagaattcggggaaaacctacctgacttgatcatttattcattcattaaacccttatgattgcccactgcatggtggttagctggggagtgaagagtcaaagaagaataaaacatatcccaggctttgtggaattctcaatttttaacggggacagacctgtcaccaaatattagtgaaaaatgtgccaagaactacagagcatctgaaaagttagaaatattaccataaacttactttaaaacagaactttagccacattttcaaataatatgctcatgtttttcttcaaccttcacacaccatttcaggaagtatctctacatttaaagcgagtccagttgttaatgtaaaaaaggtacaagaggccagggcacagtggctcaagcctataatcccagcactttgagaggctaaggcaggcggatgacctgaagtcaggagtttgagacaagcctggccaacatggcaaaatcctgtctctactaaaaatacaaaaattagccgggtgtggtgacgtgtgcctgtaatcccagctactcaggaggctgaggcaggaaaatcgcttgaacccgggaggtggaggttgcagtgggctgagatcatgccactgcactccagcctgggtgacagagcaagacttcatctcaaaaaaaaaaaaaaaaaaaaaaaagagttgtaaggaaaaagccagagaaagtagtgtatttcttgaacctttaaaaaaaattaacaattggacccatttctttacatttagaggtacttcacctgaaaacatatctaaaggttacagaaaaacatattgactgtattatttgaaaatgtaactaatattctgtttaacaataaattctccccatgattttttttttttttaaatttttgagacacagtttcactctgtcaccaaggctggagtgcagggnnnnnnnnnnnnnnnnnnnnnnnnnnnnnnnttgatctcggctcaccgcaacctccccctcccagcttcaagcaattcttgtgcctcaacctcccgagtagctgggataacaggcgcacgccacaatgctcagctaacagatttttttttttttgtatttttagtagagacggggtttcaccatgttggccaggctggtctcgaactcctggcctcaagtgatccgcctgcctcagcctcccaaagtgctgggatttacaggcgtgagccattgctcccaatttctccatgattcttgacttttaggtcactccatagaacagaaacagatgcccattgtgaaggttcagtgagccaagattgcaccactgcactccagcctggacaagagagcaagaccctgtctcaaaaaaaaaaaaaaaaaaaaaaaaaagaaagaaagaaagaaagaaagaaaaaaacagatgcccatcaaaaggaaatgcattttgctgaaagtagcgcagttttcccagggaaataacatttgagccgagccttgaaagatgagtaaaagttcgtcaagctgaaaaatttcatcgtaagatgagtcgaacacagggtcattgtgagccgttggctggcccccgcagaaacctggcagcccctttcaggtgaacctccagtccattctttattcaggcaccagtaggatgctgtgctgggtggcattcctgccccagcaggggctaggcctgagtcacatgcagggcaggggcctggtcacagcctggggcctcacctgagaaagacctgtgagaaaacattccaatcccactcattcctgcccacaccagggctaggcacgtggggacagcagggacggtgaagagcatgtttgggaatgtgatgttctgtggtggcttgttaggaaatcataagtagctttctcctgatgaccagcttgaacactggatcgctgagcagggcacaggtggaaggaatcagaaattactgtattaacaccagtattttggaggcacagaaacaaggggtgaagcaacttccctaaggtcacgcactttaggtgatagcactggtgtaggctcccataaaaatgttctttcaggtctcttcgaactcataggttcttgaaaatgtgaggggcgaaattccttcattttatggcattaatgaccactaatcaatcaatctttctctcaattatctgagcaattatgtaattactgagtcctagtgatgcctacaactgggcttcctacagtcctgcagtggtagaaacaaaggaactagaaatcacggtgtttaccttggagcaacctacaatctagttgcataggaaagaacccatttgacacaatgagagtaacaaaaacaacgaatgcagttgacattggaatgggctggagctttgggagaaggaatccttaggggaagatgaaagctaagaaaggcttggagaccatcaatggagaggaagggaaaggacagtatctggatggagagctctgggcaatatttaggaagactcaagagcgcctgctcatgaacagatggacagacaagcgtgtgctccctcctgaactcacagacttactggctcacctcacagcagggctccccttccaggctttgcaggtgatatggttccttctccatccaggataactccagtgaaggatggacagaggcaagattctagctccattttggctgcaatgcgtccttgttcttttctcctttgctggtcattctggtctgtttgggaattggactcgttgtctctggtcaactaacctctaaccctgccagggggactaagcatgctacagagcgcccaggtcccccacctcccacttccatatagccctgagcaaaccacttagtgtcagtctctaaatggcccagagcagcttgtggctccattccaggagcaaaagcactgctgagaatgtgcggatgcagcctgagacccccaccatgccagctcctagcgctaaagcaggctggtacctcacactgctttcagaatcttctaagacactgtgggtgtgaggtcttccaggcaggcatcagcacccaccaagccggtcctcagaaaacgactggaggtagagaaagcagggctggaaagagacaaagaaattccaggactgtcctcactagcatattctaaacgaagcagatcttcaggcagccgtgttaggtatgatgtccccgagagagtacacattaacatgacaaagtttgaggaatgaacataagatggccatgcaatgtcaaagtcatggctcacttgggtgcttctctgacagaagagatagagtgtggcaccagtagtccctgttgggttctgtgtctacaacagagagctttggggctgccctccctcacagagcaggctttctgcaaatgctcaggtagggctggatatattcgtagaatcttccagacccatccaacccagaaggtggtggtccccgaagagtggtggtgtacatgagaagctgggggaacgtgttacaaggcagacccctgggccggccttcagagagtctcattcacctgctctggaaacactgctaaggacttggcctctgctgtgagccaagaggaggaaagaaacccctctcactctagaactacctttttctgcctcaaccaccttttttcctgtcttttaaaaatttccaaaattctctgcatctgtagtttttgttaagtactttgtcatgccacctggttagctcaagccagagacaatcaggaaaaagctctatcagtggctgtcaactcagccacttccctccgtaccgtggtccctcattcctgcagctgggtgggagccagcacagccccaggcacaggcagtgccggcatgtattctcggagctccacacaggaatgtcccactctagaagggaagataaaatttagcgctctccatgcactgggtatgtgtgccaggaaagccctgaaacttttgctcacagggctcaaaatgaaagcagctgttgattccgagagtggcaggtttgacgacatttggagtccccctatgtgagaacggagagacccctggcgcttcctccctgctatctgaggaagggggagggggcggggggtgggaaggcccagcctctcagggttgcgtctctccggggcttcccaaggaggcagcgccggccctcccagtcttgccactgtcgccgtgctcgtgtgccgggccagccggagccaggcccgatcctggccactgtgcccaccaccgaaggcaggccccaggccgggtccctctccttgcctgtctgggggaccctggtgtcgggctcctttgatatctaaaaaccagaccctcggcccccagcgccggagcccggcgcagatccacgccctggtctctcagcgcgggggcctgggggcgggtgcggttcggggacaagagaccgcaagtgggggcgggcggcagcgtgtgagcagctcagatgggagatcacgcgcgataacccgggccctggatggcagcgctcgacaggaaacctcgagcgaggagccagctgggggccggcggggcggggctgctgctcccgtaaccgcacgggagccgcggctggcggcaacacggggctgggagcccaccttggctgcatggtgaggaagggccggaggttccttcccaggcccagcctcctctctgtcttgcggagggcgtccttcacgggtgtggtttgtgactttgggacggcggtcccggccgcctgggctttgggcgtagtgggagagctgcccagcccgcagtgcacccggcgtagctttgacccgggagggacccggccccaagccggacgcggggaggccagggcggagaggcggcgtgagcgcggcttagcaggctgaagctcgtctctttaaaatcccagcgaaatattcacctatagcgtatcggtgacggttttaaaatccaagtggcatttcctctcccagcctccgaaaaactcggtgcagtgggcagcggctcggcggggcgtccccctgtgccttgcgtccgggcgggcggcccgcagcgggaggagcccaggcgcgggcaccgaggggcggaggcctggccccggctcggggagctccgggaggagcttgggcttgggctagccgatggatgcacgggtttcttccggggaagctgcgggggccacagggactctgaggaggcgccctcaacagcctgggaccggcaggacggatcccagagcgagggcgaccagcgagcgaggcaggtgcggccctcctggctccccctccgcccctgtcctcccttgcgttgcccaggcagcctgagctcccaaggcccagagggtctccagcttacagttgcagtgggactgattcggtggatcggaaaagcgctttcatctcactcggctgctggtgaaagcatctcgtccttacagcactggataataataacaatagtgatcatgctatttaccagcagtagttggttttctgtgttcatatataaatgtaaccatattcaccaaataccattatcgtgaaagttctgtatagctgaggtccttccaaaccccggcaagtcatcaccagaaatgtactgagccagggctgggcgcaaagcgcttcgctaaatgggccagcccctgttcctccactttctgccctgccagaatcttgccgcacacaccttctttgatgtaagggttcatgttatttgtttttgttttggttgtttagtattataaatattatatactatcatagttagagttccaaacaccacaaaaaggtgtaaggtggaaaataagtgaaattcacccagcctccccctcccgtggctcctctgcagaagtaaccgtggatgacatttttgtgtgtgcggccctccagatatacatatatttttaacgtgttttttcttgtaaaataatataacattactattttcatttttaagtgtaattcagtgacatgaagtaagtacatttacattattgtacaatcatcagcactatccatttccagaacattttcaccatcccaaacagaaactccatctagatatatttttatgtatatatacatatatatgcagcttacatagtgtttttttcatacacaagtatctagagctttttttgtttttgtttttgtttttgaggcagggtctaactctgttgcccaggatggagggtagtggcatgatcacagctcacagcagcctccacctcttgggctcaggtgatcctccgacctaagcctccggaggagggggctggggctacaggtgtgtgccaccacacccagctaattttgttattgtcattatttgcagagacgggtcttgctatgtctcaaactcctgagctcgagaaatcctccagcttcagcctcccaaagtgctaggattacaggcatgagccactgcacctggccaccttttttaaaacctaattatcttgaagatctttcatggtagcacatgtagaattatctgttgtgttttttttaacggttatatatgaatacaccaaaatttatcaggttcctagttgatggacatttacattattttctctgtatactgtgagagtttatcctcagaaaaaattaaattctcagagaaatggcaaaatactgcctggaattttgacataaggggtttgctcgaaagtagatttttttgaaatggtgctaattttcaagagcaaaacttgagggcagtgtgctgcgtgagaaagaacaaaggcccggcaagacctggcttctcgtccaggctctgacacatgagctgtttgactgcgggagagtcacttcacctccctgaccttcagtctctttatctgcaaagtggagcaaataagatctacccggcttacctcactcaattgttgttaggatcaaatgaaataaaaaatataaaagggttttgtaaactgaaagtgtagagcaaatgtttggtatgacaatgattgttacagcatcagtccctggagtcagccagagaaagctacatgtccaagttggcaacaagaggtaagaataagtgtctttctctctgtatatctataatatatatatataatatatatctataatatatatatatgcacacacacacacatacacacacatattgctctctatgtatatatgtacatgcatacatatatgtttgtattgttctatttatgtgtgtgtatatacacatatgtatgcaagtgtgtgtgtgtatcttacactctatgtgcctggcatatagcaagtgttgtctgctaacctgagagacttgtccactggccttggggggctcttggtggaatgagcggagggaactgaaacatgcaacctgctcaccaaaggagatcacttgcctgtcattgtttactcccagagcgtgactgcaggcatcgtccctccctcatgtttccttagcaccctgtgcccctctctcgtgggatgatttgtttccttgcccacctctctgctcggctgggaggctacatctgtgtctgtcacctccaccctcactgcccagcacagtgcgtgacattttctcctagtaaggatggccaccacatgaccactcgtgaggcgccactccttggcttgtaggtggccatctctccctgtgtctttacatcatcttcacggcatcttccctctgtacatgtctgtgtcctaatctcatcttttttttttttttttttgatagagtcttgctccctcgcccaggctggagtgcagtggcacaatctcggctcactgcagcctccgcctcccgggttcaagggattctcctgcctcagcctcctgaagcctcatggtgtaccaccatgcccagctaattttttgtattttattagagatggtttttgttttgttttgttttgtttgagatggagtttcgctcttgttgcccaggctggagtgcaatggcgtgatctcggctcactgcaacctctgcctcccaagttcaagcaattctcctgccttagccttctgagtagctgggtttacaagtgcctgccaccacacctggctaatttttctgtattttcggtagagacggggtttagccatgttggccaggctagtctcaaacccctggcctcaggtgatccacccgcctccacctcccaaagtgctgggaatacaggcatgagccaccgcacccggccgagttggggttttaccatgttggtcaggctggtctcaaactcctgacctcaggttatctacccacctcagcctcccaaagtgctgggattacaggcgtgagccacctcgcccgacctaatcttgtcttcttacaaggacacgagtcatattggatcagggcccccactaatgacctcattttaacttagtgacctctttcaagaccttttcttcaagtacggtcacattctgaggtgttgggagttaggatttcaacataagaatttcagggggcaaaattcagcccataacagaaatggaggcttagggattattagtgttaatggatgaggaaggagcaaaagagtgaatgggtttcaccctttcaggacaaacaaccactttctgggtggtttatggggcaagagtaggaagagcttggttttgaggaccaggggaagaagagatgacaatgactatgtttggctgaatgcagacaggtaatggaggctggcagtatagcctggattttagggctgatttgaagcctgtcctggggcttgccggggcatctccagttagcccaggggcccaaggcaactgtgaaccttgccttgttccagttggctttaattttttctttgaaatgttattaccatattttaaataaaaacataatgtgtccttgtcaaaagagaaaaccctgcagctgttccccatctcattcagagtaaaagccactggccaaggaagttctacctaacaaccccacccgcttgtcgccctctttcctagtctcctagaacttcccctcattcatgctacctacccctgcttgcagttcagagacactgggcacaggtccaccacacagcctttccacctctgctcctctgcccggagtgcccttccccgacagatctgcacagctgaagcccgctctgaccacctgtgaaaaacaggagacatctctttgtcacttcatactttcatttccttggctagcactgagactgtcttttcttttcttttctttttttttttttttgagacagatgcttgctctgtcaccaggtgggattgcagtggctcgatctcagctcactgcaacctgtgcctcctgggttcaagcgattctcctccctcagcctcccgagtagctgggactacaggcacatgccaccatgcctgactaatttttgtatttttagtagagatggggttttaccatattggctagactggtctcgagctcctgacctagtgatctgcctgcctcggccttccaaagtgctgggattggcatgagccactgctcccagtatgtctttttatatgtttgtaagtaatctgtttttctgtctctgcgaattgcctatttatatcttttgctgatttatctcttggactattagtcttagctttcatttttcaaagtattattatttattcacttatttttttttgagacagggtctcactctgtcaaccaggctggagtgcagtgacacggtcagggctcactgcagttttgacctcctgggctcaagtgatcctcgcacctcagcctcctgagtagctgtgactaaggcatgcaccatcatgcccagctaattttttattttttgtagagggagggtcttgccatgttgcccaggctggtctctaactcctgggctcaagcagtcctgctagcttggcctcgccaagtgttgggattacaggcctgagccaccgcacctggcccatttttcaagctattattgatggaattccaatcctgtaaaaagctttaggaatgaagctgttcatcttagaattatttataatggtgaaaaattggaaacaaatgagcaccaatggggaatggttatgtagatagtggaaagcttattaggcaacctttaaaaaggatatttattaatagtaaaatgacaaagtaacatgaaatatgaatatatgaaataacatgaagtcttagattataacataatactaaatgaaaaaaacaattcttcaggaaatttttttttttttgagacagagtctcactttgtcacccaggctgacatgcaatgacgcaatcttggctcactgcagcctccacgtcccaagttcaagtgattctcctgcctcagcctcccaagtagctgggattataggcacgtgccaccatgcccggctaattttcatacttttagtagagagagggtttcaccatgttggccaggctggtctcaaactcctgacctcaggcgatctgcccacctcggcctcccaacgtactgggattacaggcgtgagccactgcacctgcccgtggaaagttgttatgtaaaatgattacagtttataaataacaaagactttggtcagccatctgccatcatattaataatggctgtgtttgaaagtggtattatgggcaattctgattttttcctacttttctgcacttttatattaagttgatttacttgaaaatgaaaagaaaaatgatcacaaaggctgggctcggtggctcacacctgtaatcccagcactttgggaggctgaggcgggtggattacctgaggtcaggagtttgagaacagcctggccaacatggtgaaaccccgtctctgctaaaaatacaaaaaattagccaggtgtggtggcaggtgcctgtaatcatggctgcctgggaggctgaggcaggagaatcgcttgaacctgggaggcggaggttacagtcagccaagatcatgtcactgcactccagcctgggcaacaaagcgagactctgtctcaaaaaaaaaaaaaaaaaaaaaaagaaaagaaaaatgatcacaaagtatcgctcaaaacataacaactttaatggaaataaaaatacaagaagagaaacatttgctcataaagcactacccctaagaaatcatacagccctgttcttccctcttcccttggaacccttatctatgggaatacataatttgtaggtagttttgaacaaatgatccaattttacaatgaaacatgaatatttgaaatctgacactgaggagagaattaaggaggctgtggtactttttaaaaaaatttttgtttatttatttttttagacagagtctcactctatggcccaggctggagtgcagtggtgctatctcaactcactgcaacctccacctcctgggttcaagcgattcttttgcctcagcgtcttgagtagctggtattacaggcgcccgccaccacacctagctaattttttgtatttttagtagagatgtggtttcaccctgttggccaggctggtagcaaattaaagaaagtagtaaaacattatatgttgccagtaaattagctggagtcgttctgcagttcagggtgattgaggtatctccagtgggtcattgctataagcactgggcagtgtgagtcctggcctcacatttggtagcaggccttctgtatctgtcaaccccccaggccggcctctcagccctcaatgaaagaaagctaattgtagagtcaagaatatgacctgctataatggttcgatcctgggagaagggactccacagcctggtgaggacccctctcaccacctctgaggatcagcaagtctttgaaggtcagtaccaagtggtggttaagacctggactgtggatccagatgtgcctggattcaaccctggctgtagacattaggcatgttattaacttctctgagcctcagtttccctagctgtgaaatcagagtcactgtgaagactgaatgagaaaactcacacgtgtggttcctggcccagaacaaatcttcaaccagtggttataactattactctgtgtgtctagcctatatcttttctgctgcagtgaaagttagttattcgatgaaagggagcaacccactgagggggatggtctgggtgcctggatgctgtggtcaatgggtcggcatcacacccagcaccctgcccaacacagacaccgcccccacccccccacccatagctgctgccactgccttcctaagaacagtgacttcctgttttctaagtttttaccctgcaatgtcatcaccagttgtgcctgagcctgggggtggagctggcagcagcaggactcagggctcaaagttggggactcaaaggaaggaaggttggcgagtagaaagctggccactcctacctggatcatgagctactgtgattcatattgattccatcagtgcctacaaactgagcgcttaccaggtaccaagcccttcccatttgagtgtcacacaccctgggaggtcgctgtgattactcagtgattacacagtagcaacaccaggacttggattgcagttgtcgccttcgtaggattcattcttacctgccgtgcttcctatcaaagtggaaacaagctggacgggggtgaggtttgaaaggctgccctatagaaattggaggatctgtgtgatttgtgcttctgaaggcagaactaggttcaaagttttttttttaactctgaaaattagagctctccaccagtgattgctgggtgctgagcttcctgtcaccagagatattcaagcagaggccagaagtgcctaccaaagaagaaactcctgaaagaggtgggaagctctctatatgacaggaaccccagaggcactgggataaggtagattgagaagggactttgcatcagatgcactcagaaaatctctagccatgtgacctattggagccgcaacgtcattatctgcaaaatagaattggtaataattctgcccgtattgtgcaaggttgttctgaggattaagccagatcatgcaagtgcaaagagctctctaaactgtatgcttcatgcatgtgttacatcattatcattttgtgaagtgaggagttctcagaaagtctacacactactgagctcccactgtgtgccaggcactttgtacacacccattatctctttttattttttttgagacggagtcccactctgttgtccaggctggagtgtagtggcgtaatctccgcttactgcaagctccacctcctgggttcacaccattctcctgcctcagcctcctgagcagctgggaccacaggtgcctgccaccacgcccggctaatttttttgtattttttagtagagacggggtttcaccatgttagccaggatggtctcgatctcctgacctcatgatccgcccgcctcggcctcccaaagtgctgggattataggcgtgagccaccgcgcctggcccccattatctgtttttatcttcaaacacccctgaagagtgggtatccccatcctgggctgggaaacctggccaggttctgtccccaaccgtggcatgatggggtgggaggtcagagggccatcccctgctgtcactccttgtacctgcagagcctcttagcatgcgccactgtgcagggcaccccacaaactttacctcatttctctgcacccgtgaaatcggtcttgtcaaagcccttctgcagataggagaattgacgctcagagaggttaagaaaactgttccaaaacaagccaataatggggcagattccacatttgagtcttagagtctttctgactcaaagacttattatgttctttgctcttctctaagcctgtgatgtgcgggtgaggagggaaaggtgcaaatgaaactataaggcaccatctgtgcttgccagagccagtggtggggggcggacttgaagtgaaacgtttacaagccgttgtgactaagtgtcaaaagtgggcaaaatggcaagggctgtgaaatcagaggtaggtggaaactccggatcctgagcccataggtcaggtgcatcgaagccataaggctaagagaagtacctggagtcaggagacccaggaattcccttccagctttgccactaacctgcaggtgtccttggtgaagttgcttcattcctctgatctcagtttatccacctgtgaattgggcccaaaagtagccccctgtttgtctcctggcactcataagaatctaactccatcagacacaggaagtcactttaaaagtagaaattagagttcaaatgagaagaatccttattagttggatgtgagtaagtcccgcagatgcccagctccgaaacaggatttgctggagaaggaggttgactgcaggggaaagggcaccagcgtgtattttcagcctcagggtatggcaggaccaggttgattaaggcctgatccctgttagcagaagttcatagtctggctcagagacagacagacaaacaacgcaattcaagtaaatctcacccagagaaaccagattctgtaaggataggtgcgtctcccccagggtgcactctggggctccagaatcttcctgttagtggtcagtaccatgagacttcctgaattcagggcttttttttaatgaagatgacaaaaggctacaaagggatggcgaggctcactgtcactaattagactcacaacacttagatacaatgacccgtatgcctagatactctgtgatcatctttggctgcccccagcctcctctgagcatctcacatggcctattcctgggatcttgctacagggcaggaaggttccaacttatcgtgcatgggcttaaagtagaaatcatggcagtaacaataggtggcaaaatggaacacatacccttatggggtccttcaccccataagaattattttattttatcctcaccccataagaagtatcatatttggccaggcacggtggctcatgcctgtaatccgagcactttgggaggccgaggcgggcagatcacttgaggtcaggagtttgagaccagcctgaccaacatggcaaaaccccatctctactaaaattacaaaaattagcagggcatcgtggtgtgcacctgtaatcccagccacttgggaggctgaggcaggagaatcacttgaacctgggaggcagaggttgcagtgagctgaggtcatgccattgcactccagcctgggcaacagagtgagactccacttaaaaaaaaaaaaaagtatcgtatttaaccctcaccaccatctaatgagacaggtagtgttgttatccccattttacagatgagaaaacgaaggcttagagaagttccataatacacagttcagaagtacagtgtataagaaggaccaaagctttaattttattgcatctgtttgacagaaatttacatttgttgtagggtatggctgcatctctacagaaggcagggcttccctctcacatgctgtggcccctgtaatgatgcaggtctgaatctcaatccattcatggccatgcagtgaagtccccatgcccaggttccactccaggccacttaagtcagagcctcaggggagagggcggtggattgagagtctgtgtgagaatgctctattagtctctggggctcctttcagatgctgaggttctcctgggtgctgtaatcttgggtagggatcaggaacattaaataaaacagcttctccacttttacagaaaagtagctaccatgtaataccctgaaacctcctaggaagcagctgctggtccctttgggatggaattggtagaaatacgaagaagccacaggagcgcgcacagggaagaagccaggaccaagtagagagtggcgatgcggtgcctttgagctggcatcctgcaaaactgtctgttgtccagggaagctcctacaccttgtgtgcggcctcaagagctaagacttaagccccatgagggcagggactcagaagactcgacccaaatatcagacatcattgtcttttgattctcatcacaacccttaaggtagatatgattaccctccatttaatagatgaggtaactgaggcccagagagggaagtgacttgtccaaaaccacacagctagtaagtggcaagagaagtactcgaacccacctgcacgcaatccagagttcattccatttcaatagttcccggcacagagcagatgcccaatgaatatttaattaattgcgtaactgaatcaggtcctgcatccctgcatggagctttctgggccatgactgtcttcctcaggcccatctctcccagcacaggcatagtgggaccgaggagaggagggtcctacacagggaattatgttggggttaatatcctctcctccacccaaccacacacagcacacttgtcatcagtcataaaactatgcagaaagaaaggaagaaggaaggagggaaggaagaaaggaaggaaacttgttcatattatttatctcagggacatgcccaatccccctgcccctttgtgttgtgctgagtctgcacaacacaaagaaatatttcttatttgtgctaaatttactgtccagtaatttttctgttctcattttctgtgacaagcagctgagtgattttctcctggattttcttctgagtctcaaccagtcccataaatcgccacggttatctcctctgcagtcctcacagcaaaaagtcaccccagctttggtggccttcatgggggctggcttgtcccccagaggcctttagatcgtccctaggtcagtgaggacttccagcaataccttggggccagagggcaggcacacctggggctgggcccagcatcttcctcatcactgaagttcagccctgaaaaattccatgatatcgagtgattgtctaccctgtgccctgcactctgatgctggggctggaggaagaggcaataatgaagatgcagccattggtctcaggtgctgacagcctagatggaggggcatctgagtcctgaggagttgggtttgtagagcgctttgggggatataggctcttgaaccgacatcctctcactttttcctcaggggctcaggtggtgggacagtctgatttcaacaggtgttgagtggaggggtagaacgcaagcctagaaaaagatctagctcagcaggccagggggtagaaaaatatgggtgttcaaggaagaatggggggaaaagacaagagcagagggacagggtggcacaaagctgtggtcttttcaggcctggactggttatggcagagccctaacatggctggacaaagagcttggactctcgtccgagtggctgggtcatcaatggtctctgggcagggtctgtgggaggtttgtagagatcagctgcctgggggcaagaggggtcctgaattagggttggagtcaaaagccaggggacagagggattcagggtggtgggggtggggacactggcggctgcctttgaatcatctgcttccatagttcgtcagggaggccaaaacgttgctggcatggaggggtaggcagggctggcccaggggcaggaagggggcgagaactgctagggatcagtcctgggctgcctgtgaccgtgtgctctgaacccgaatactcggtgcctcagtgtccgagtgtgggtggcaggaggatctgacgatgattacatttaaggcagtgtctgaagaaatgttagttttcaccctgttcaacagaagaggcagctgacagagcatacataacctgccccaaatcacacagccagaaagaatgacagcactcccacatatggcctccactccctctgccctcatctgggtccaaaggccaccagagggcgcccaggccttgggagacagacactagcggggctggcctgggacctctgctctagttaccaggcaggggtggagtgagatgggtaccacaccctgttttacaggttgagttgctgcacgtttacctagtaggaagtatggtcagactaaaatctgagtctcctcattcacagtgcaatgatgttccaaataaaaacactaactttttaaatttttttttgagacggagcctcactctgtgtgccaggctgaagtgcagtggcgtgatctcggctcactgcaacctctgcctcccaggttccagcgattctcctgcctcagcctccagagtggctgtgatcaaagctgccagccaccacgcccagctaattttcgtatttttagtagagatggggtttcaccacgttggccaggctggacttgaactcctgacctcaagtgatacacccatgtcagcctcccaaagtgctgggattacaggcgtgagccaccgcccccagcccaaaaatgcaaacttttatttaaccagagtatttagtgtatctgcattcttcagcccattgtactccaatggcagtgccaactaaacgtgcattaactacagcttgacaaaggttaatatggcactaggagttaggggcccctgggaaatttgcagtgggagaagctaacacagaagggatctttgagctgcattttgtaggatgcatcaaatgttaccaaatagtagggtttcagggagagaaatggagggaacatgaagagggaacagagagtgcaaggcacagggcaaatagtctggaagagcaaggcgtgtcctgggaatggggtgtgtgtagtgggaggaggggagacagagaaggctgaggccatggagctgggactaggggacagggagatgctgggcctaggtggggaggggcaccaaaggtacctctgtctgttggccatgaaacccttcagggaacagggaagggaagccgagcaccagatcccactgtcctaggcgggagagtgcttggcactgaggaggcagggagttgggggagagttaacccagattctctctgtcctagttaactgtcagatattgaaatgatctcatttgaccatcatttgacctattgtctccctgtgggtaggcctcagagccacacacctcaggccaggagtaccattcatccagacgtgaacatcttcccgaggcttccagagttcttggttcacaccggggctaacatggctgggcttctgctgcagtggcaggagctctgtgcacagagaacagcctcatctgctcgccttgtttccacctcccctcccattgccccaggttctttggccccacagcggccacatctgccgttggtgccaataggttttccaggagctggttgaggtgggagggagggagagggttgtgatcaggctgaggcatggggattggatatagtctccgtgtcatgatttatttggtcagtcagtcctagtgccaccctggggtaatggggatgtgttctcgtcaccttgggcctggctgaccagctttatctcttggcacagaggcacagagctttggcctgctggatcccaaactctgctacctgctggatggaatcctcttcatctatggtgtcattctcactgccttgttcctgagagtgaaggtgggtaccactgggctttgggaggagggcacggggtcccccacttgatggatgttcagaggggccttggtcttggaaggtctcaagctcgggtggtgcctggggcttggtatccaggagcaaagcaaggaccagccaagtgtgtgccttgagtgggctgaggaggaggtggcagtgtctggctgagatggacagggtaggagggagagcctggtgctaggcacctccatgacaagccgtacaaatgtgtgcacatcagagtgtcccagggaaggcgatgctactggtgacaaaggggcttacactcaggcagaggtccttctttccaagtgtgaatgaaggccatgttagcctttctcttgaaaaggccctttcctcatctgtaactggggagctgaccagagcgtgggtttttcacttggtgccttgcagaccctggatttcttcgtggggctggtcatggtgtgggcagagattggaagaatttaggagtaaaggggagaatccagtcccagtcatcacttcagtgcttctcaacccatttcttgtttgaattttggactttggcataatattttatttgaaaaaccaaatcttactgagtttcttgttttaagtttgaaaatgctgccctagatgatttctaaggttgtttccaatgctctagatctgtaagacattgcagtttctcccgcctgaagcggcatgaagtgaagcaggagtgaggctgtgtcagcttcccacagatgctcaggacactaagcgaacgcgaggcttcctgggcaccggggcagccgggcgatggctgagggctgggcgagtgatgcacgtacagtacactgctccgggggtcaagataggaggcgggatcttgaccagccgccatccaccctggattgtcctcagagtccccggaggaagggatcctagagaatactcatgtccccgggggcgcagaccaagaaccttatacctctgcgcacgcgcgagggcgctagcccgggaagaataaactccagcgggtcctgggccagcgtgatgaatgcacgtgtcacaggcgggaggaaaaaggacaactgggctcagaaaaaggggctgccacgccccggcccctgcaagggctcagccccaggaggcagggcagcattgttagttgccaaggagcggagtagggctgtccctcgggtcgccgcgcgccctggcaccccggctcccctgcgcgccctcgcggagcagtaacgcgctttgctttctgtgttgcagttcagcaggagcgcagacgcccccgcgtaccagcagggccagaaccagctctataacgtaagtcagcctcgccgtagaccctccggaaaggaagggcagcctcctcctcggacctagggaacgcgcccgccagagtcttgggtttaggtttggtccctagctatcacctctgcgacccggctgcaacttgtttaacctcagttttctaacccacaaaacaggtgtagtaattgtacctgtctcaaagggcgccataaagattacatgctttaatgtcttgatgcatggaacgagcttagtctagtgcctgccactagtgagcccccaagccatcagcaatttgcaaaggctagaggggggtggagaaggaatgtattagaatcttcccagaggaggggaaagcgatttcacactccctgtgcaatgggactgtggtgaaattgactaccacctctgagcccccacttctctatttgctcatgagaatgttgatccttatcccgttggactgatcagcctatagtacttggtgacctttggggatcccatccactgtcatgttaatgcgtgttctctgagatgtcctctgggatgatggtctccagatggaccagttaccatcccctccccagcccctgcccctctttttatgagccaccccagagagggaaaccacactccccagtccagctggctccatccttctgaggttcctccgtcctgtgtctgacactttcttatctgttataggagctcaatctaggacgaagagaggagtacgatgttttggacaagagacgtggccgggaccctgagatggggggaaagccggtaggggttcctctaccttcctgtgtgttcctgcatgtgtggtggggctcagcccaggctgtgggggagggctcctcagctcactctgcaaccagactcgaccctcacatgtgtgggcccgggacaagagaagagatggagacccacttgctgccgcaccctcttccttcctccttggctccattctgcatctcaaggggcctcacccccggacgtggcaccccactgctcatgtctaagctctacccacttcccctcaaactgctccttggccatcctgagatgcacacacggtgacgccatctgccccaagaggacagacctggtgaagaggtccatacaggaagggcccaagacccctggataacccacatatggtcggggtatggtccctggggggtttgacctcttggctttgtagacactatacctgtgggtatacctgtgggtaggggagcagctggatgacaccacagtagggtagggtcctctttgttttttccccttcattctgatttccttccttccttccttccttccttcctctgtctttatttattttatattgacaaattatagttctacatatttatggggtacaaagtattgttatgatttttgaatataatatgaaatgattaaattaagctaattaacatatttatcacttcaaatctttaacttttttgtgatgagaacattagcaacttactcttagagatattaaaatgtatagtactcacatattaactatattcagcatgttgtgctgttgatctaaaaataaattactcttcctatctaattgaggctttgtaccctgtgactatcatctccccattccccccattccccagcctctggtaaacatcatgctacctgtccatgcttcagtgagttaaactgttttagattccacatataggtgagaacatggagtgtttgtctttctgtgcctggctgatttcacttggcataatggtctctagttccatccatgttagagtgaataacagaatttcttcctttttaaaagctgaatagtattctattgtgtgtatgttccacagtctctttatctgttcattctttgatggacacttaggttgattccataacttggttattggtttcttttgttttgttttcttttttttttttgagacagcgtttagcttttgttgcccaggctggggtgcaacggcacagtctcggctcaccacaacctctgcctctagggttcaagcaattctcctgcctcagcctcccgagtagctgggattacaggcaagcgccaccacgcttggctaattttgtagtttttttagtagagacggggtttctccatgttgatcaggctggtctcgaactttcgacctcaagtgatctgcccgcctcagccaaccaaagtgctgcgattccaggcgtgagccaccacacccagccttggttattgttaataggactacaatctggaatcacaggtgtaagcccccgcgcccagccgtggttattgttaatagtgctacaatcaacatgggagtatagacatttcttcaacaagcagacttcaaatcttttgggtaaatacccagaagcgggattgttgggtcatatggtagttctatttttagttttttgtggagcctcaatactgttttccataatggttgtattaatttacattcccaccaagagtgttcaagggtttccttttctctccatccttgccaactattgttgtcttttgtctttttggtaatgcgcaccctaacaagtgtgaggtgatctcattgtggttttactttttatctccctaatggttagtgatgttaagcattttttcatatgtctcttagccatttatatgtcttcttttgagaaatatctattcatctatgatttattatggaagttttacagtttcaggccttatgtttaagtctttaatccattttcagttgatttttgtatacggtgtgagataaggtccaatttcattattttgcttgtggatatccaggttttccaacaccgtttattgaagagaccattcatttcccattgtatattcttggcaccttttgctaattgctcggctgggacctatgttactatgttgaatagaagtagtgagtgtgggcatctttgtcttgtttcagatcttagaagaaagggaggaaaggcttcagcttttccctgctgagtgtggtgttagctgtggattggtcatatgtggcctttattgtgtggaggcacattccttctatacctaatttgttgagagtttttagcatgaaaggatgttaaattttgtcaaatgcttttcctgcatctagtgagatgatcatgatttttgttcttcattctgttaatgtggtgtatcatgtttattgatttcgtttgttgaaccatccttgcatcccagggattaatcccacttgatcacactgaatgatccttttaatgtgttgttaaatttgacttgttagggtccttttaagcacagggctcaggacaaaggccagggctgtcctggtgtaagggcagtgctgccagatgctgccagtggtcacgcctgtccatccagcccctgtccaggctgatccctgtgctggttgtgttgttgctagagtgaatgggcagtagagaggctgtcgatttcattgaccactcctcacccccaccatccaagtttatcttgcctcctctcctcttgtcaggactaggagggtgtggggagggcacctttcagtaggcactcactaccagtggctggccctgctccaaatgatggtatgtgactccttttgtcttcagccaaaagtcccacttgtcagcttgtgatgtgtgtgggcgtcccgatggcctgccctgggcaatgctgggcttgggtgggcccctctggaagagcgaagtgtgtatccagttgcaggtaaccaagtatgagccatgtagtgccatgagggccccaacagtggcctaggcaaggctggggtagcacagggaggagagaggcagacggcagagccccaggaaactgcagtcagggggcaggatggggtttgctgtactttcatggcttgggtttgtgtttctctccctctaacgtcttcccgttgtctttcctagcagagaaggaagaaccctcaggaaggcctgtacaatgtgagtagaggagacctcacatttgaccttggaaagttggaggaagggctggaggagggctccagaggaagggctggaggaagggctggaggagggctccagaggaagggctggaggaaggcctggaggagggctccggaggaagggctggaggaagggctggaggagggctccggaggaagggctggaggaagggctggaggagggctccggaggaagggctggaggaagggctggaggagggctccggaggaagggctggaggaagggctggaggagggctccggaggaagggctggaggaagggctggaggagggctccggaggagggctggaggaagggctggaggagggctccggaggaagggctggaggaagggctggaggagggctccagaggaaggcggttgctcctcactctgtggtctttgtctgtccagaccttcccttcttggattgagtaatgtctcacctgcttgcggcctgcagcagcacctgcttctagaaagtctccttagctgaaaagtgccgagtaatctcccttccctccccaaaccctgctgctggagttcccaggttgatcagcctggggtgtagggggacacagcaaggtcaagctaggcaaggacgaggtggctggccccttcgaggggctcctgtcctgggtgctgaagtcttctgagtgtcccccgctataggaaggtcaacctcaccctcctgggtgtgaccctgaaccctgattgtcgatctgggttgccatgcaggagacccttgcaggtggcagccttctgtgaaggagatgcctccccgcccctcctgtggggagggagggttgatctacagcccgtttggctgtgtaaagagacaacttgctcagataaatgattctggggctccaggtgagcccttgctttgcccagtctccgtgtctttgtctagaactccacctcctatctttttgagcctaacttgagcccctcagctcagtgcaaagagctggcagctcggaggagactccaaagggctgaggacgaggggggtgggctggagctggttgtgggcagagaagtttgtgtgcataaggtttggagccttgattgtgggagccctccctgtctgccactgctgccaacttggggatcaagaagcttcctgttgtaggggaacctgctgctttctgcattagttggtaaaaatcagtgttccacgccctcttctgcaggaactgcagaaagataagatggcggaggcctacagtgagattgggatgaaaggcgaggtgagtgttgctgtttcttaatttccgagggagttcctcttggtcctccagacacgcctgctgcaggcctcctttcccatccacttctcatcccagctgcaaatgcccatgtggtggccatcagaggtgaaggcgaacctggctgtcacccagccgggcagaacataagaaactaaggaagggctgatgctctttcagtacagaaaaccacatctagattctatgacagcctaagctttgcaaaagcaggtccgttttaataacaggaagcatcgagtgcttaatatgtgctgccgtgttcagtgctcaggaccacaggtcccaggacaacatgaaaacaattcatcaacaattaagaattgttcatcaacaattaattgttcatcaacaattaagaatttcaaaatggtgagagtgaagcattgaccccttccaagcaggggttctctgtagttttatttaattcccacaacaacccaatgagaaacatgtgccctgcaaggcacaaggaggttgagtgacttacccaaggtcttctagctggtaaacgggcacgtgattgaactgactatgccagagctcgtaactgctcaaaacagctggttgtcagtgagcaaaaatgactagccaagaactttaagagctgaagggaagcccatttatctaagcagtaggcaatataggtcctgcgggccctagaccttaggaatctgatgtctgtgaggatctgagtggggtggagcaaacccaagccccatcatggccaggcctcaccttactctgcagagatgaaggtctgaccaggggcctgaggatccttctctcccaggggcaggggtgctgctgggagacagttacctctgacttcctgggtaccttgggaggggcccttgagcagaaatgccactactgactgcctgactttctaatccttttctcatttcactcccaaacaaccagcgccggaggggcaaggggcacgatggcctttaccaggtaggagctgccggcgtcccttcagtggaaggggcaccacctgacaaggggcaagatcaaggcccccacattttgcctgctggtggcaccagctcttgccaacagctgggcagggcaagcccaaggcacccatttaggccagtggcaacgccactgccaataagtccctggagcacagctgggacttggccattcaagcgaattacttggctccaaccatgccttgcttggccatggcagacagagcagcagctgtccagagggtacgcagcctccccgccgatgcagatggaggcaaaggaccacacaagtgattatcctgcctctttgggttcttgtagaaccctcactctgcatcatttccttaggcctagtaagatgagaggttggctgggaagactgaaggaaaaaaagctaagaaaaatggcagcttcaaaaagaaaatgttatgtagttaggtgcctggtttttgcaaatcagtgcaggcaattatgcaaactaagcacggtcaaactacttctctaaaacatgatccccagcgggttgtcatttccctccttctggctcccatgggctgttcatagctcgttcttctgactctagtgtcaggatgcccagcttgcctgagttgagtgatatcaaaagggccccagaaacttacctgtgtgtggctgctgttgatccttctccttcctggcccccggaccagggggacaggcattccagcaggtttggggccagccttgtgggcctgttcgtgaccaagaaaacactagaatcactgggcctgggaagggaaggaggctcacagagggctgaggccaaggagcccctcttctccctgtgacaagtccaggcttcctttgggcccaggtgtcagggacagcagattctctggagcaggcctgggccctcccccctgattcctgcccaatatgggaggtgggagactcctttctcttaggtccagcaggaagttggcggggcccaagcactgtaaggcacagcatttgaggagctgagaagaggggtgagaatttagctggaaaggagttgctgcaaggccattcccggcagggcacagcacccatctaccaacgaagctgttgcagccaaggctcctgcccgtggggccagggggattattcctgggcctctggaggctgggtgggtggtcacagggctgtgctgcagagacacctgttggcctctgggttggctcctgcccacacaggctactgacccactctttgttttctgatttgctttcacgccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctggccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacagtgtggttacacagtgtgaataaagtgctgcggagcaagaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctgctctgctttttttctactgttttaatttatactggcatgctaaagccttcctattttgcataataaatgcttcagtgaaaatgcagctttactctaagctttatttcagcagtcaagcttgtaatggcaatttagtcatcagtaaatcagcaggttgcccttgggggaggaggggagcaaaactgctgattctcaggagagaacaggacagttcctgggaacgagcacatgagcacaggtgcatcctgcggcccggaatgcggcaatatgggtggtgtcacacacggcaagtgggccgggcatcccggctgggtggctgtgccttagacagagagagtggggcttggtgcaatacaatgtgtcaggatgggcccagtcttatgccagaaacagagagggctatgggaaaggagccctgcagcacggcaccagcttgtcaggtgcaggaaaacaagcgcgaaaggctggcctggcacccaggcatcagaatagacagcgtgtgagcagaaggtgtccggaagttatgcacagcagctgacgccacagtgcaaaatgtctcagtgcatagggtttgagggagggatggagaacaagtcttttaggcgtttctctcacaaaaggtggccctgtccctagcagtatttcctctaactgcagtggctatatataaggccccaattcaacaagcccaccaactaatattgtgtaaagactgaaatctataccttgacattttcaaaaaggaaatccaagaccatgactgttaaagcccctgaaaatttgggattccaacaggagccacgcacatcatcactaggcatatttaacaattcacaggcaactcataaggagaaggcatttgatttgtaactcagcctcaggggaattctgctactcactgggcttttaaaactgaaatctggttcatctattagtgaaagagagtgcctctcacatcgagggcttgtgctagaccaagtttcaaggtcagctgacatatatacaggctgtgtgacctggatggctggtttgaaaagtgagttgatccaattctgtcaagaatatgtcattctgggcatggtggctcatgcctgtaatcccagcattttgtgaggctgaggcaggagaatcctttgagcccaggagtttgagaccagcctgggcaacacaggaggaccccgtctctacaaaaaaatacagctgggcatggcggcatgtgcctgtgttcctcgctacttgggatgctgaagctagaggatcgcttgagcacaggaggtcaaggctgcagtgagccgaaatccagcctgggtaacagaaggagaccctatctcaaaatatatatatatatatataatttttttataacatgtctaaagaggcaaaaagaaaagctggcagtgggcagtgagctatggtgctagagctaaactgaggtgtgggccacatcaggctacgtgcaaggtaaccacacagacagcaagctgggggagaactgagatatgctcacagaagcagggctgagaaaccagtttctgagagagcaaagccctgaatccgaggggagagcggctagccctggaactgccagggttcctgtctttcctgaggtctggcaatgccttctccacagcacaactgcactccctccatcctaagacactgttggttactgatgtatcaacttatttcaagggcaaaaacactaaatatccattgtaagatgtaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggttaaaatgtgaagatatgcttagaatcaaggaaacatg

SEQ ID NO: 11856 - DNA, 13598 bp, Human
attataaaagtaatatatgtttgttgtagaaagtacagagaagtataatttataccataccaacagagattctctaagcacaaaggcaggggttcctctaatttttgtattctgtttgttattttaaggagaatttcaacagggatggagacttaaatataatttgtttgtatatacatagagtgtctgcagaaacacaagtaagaaactggaaacattgcttctgagtagaataattgaggaaatggggaagataagtcaggtgttaaaggcactgacttttgtattatttatgtagccacatcactaaaaaaattaaaaaacagtacgtaaactttaaaaacacaataaacattttcataagaattccctaatattcataattcttatatagaaatgtgaaataaaaataaaatccactatgaaatcataagccaaacaaaaataatttaataagagcatcctagaaacattgtttctatgtaatcattcagataaaaaagaaataaaaggatgtaaagaaggcacaaataaaagagaaagaatagaacaaagaagagtgaaatgcctagatggaaagattttcaaaataagtctgctacattgaaaatatactgccagttggttgatatttaaatgtagaaattcttgaataatggtggcatcaatcatcactaggaaggcccggcacggtggctcatgcctgtgatcccagcacttttggaagccgaggtgggtggatcacttgaggtcaggggttaaaccagcctggccaacatggtgaaactcctgtctctaccaaaaatacaaaaattagccaggcattatggcgcacacctgtagtcccagctactcggaggctgaggcaggagaagtgcttgaacccgggaggtgtagactgcagtgagattgtgccactgcactccagcttgggagacagagcgagattccgtctcccccactcgtcccccaaaaaggagcatcactaagaaaaggtgaatggttgggatgcatactggaaggaaacaacggaaatctgaaaaggtgtaagaacctaaacaaatttgtttatcacagaaaataaatcacaaaacaactttgcgttctttggcaagtttctttatgttaaacaagaattgctttttgcatcacatagatcttctaaactctttgttgaagaggtccttggtagtctgtatctaagccagttccttacggaagtggcactgagcggagtagataaagataggaacttttgaagggtcataatctctgtgtgcaaaaaagaagccacagtagtctgaagagctgtgcaggttttagggtgacactgggttgggaaccttggagctaagtgtcccacacctggcaagccatgacatacatattttctgttcaggcagaaactgagctttacaaaagtgaaatgagaaaaaaaaaaaaaccaaaaaccaggcacgtatattgagaaccattcagtccttcttagaattgcctcatacctttctcatgcatctttattaaattcagatgcaaattaattttagaaaagtctaaataggtgtgtgttttatttttctgtttcctaattaaatagtggtataagcctggaaatgctctatatctattttcggaaatctatagctcttgtttaggtaaatatcaggtacttagctaattaaatgtctcttgtttataggaaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgagaactcataagacgaagctaaaatccctcttcggatccacagtcaaccgccctgaacacatcctgcaaaaagcccagagaaaggtaatatgaatgaaataattttgggggactttaattgaggagtaagatatttgagaatatgaggaagattccaaagtctctgcatataccttaataagaactgagacaggcttttactcattctcttttcagcacttatgattgaattagaaggaagtctgtaaaatttggctgtgatcatagggtaagatgttatctaacagaagccagaaacccaatgtctcctgctgagatgcttgagtgcctgtcaggatctaaaaattttcctcaagaattactgtatgtcattggaaagacgttcttttgagtggcttccaggagccagacagagggcaagtagacattatgatattgttttattatccatttttaagtgatgtatagctatatcttcaagctggcccatgataaagtggttcacttgttcagctgaatgactatagcttctgattatcttttgaatagatgttctcatgcagacttgaatagtagcatggaatttcttgaatgtcgttgttttcatttttcttctttaataaaatgctacaaaaatcaaagttggtagtatttctctagctattattcatgaatttgcaatgataagtcacttgcccaagtctaattgattagttccaatgagtttctggaaacttttttgcagctaaccttggttatcttagcattagcattaattggtggctgattgggaaatagacactagaaaataaaagaccttttttgtccctccttattagcgttgaagaataggctatgggcacgtgtgaagaactatgggctgacactatatgggtcccttaggaatgcagaagctccctttcatctctgtagatattttgtttcttaagctcttcaatctttttcccagtcaaaagtcagatattttgctttagaaaaggaatcttttaaagtttctgaaaatatcttttaaataattacttgacttaataccaattcaattattcataatattggtcaaccaaattgcatgtaatacattgctatattcttgaattatttaaaaaagacaagagtggtcatcatttataaaaggttcgtggtttttcatgttaatttcaactttggttttcttaagtttattattttttttgcagtaagagtcattgaaattttaagtgagtcatattccttaccatttcctgctgaaaagggtagtgtgtgagaaaaatgttagaaaagcaattaattatgttccagagcagattttcagttgcagtgtacatttctttttaatgtgagacccaaatttacatgaaaactcaaagtaagagctgggtaacagaaatggctaacttagaaggtaatgtacgtcttgcttaaaagcacatcaaagtaatctactttctcaaagagaaaatttacaggagtgaacttacatttcttttgagaacagcatggttcatagcaccaaacttcatttttacaggttgtgaatcctagagtagtttgctatcaacttctgatctttgcacattctggatttggcatataatgttacagcagtgccattgtaatgttgcacaaagtagtctagcaatttcttggttcaccaggcttagagataacattgtagaaatgatccagcatctttaacactctgtggtttaaggtggggcacttaggggtagaatcaataacaatgttagaaatcaaattagacaagataactgaaacagcatgatccatgtgtgactccaagttataaaggaggacatggattaatggtatacttctaggctataggggtagtacaagtggaaggacaccatcttagcatcagatcactttctgagcaactttggcaaatcttttaaattctctaatgtgtagttttttaatatatgacacaggtgtaaagaaaataaagcaagtgaatgtatgtgaaagccaatgctgactgggcacgggggctcacgcctgaaattctagcactttgggaggcagagccggggatatcacttgagcccaggagttgaagatcagcctgggcaacatagagaaaccctgtctctacaaacaaaacaaaacaaaaaaacaaacacaaaaaaccactcccaaattagccgggcttgctggcacactcctgttgtcccagttacccgggaggctaagatgggaggatcacctgagcttgggaagttgagactgtaatgagccgtgatagtggcactacactccagcctgatccacagagtgagaccatgtctcaaaaaaaaaaaaaaaaaaaaaagaaagctaatgctttttcccctttccctgttcccctgctgttccccactgcagacagtccttatagcttgatcagtttaaaatacctgaacttgctctcttttcttttcttttttcttttctctctctctttctttcttttcctctcctctcccctcttcccctctcctctcctctcctcttcttttctttttctttctttctctctctctctcttttttgttttcaagacagggtttctcactgtctcccaggctggagtacagtggctcgatcccagttcactgcagcctcattcactcaggctccagtgatcctcccacctcggcttctaagagatgggaagcaggaactgccaggtcagttaagggatatacctactacttgcccagtgtcactactgctatattcctgatctaagcagtcaagggcctatgtagatgaaatggggtacaaagataaaaatacaaagacagacataccactgtttgacgtgggagtgacaaggtcacactgcaaataaatgtaggctgaggggtatttttgtggccatttttggaaagtacaatctgccatagcagtaaacacaggggcaatgaacaaggggcttcactttgcagctcctctgctctgtttttattaccaaaaaaaaaaatccttttaaagtaagatgcctagacaacatagtgagatgcccacttcttttcttttctttctttctttctttttgagacggagtctctctgttgcccagggtagagtgcagtggcgcaatctcggctcactgccgcttccacctctcgagatcccatttctaatttaaataaaaagaaagaaagtttctttgtggatgaagagatagacgtgtacataactggttagactgtggggcatcatctaagaattataagccaagtgataggtgagtgcagtggagaaagatatttattttgtctttggggttgggtgaaaacttcacagtgaatctggctgttgaacagctccttaaaagactctgaagtagatgaactgaaaagggagagaaagaaggccaagttgagaaaactcatgttttcttggacacatattatcttgatgtggtgggtgatgggatataagggtatgttggtgtgtattgcaggttagtctgaggttgtgtgtacagggcctttgaagttcggaaaatactcatgtgaaataccaaaagaagctgagattagtaaatctgactttagattgagcatatttttgcaaaatagcataaatcctagcagaatttaatttctccccctgattcttaatattttcttttgaattttaaaacagaaaaacctgagggtgattaggatgataaaaatatttattaaaatgctttcaaaatcacctagaatttgaaggctattctgtttttacttggttaatgtcatctcttttcaaaatacaggcaaagaaaggtaatagttctgctacagcaatagtgatttttgtttcactttttcaatcttcttttcactttattataaaggcaattctaaaatgcgcattgacttcatgctttcacattctcaaatcttattataaatgtttctctctgaattaattctgatatagttgttcactgcataatggctgaattttcataatatatgagctgcaatattaaggcacaaacatgatactagtttaaaaaggaaactagttttaattctgaacatttccttatggctttgtgtattctcaaacttactgatctcagaacctgtttacactcttaaaaattattgaagagcccaggctggtcatggtggctcacgcctgtaatcccagcactttgggaggccgaggcaggtggatcacgaggtcaggagtttgagaccagcctggccaatatgctgaaaccccgtctctactaaaaatacaaaaaaaaaaaaaaaattagccaagcgtggtggcgtgtgcctgtagtcccagctattcgggaggctgaggcaggagaattgcttgaacccaggaggtggaggttgcagtgagccaagactgcatgactgcattccatcctggacaatagagggagactcaatctcaaaaaaaaaaaaaaaaaaaaaattattgaagagcccaaagagcttctattcatgagtttatatccattaatatttaatggcttagtgattatgctaaagtttaaaaatatttattcatttagaaaaatccatcatatgttaacacatataacatatatttattttttaaaaatgacaattttcaaaaaaaaattagtgatgagtggcattgttttacccttttgcaaaactcttcatcgtctggcctaacagaacatagctaaattctcatgtgctttttcattcaatctgttgtaaaattacatgtcatgtagcctctagaaaatttctctgaacacccaagaggatgaagaggaaaaaaagacaaacaacattttagtattattatgaaaatcattttaaccccacagatccactgaaaatctttggggttcccagatcacactttgagaaccactgacttagaacaatatttattcagtgttaattatgtgtgaagataaatagaactcaaaattacttacatataaatatatatattaggtagaaataatgacataggtttgttttagccttcatacttacacaatctgaatttctatacaggttgagtatcctttatctgaaatgctgaggatgaaaggtgttttagattttaattttttttggatattggaatatttgcatacacatagtgagatatcttggggatgagacccatgtctaaacataaaattcatttgtttcatatacacatagcctgaaggtaattttatatactattttaaatattttgtgcataaacaaagtttctgttaagtacttatatgtggaaatttccacttgtgtaatcatgttggtgctcaaaatgtttcagattgtgggccatttcagatttcagatgttcagaatagatatactcaacatgtgttataaacttagttctgctgtctgataaattattcctaagaagtattatgggttaatataaacatctagcagaaactcagccctattatgtcagtctacatgaaaaataaccataagttttgactcatatgtacctttaaacctcattctgaatttttttaaaaaaacttttattttgaataattgcagatttagaggaagttgcaaaaaatgtacagagaagtcctgtatatccttcagcttgttccctcattgaaaattatcttgtataactatagtacaaggtgaatactagagaactgacattgctgccgcctatacagcttattcagatttaagacacacacacacacataatactagtgctctgttatgcagttttatcccatgtgtagattagtgtgactaacatccctatcaacatgcggctgtcccatcaccacagctcccttgtgctatccctttagagccatactcaccctcatacacttctttcccagtgctaactctttgaaaccattaatctattctctatctctataattttgttatttccacagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggtaagtacatgtttagttttatcagaaactgccaaagtatttcccagagtggctgtaccattttgtattcccaccagaccagcaatgcctgagttatctggattctctgcatccatgccagtatttggtgttattttttattttagccattctgatagatatgtaatatgtcattgtagttttaatttgcatttccttaatggctgataatgttgaatactttgtgtttatcctccatcaaatgattgtatattttatatctcatatataagtttatatatattttcttaggtattatctagtttaagttccatgttttacaaataaggacattgaggcttcttaacaggatgacagataatttaaaatttaaattttaaagaatttaaaaagagaattttttgtaattattattaaaccaatttctacagttaatgtgagaaatgggaagattcagttatctatctctttcctaaggagaactttttttaaaaaaaattacatggttttagtatatgttgggagctaaaagcagggaggtcaagacactgatgactattattaatagtaatgttgaaactactggttgttgttatgactggtaagccaattttagattaactgttttttttttttttttttgccatgtctgtctgcaggagcgccatggattactacagaaaatatgcagctatctttctggtcacattgtcggtgtttctgcatgttctccattccgctcctgatgtgcagggtgcgtgaccaaatttgtggttcaagtaataaggacaacacacatttctagatgtacatcaataactccattaattacatttctaccaccttttcaaaagtaataagtctttgctgctggattcatatctaggcacttgtagattgtgaacataaaattaaattaggttcagaaaatgtgcagtgaaaatgatatcttacacaaccatttatgcagcagcctatacattttcatcggaaatagattcctttttattcttgagtcttacaagaagaaaatgctccttattcagttagctcagttattttttacatttctcccggcagatttgagattttaacattgcctttgtagatgaattttcacatcagttaacaagtgagaaaaacaaaaccattttatacagtaaatttgttttgctgtattgtctgaaaaatctcatatagtagctggtataattccttctgctttgaaattgtgagctactattggttatggtttttctctatataagtggtaatattttaatccaggtcccaagtgcaggcgcctgatctaatatcaggctctctacactcaccaagctttcttaattctgacatatttctctctgtcaatatttggagttactgtgggaaaaacaatagcagattctaaagggaaaaatatttttcctctgtgcaaaattctcttttcagatgaacatgatgttttcatctgtcaagttttgtgtttcctctaggcatactgttagcattgggatagagaatccatgcttgaagagagactacaactgagattttctatgcatatctgtaaaaaatgtttgtttttaagttttatttcccatgaacattaatcagtataaatattaaatagatattatagatgaagattaacatataaccaaaaagcacttacttagtttcctttcatttttgatggaaaaataatattcactatcccataataaggaagcattcacagtttcttttctttgttgccttgccttgtcttgccttgccttttcttttgagacagagtctcgttctatcacccaggctggagtgcaatcgtgtgatctcagcttactgcaacctccgccttccgggttctagtgattcttctgcctcagccttctgagtagctggtattacaggcacctgccaccatgcccagcgaaatttttgtatttttagtagagatggggtttcaccatgttggccaggctggtctcgaattcctaacctctggtgatccacctgcctcagcctcccaaagtgctcggattacaggcgtgagccaccacattttttcttatttttttgagtcagggtctcactttgtcacccaggctggagtgcagtggcatgatctcggctcactgtagcctcgacctcccagcttcaagcgattcttctgccccagaccctcaagcagctgggactacaggtgtgcaccatcacgtctggctaatttttgttgttgttgtattttttgtagagacagggtttcaccatgttgcccaggctgctctcaaactcctgagctcaagcaatccacccactaaggcctcccaaagtgctaggattacaggcgtgagctactgtgctggcctcatagattctttttgagtcttttttggatattttactctgcctttttttttccctgatagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtaagaacctcaagatccccagaagctttctaacagcccaatcagagaaatgttcatagagcccacccatggaatttaatgccaaaggtgtctaatgacccagcatctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaatattcttcaattttgtctctatctatctatctatcatctaatctataatatgtttttttttccttcccctttaggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcccacagtacaatcagcagtctagttcttttcatttggaatgaatacagcatttagcttgttccactgcaaataaagccttttaaatcatcattcaatcactgaattatcatttttcttcaaagtaaagccagttgctttggacagcattaatggaagagagtgggccattgggtgagttggggccaaatgtgtttggtgacctgacattggagagccttgctgttaccacacctagcagcgtgtgagtcctttcagccagtgggctacttataagacatttattagggcaagagaagaaaatataagaacttctatttatattaatttttatataactttttaagtttccattttgatggattttataaaagcacagatacattagtatggtaatacatgtatacaatttataaatcaataattatccatatattgggaacatttgatcagaaactttttactgttagaaggggacaataaaaaacaaacaaacaaaagaaaaagaaaagggagaacacttctctaggatttgggaaagacaaaattattcccagactgaagtttctatttacttgctttatgcctggctgaaaaacgctcatcttattagtccctggcagccaggctataattgaatagaggccaaggaaagggcatcattgcaccaattgaaactgggcattactctgaaataccagaggcatcagattttgttcttcacattcagatccggctcagaactatggtctaggtcagatgcctggcatattcactttgttttttaaaatgtttaagatggccgggcatggtggctcacacctgtaatcccagcactttgggaggccaaggcgggcagatcacttgaggtcaagagttcgagaccagcctggccaacatggtgaaaccccatctctactaaaaatacaaaaattgccaggcatggtggtgggcgcctgtaatcccaagctactcaggaggctgaggcaggagaatcacttgaacctgggaggtggaggttgcagtgagctgagatcgtgctactgcactccagcctgggcgatagagagcgagactcagtctcaaaaaaacaaacaaatgaaaaatgcctaagagtagtgccatgcttcaacaccacatctgttgagcatttatactgagaggtggtccttaccttgaggacaatggtattataaatattaaattatattagccatggtggagatcatagctactcaaaaaagttctactcctaatggagcctgtaatttaaaaaagataatcacactggtaaccggtaaggttttcagaaagaaattttgatcatcacccatttgtcgaaattttatttctgagtggcaacccagttctttgttccttagcaggctggtaaacatatcaggtgttagggtagtaagttaaaataggaagtgcatgtacttttttttttttttttttttgagacagagtcttgctctgttgcacaggctggagtgcagtggtgagatcttggctcactgcaacctctgcctcccaggttcaagtgattctcctgtctcagcctctcaaatacctgggattacaggcacatgccactgtgcccggctaatttttgtattttcagtagagacggggtttcaccatgttggccaggctggtatcgaactcctgacctcaaatgatccgcccgcctcagcctcccaaagtgctgggattacagttgtgagccacggaggctggcttttttttttttttttttttagtagagatgggagttttgccctgttggccaggctggtctcaaactcctggcctcaagtgatcccccatctcagcctcccaaagtgctgggattataggcttgagccaccatgccctgtttgtgcatatacattttaagaaacatgaaaggacacatgaagatattagtgcatttctttatttacttattatacttttattgaatgtatagtaaatgttgatattttgttagatcgctgggatttagacatcaggaatctctgaaagataagactaagaaaatataatactgcttaatcagagaaacaattgtggtgatcattggttcatt

SEQ ID NO: 11857 - DNA, 42741 bp, Human
tagacatgctcgtctgaatgctcaaggacagtctcagctctgggcatcaagaggagagtcagccaggccagaagatcacagtgttcaaaaggaaacaatagaaggatgaaaactgtgacattaactcaggcaaacttaaagaaacagccctgtgaggaaagcgctattatcattcttgttttacagatgaaggttctcttcatctgcaaaattccatgaggtgggagtggggaaggattcaccctactttactcgggcacccccagtcattgtggcagccaaaacacccctttatacatttccaaacaccaatgggaaattgtatgagagtgtgtgtgcgtgtgtgtgtgtgtgtgtgtgtgtgtgtgtgtagaatgggtgcgatggcatctccagttgagaataactggtatctaaatgtattcaggatgctatataaaaataccatagattgggtggcttctaaactgcagaaatttattgctgacagttctggagactgggaagcccaaggaaaggtgctggcaggtctggtgtgtggtaagggttgcttcctggtttatagacagccctcctctccctgagtcctcacatggtggacggggtgagggaactctctggggtctcttttataacggcactaatcccattcacggagtctccaccctcatgacctaatcaccttccaaaggccccacctcctaacatcatcatattggagtttaggatttaaacttctgtgtttgagccaggcactgtggctcacgcttgtaatcccagcactttgggacaccgaggtaggtggatcacttgaggtcaggagttcaaggccagcctggcctacatggtgaaaccccacctctactaaaaaatttttaaaaattagccaggcatcgtggcaggtgcctgtagtcctagctactcaggaggctgaggcaggagaatcgcttgaacctgggaggcggaggttgcagtgagccgagatcgcaccactgcactccagcctgggcaacagagtgagactctgtctccaaaaataaaataaaataaaatacacgtatgggtttagggagagcacacattcagtctacagcagctggatatgctgaagtactgaaacgatcgctccaaagtctaaaggggatggaagaggggagatgtgcacatgtgtgcccccgttcttattgccttgttcctgaaaccgcctttgtaaaaattataacagtgagaaaagagatctgacctaacccactccatcttgcctttaacctccaagctgccattgttcatccctggacgtaggccaaactaactgggagaaatttagtttatagttttaactttgttgttgtagttgttgttgttgatctatttttatttttctttgagacagggtcttactctgtcacccaggctggagtgcagtggtgggatcacaactcactgcagccttgacttcccaagctcaggtgatcctcccgtttcagcctctccaagtggctgggaccacagcgaggcaccatcacgcccggctaatttttgtatttttttatggagatgcgggtctccctgtgttgcccaggctggtctcgaactcctgggctcaagcacccacctgcctcggcttcccaaagtgctgggattacaggtgtaagccaccacgcccagcttgattctttccctttttcctctccagatgttcaccttctcttatgtaaaatgcaccattcgcagccggcctgtccctctccctactcgccccacccccacctctaaggacgtatataaatgttaaacctcctgaaatcctcttatgaaaaacagccacaggtgtgtcccacaggtgcggtgtttttcccagacccgccctcaagtggcttaataaacctcgatgatcaagacacgcctcagtccttcattttggtcatcattctttctctgaaaaatcagatgatcaagcacctgaggccacatccagcacatggctttgagggctcccgaatggagctgggtgagggcacagaggtgtctgcgtgtctttcccagccaactccaatctggttcatgagcccccaggatgacctaccctgggcatcgcccctctgcactcagcatctgctgatgtcagtggtttttcctctgcccactttctgctgcctctgccatgggaagtgtgacagggtgggtggggcagagcagtgggaagaggaaacctgggatgcttccatctggcctgtgacttgtctttctccaaatgtcgaccacgcaactcagcttgccacctccatgactggtctcattgtgaaaacttgtatacattagatatttttatcctttatgctcattaaaataaactttctcaggttttgttttggttttttttttggtttttttttttttgttttttgccaactgatagtcctgatcttccttttttctttttacttatttatttattttttgagacggagtcttgctctgtcgcctagtctggagtgcagtggtgccatctaagctcactgcaagctccgccacctgggttcacaccattctcctgcctcagcctcccaagtagctgggactacaggtgcccgccaccacgccttagacatgaaatgaaactcatagattatttaacccaagtcttattttatctcaaaagatagagtagtttgcccacaatcatacagctaattaataacaaatccagcactagaaaacaaatctcctgactctttaaccatgtctctacctcctgtacaattcatcctcttccatgagatgagagtagaaaaagaagtaaatcaattgagatggttcatcctgtccccgccccaactccaggctcaccaccacaggacaggggtggcagggggacgcccgaattagggagagtggcttggggggcaactttcggtgtcagtagtcagtagggagaagaaggctttgaaatgtaaaccgtgtcaggaagaagaagaagcaaactgcccacttattttaggaagatcaggggccaggcgcggtgactcacgcctgtaatcccagcactttgggaggccgaagcgggcggatctgaggtcaggtgatcgagaccatcctggctaacacggtgaaaccctgtctctactatcattgattctatagttcagatacacagacaaccccgaatgcatgtgcacacatgtgaacacacacacacagagacattaatgatgaaatcataatcaagagtatttcaagtcaattctaaaagttaaaaatctcaggccaggcgtggtaactcatgcctgtaatcccagcactttgggaggccaaggccggtggatcacctgagatcaggagttcgagaccagcctggccaacttgatgaaaccccatctctactaaaaatgcaaaaattagctgggcatggtggcatgcatctgtaatgccagctgctcgggaggctgaggcaggagaatcgcttgaacacaggaggcggatgttacggtgagctgagatcgcaccactgcactccagcctgcgtgacaagaacaaaactccagctcaaaaaaaaatttaaaaaaaaataaaagttaaaaatctcaattaacaaagagatctttaatgttttactcccttcatgcccctttatgcattttcaatccatgctttcctttggttcttctgaacaaatgctgtgattcccttttttttttccccaatgcttagttcatttcttcttaaaagtatgttgctagtttgtttacttgtaagtacaagatcctctctcccctaaggctcactgagcaacttctggaaagctgaactgggcagtctaaggcatgctcaagtagaaaggtatgtgttaagaagtcagaatggggtttccttgaccctggctgggagcactctcctcccatcttcctgggatgcagttcctttttctattttatttgttttattttgtgacaaggtctcattctgttgcccaggctggaatgcaatagcataatcatagctcactgctaccttgatctcctggcctcaagtaatcctcccacttcagcctcacaagtagctgggactgcaggtgccagcacacccagctaatttttgtattttttgtagagacagggtttcaccatattgcccatgctggtctcaaactcctggactcaagccatccctccgcttcagcctcccatagtgctgggattacaggcatcagacactgcacctggctgcaatgcaattcttctttcttttttttttttttttttgagacggagtctcgctctgtcgcccaggctggagtgcagtggcgtgatcttggctcactgcaagctccacctcccaggttcacgccgttctcctgcctcagcttccctagtagctgggactacaggcgtccgccaccacacctggctaattttttgtatttttagtaaagacagggtttcatcgtgttagccaggatggtctcaatctcctgacctcgtgatccgcccaccttggcctcccaaagtgctgggattacaggcgtgagccactgcacccggccaatgcaattcttaaaagtctcgtttttatatctgatgggcgattaatatacagaacatatcaagaactcctacaactcaacaattcaaaaaacaaataacctgattttctttttctttagatggagtctcactctgtcgccaggctggagtgcagtggcacaatctccgctcactgcaacctccacctcccgggttcaagtgattctcctgcctcaacctcccaagtagctgggactacgggtgcacaccaccacgcccagctaatttttgtatttttagtagagacggggtttcaccatgttggccaggatggtctcgatctcttgacgtcgtgatctgcctgcctcggcctcccaaagtgctgggattacaggcgtgtgccaccacgctaggccacaaataacctgatttttaaaatgggtgaaggacttaaatagacatttctccaaagaagatatacaaatggccggtaagcacatgaaaagatgctcaacattgctaatcattagggaaacacaaaccaaaaccaccacaagacaccacctctcacccattaggatggcaactgccaaaaaccccagaaaataacaagtgttggtgagcatgccgagaaatcaaaacctttgtgcgctgctggtgggaatacgtaaaatggtacagcactgtggaaaacagtataatgattcctcagaaaattaaaaatagaataaccatgggtacaaaaaaatagaaagaatgaataagatctagtatttgctaacacaacagggtgactagtaaaaaataattgtacatttaaaaataactaaaaatataattagattgtaacacaaaggacaaatacttgaggtaacagacaccccatttataataatcaccaatgtgattattacacactgcatgcctatatcaaaatatctcacataacccatcaatatatacaagtcctatgtacccacaaaaattaaatattaaaaaatagaataactgtctgatccagcaatttcacttctaagtatatacccaaaataactgaaagcagggactcagaattatttgtaagcccaagttcatggcagcaggcaaaaggtagaagcaacccaagtgtccattgacaggtgaatggatacataaagggcagtaaatacagacaacggaatattattcagccttgaaaatgaaagaaatgttgacacatgctacgatacagatgcaccttgaagctgttacattatgtgaaataagccagtcacaaaaggacaaacacaatatgatcccccttatatgaggtacccagagtggtcaaattcatagagacagaaagtagaatggggggttgcctgtgaggtaggggagaaggagcagtaactgcttactgggtacagggtttcagtgttgcaggacaaagagttctggagatggatggtgctgaaggttgtacaacaacatgaaggcattatgggctgggcacggtggctcacgcctgtaaccccagcactttgggaggccgaggcgggcagatcacgaggtcaggagatcgagaccattctggccaacatggtgaaaccctgtctctactaaaatacaaaaaattagcctggcatggtggtgtgtgcttgtagtcccagctacttgggaggctgaggcaggggaatagcttcaatccagaggcagaggttgcagtgagtggagattgtgccactgcactccagcctggcgacagagcaagactccgtctcaaaaaaaaaaaaaggagggatttaatgtcattgaactggatgcttaaaaatggttaagatgggaaattttacgttatgtgattttaccacagttaaacaaattttaaatgaaattaaacattgattgggcttaataataaaaaataaagtattgcgtaacaaccaaccctctataaagacaggaagataaaaggtaggtactacaatcaccaatattatagggaataaaaatgctctaaaatagagtcattcaggctgggtgcggtggctcatgcctgtaatcccagcactttgggaggttgaggcaggtggatcacttgaggtcaggagttcgtgaccagcctggccaacatggcaaaaccccgtctctactaaaagtacaaaaattagccaggcatggtggcgggcccctgtaatcccagctacttgggagcccgaggcaggaaaatcgcttgaacccgagaggcagaggttgcagtgagccggcatcatgccactgcactgcagcccaggcgacagggagagtctgtctcaaaaaaataaagaaagaataaaaaataaaatacaatcattcaaattcaagacctctgcctaatgtcccacagagaacctcatgctccagcagaaaaaagacaaagaagaattcacatggtaattataaaaattacgagaaccaacacaatggtaattataccatcacaaaaattatacttcaagactctgtaaaagagaatgttgctaatattatgttttaaggaaacagcattgcaaggtaaaattgaagtgtttacatacggacaaagactagaagggaaaaggcacacatgaaattatttcctttgttagatttgatttattgttttctgccttaaaatacatgtttaaaattgttataatatttatacgacaaataagaagataatcagagtacgataaaacagaattcccaagcttctccctctcagaaaaggaattgctccaaaagctccaagattataattccttatataagaaatatgcacgtggcattggacccaacttaaaactaaaaacctaaatgaaatttaaaaaaaagaaataactgaggccgggcactgtggctcacgcctgtaatcccagcattttgggaggccgaggcaggcagatcacctggggtcagaagttcgagaccagcctgatcaacatggagaaaccccatctctattaaaaatacaaaattagctgggcatgatggcacatgcctgtaatcccagctacttgggaggctgaggcaggagaatcgcttgaacccccgaggcggaggttgcagtgagccgagatcgcaccattgcactccagcctgggcaacaagaatgatactctgtctcaaaaagaaaaaaaaaagaaaaaagaaaagaaaagaaataactttattttcagtatcagtacaatgaagaaatgaaaactgttgatgaaaaaagactagactgccgggcacggtggctcacgcctgtaatcctggtactttgggaggctgaggcaggtggatcacttgaggtcaggagttcgagaccagcctggccaacatggtgaaaccccgtctctactaaaaatacaaaaattagccgggcgtggtggcacacacctgtagtcccagctacttgggaggctgaggcaggagaatcacttgaaccgggggaatcagaggttgcagtgagccgagaatgcgccatcacatgccagcctgggcgtcacagcaagactctgtctcaaaaataaaaataaaaataaattaaaaagactagaaagacaactttttccaacccacaacaaaggggttgctttaggcttgcctggacacgtcacgtcatgttctcctattctggttgctctagtgacattccccagatgacatctggcctgcagtcttcatagctacgacttttcctaagaagctacaagcacttgtgggaaagaacccattgcttgtcacccttgcaatgcctagcacagtgctgagtttccacttaagcttcttgccagatgaatgctaagcaaatacagcctgttgagaaagaccctatctggtagtttttatttatttatttatttttgagacagggtctcactctgtcacccaggctggagtgcagtggtgtgatcatggctcactgtagcctcagcctcccaagctcaagcaatcctccccatgtcagcctcccaagtagctaggaccacaggtgcaaaacactacagtggctaatgtttttatttttgtaacacagggtctccctatgttgcccaggctggtcttgaattccagggctcaagcaatccttcttcctcagcctccaaagtgctgggattacaggccaccacacctgaccaaactgtttttttttttttttttttaaaactaacaatcagtgtatcaaataatgctgaggagggtgagttacattacagagacatgcacaagaaatcaaggatgcaatagttcacaaagtgttgcaaacagttcacaaatgttgcatggtccaattcccagagttcacctgtcacatgtcataatactgagaaacagcatccactggaggtacagcagaactttttagtgtggcttgatgttaattacataattaggctgtattgtaagtcattcttgtctttagaagccaaacacacagacacgagaaacctgacctgatactgtagccgtgggtgctgcccaatcagggcactaatgtcataacacttctcacttctccccctgtgctacactggaggatattctgcttcctaatgtgcaagaaagtcctctttttccatgtagccatcagttttagcagatgggggacttgggtgggaagcctttgctttcctttccttgtggcagggaatgcagaacaaatatggtgtctgtaaatttctgaacataaaagaaaatacattttaagattttcctgtgttcccaagtagtggctgtagaaatagccctgcagttccaaatacacagacaattataaatacccaaagaaatactctgtccaccaccatggccacgtatttccagtcatcttctacctgaaatgcaaacaaaaattaagagctgttttaaaaaaccaaaaccataagaaacatgccttgtttcatcaataagctgcttcttttttgaagaagatttctccggcacgttttaaagcaaatatcagctgggtgggaggatcatctgaggtctggagttcaagaccagcctgggcaacatggtgaaaccctgtctctactaaaaatacaaaagatagccaggaatggtggcatgtgcctgtagtcctagctactcaggagtctgaggcaagagaatcgcttaaacctgggaggtggaggttgcagtgagccacgatcacaccactgcactccagcctgggtgacagagtaagactccatttcgaaaaataaataaaaatgaaaataaagcaaatattggtatttggtgaatccaggtctcctgtacaggacacataagaaattttgtttcgtttgcagagggcagatgcacagcctctgtgagtgcctcagacagcagagtctgcggcaaagccctgactccgtgggtcaccagggactttcccaactgcaagaaacgctccagagaagcaactgctcagagagctagactcattctttgcaacggtgggtagtctggctccatggcaagtctggggaatgagtttgaggcagggggtgccactgggggcggaggacatggaggggtatgattgagaaccactttatcaggaataggcagccctccagccctcaaagggatgctggccatggagagctggttgtgtttctcccagttcctgaccctccagccttctgccactgtatctgtacttgtgtcttgagagccctaactggtagtgattaagtcaacagcagctgtttcttcgattaaaaaaaaaatgttagggacaggattttgctgtgttgcccaggctgaagtgcagtggtgcgattgtggctcactggaacttggaactcctgagctcaagcaatcctcccgccttagcctcccacatagctgggacaacaggcttggcaaatttttttaaatttgttttttagaaataaggtctcaatatgttgcccaggctggtctcaaactcctggccttacttaaacaattctcccgtcttggcctccgaaagtgctgcaattacagccatgtgccaccatgccctactaatttttgttttttttgtagagagagggtcttcttttaaattttatgaaggtgaatttttctgggctctcttgtccggtgacacatctgcatgacagccattcacagcatcttccttctacaccaacagggcggactttcggtttcacagtatcctttcactaggagcgatggctgccagcagctgcagtccgaggtcaaacctagacaccaggcctgagtttcagatgccttccgctagtcacccacatggtgtgggaaattggcatgattctcttgagctctgtctttggaagctgagggaggtacatgctgctatagttagactctggacagcaggaacagagtacgtgaacgctaaaaatatccctggggctcatttcaccagcacctaaatccctcaagtaggacaagtggggccagagctgccggaacgaatgcactctcgccctctcccacatctcccagcacccccaggctgcacgctgctccgaactcatttctccttccctctggggcagcttttctctttctacctttttatttgctgctgtttcttgtgcaggggcttttttttttttttcctgagacagggccctgatctgtcgtctatctcccaggctgtagcctcaacctcctgggctcaagcaatcctcccacctcagccccttgagtggctgggactacaggtatgcaccaacacgcctgctaattttttttttttttttggtagttcagggtctcactatgttgcccaggctgaggctcttagtttcattaactgaggttgccctgaatgtttgtttgtttgtttttatttttgagatggagtctctctctgtcacccaggctggagtgcaggggcgccatgtcagctcactgtaacctccacctcctgggttcaagcgattctcctgcctcaacctcccaagtagttgggattacaggcctgtgccactatgcctggctaatttttgtatttttagtagagatggggtttccccatgttggccatgctggtctcaaactcctgacttcaggtgatccgcctgccttggcctcccaaagtgctaggattacaggcgtgagccaccacgcccggccctgaatgttcattttaagcaaattttacttgagttcacatttctggaggtggagatttgctctggggctattgcacctgaccccgctccactggcaggtctgaccctgtcagtccacccataaccacataataacagagccaggtctcagagcaaggccgcctgaccctctcaggaacaaaagtcacactgaaggtctgactgtgcatccagagtgcccataggctgcaaagggtgcaagctggctgggtggagggaacacacatttacctccttggtttcattgtggctcttcatgttttctgctatgaactgaacactgttaatcacatcttcaacttcaggcgagtgctccgaattttccaccacccactgtaatggctgatgacttaatcttctcttgcttgtggcaagctcatttgatttgtgacaatggaagcattctttaagatgtctgggttccccatggcttgcaagcttgcctttggcaggcctcctggcaaggcctctgggcactgcatcagagcctgtgccccttgtcttgtccagaggccacctcatcagcaggacctggggcagcagcttcaggaaaactgtcttcacccacctgggcattgtgtgcgtggttggggtgcggtagtgtatgttcaacacaaacacagtcaccacgatggacagtgtgacaaagatcatggtgaacagcaggtactcacccaccagtgggaccaccagagatgtggatgggatggtttctgtgatgaccagcaaaaacacagtcagagaaagcaggactgaaatacaaagcgtcactttttcaccacagtccgaaggaaggtaaaagaccaacacggttagaaatgaaataaagagacaagggatgatcagattaatcgtgtaaaacatcggcaatcttctaatgtagaaagaataggttatatctgtgtatatctcttcacaacagttgtatttgatgtcatgtttgtagccagaggcatcaatgatttcccattcactgttttcccaaaaatcattcatatccacttttgatccaatgattagaagatcaatttcagctttgtcatacgtccaggaaccaaattttagggaacagttttgatgatcaaaagggaaaaaggtgatatccatagggcaggaactcttaaaaatagctggtggagtccaggttatcatgccattgtatttaagaagagcttttgttttgccttctacttggaagtcaccaacagcactgcaaagcaagtcagacaccattagtaacactccctttgctataggccagaatacaccaacagcagctttggaaagaggctacggtggtcagagacccatacttgttatagagaacaatgtcgggcttccaaatcttatctgcaggaacgcgaagagtctcaatgccatcatattccattggatcccagcgcaatttataatcattccagatctaaaataaatagaaatcagcttttaaaatttcttaataactttcgggccaggcatggtggctcacgcctgtaatcccagcactttgggaggccgaggcaggcaggtcacttgaggtcaggaggtcgagaccagcctggccagcatagtgaaaccccgtctctactaaaaatacaaaaattagccgggtgtggtggccagcgcctgtagtcccaactactcgggaggctgaggcaggagaatctcttgaacgtggggggcagagtttgcagtgagctgagatcatgtcactgtactacagcctgggtgactctatctggaaaaaaaaaatgtgtttcttaataactttcttccaatgttaactttatgatggttcaacagttgttgttgaaaaaagaatacatttggccaggcgtggtggctcacgcctgtaatcccagcactttgggaggccgaggtgagcggatcactaggtcagaagattgagaccatcctggctaacacggtgaaaccccatttttactaaaaatacaaaaaaaaaaaaaaattagccaggcatggtggtggttgcctgtagtcccagctactccggaggctgaggcaggagaatggcatgaacccaggaggcggagcttgcagtgagccgagatcgtgccactgcactccagcctaggcgacggaccgggactctgtctcaaaaaaaaaaaaaaaaagtggcccggcgcgatggctcacgcctgtaatcccagcacgttgggaggccgaggcgtgcagatcacgatgtcaggagatcgagaccatcctgcctaacacggtgaaaccccgtctctactaaaaatacaaaaaaaattagccgggcgtggtggcgggcccctgtagtcccagctactcaggagactgaggcaggagaatggtgtgaacctgggaggcggagcttgcagtgagccgagatcgcgccactggactccagcctgggcgacagagcgagactccgtctcaaaaaaaaccaaaaaacaaaaaaaaaaagtaaaaataatacattcttatttgaagaatgcattggttgctatcaaaatctggacaattatatccatggggaacagggagctaaatagctgagctgatttaggcaaatatttcattagataattatgtattgattattagttagctggttaaagttttaggctcaacttccatattccgtgagctatactcacactggagtatagctctaatatcaaaaagttcaagggtatgatgataagctttgaattaaaaaaaaatctgtataaacgattaagacttcctttctgttttttttttgttttgttttgttttcaagacagagtctcgctctgttgcccatgctggaatgtagtggtgcaatctcagctcactgcaacctctgcctactggttcaagcgattctcctgcctcagcctcccgagtagctgggattacgggcacccaccaccacgccgggctaattttgtatctttattagagacagggtttcatttcaccatgttggccaagttggtctcgaactcctgacctcaggtgatccgcccaccttgggctctcaaagtgctgggattacaggcatgagccactgcacccctccaagactttcttaaggaagaaaggtataactgataaaaccagctgctgggaatctcatgtacatgctcccaagctcagctactgacttctccaagcctggtcaagcagggatcaaagagcaggcaagcatcagaccctggagctcaagttacagaaaagtggaagatctgagagcagcaaccaggaaggatggaaacctctatgtcagagggacctttgtcactaagtgtctgcacctgtgaagcatgcatcaagtcagctattaccagagctgaactttaggctttggagatgacctagtggataatattttatattctataaccagttggagatggaacaaggtagtgcttgtgggttttatccattcaacatcattaagccaacacatgatataggcacatacgtgacgcagccacaaattggtttccatgatctggtttacttcatcctgggaagaagaaataatacttttagcctcaaatgtgcttgccatagaggtgagacttagagcaaaaattacaactaaaaagaaccaaatctgacttattcatgccaatagaagaagacttcaaggcaatgtgtgaaagcattcagcatgcaagcagaaatgccgcattttcacatctggctccagccctgtggattttgagaggcaatgtggctttaaactctttcatagctgatttaagcctcacctcttctgtgaagtgcttccgatctctgcagcccataaaggtttctagttccatgaaaggaaggaaagaaaagaagagcgacagcaggtaggagggagggagatgctgcagaaagtggtgaggattccaaccccgcacagtgtttttgcctgttccctaaacgcctcccatcctcgactgtgcctcagggctctctgggctctgagtcctgagacccctgccctgggatcctatcttgaaatgccagcctcagccagctgggcgcggtggctcacacctgtaatcccagcattctgggaggccgaggcgggtggatcacctgaggttaggagttcgagaccaccctggccaatatggtgaaaccccgtctctactaaaaaatacaaaaaaatagtcaggtgtggtggcgggcgcctgtaatcccagctacttgggaggctgaggcaggagaattgcttgaaccagggaggtggaggttgcagtgagcggagatcgtgccactgtactccagcccaggcgacaaagactccatctcaaaaaaaaaaaaaaaaaaagtcagccttggccaccatggggtttccagctggcagctgctactcacccccagcgaagccaccacttcgatcgttcactacacaaatatttattgagtaaccactatgtgctctataaatattgggaatacagcaataagaagttgggaaaaggtcctgccttcatgtgtcttagctgttagatggggagacataaaattactaatacatctatactataacataagacagcgttaagtcctatgaggacaaataaagagggatggaatggtccatgtgtggacacacacacacatatgcacacacacgcacactcatacacacgcacactcatgcacactcacacactcatgcacacacattcatacacacatgcatatacacggtactctcatacacactcatgcacactcacactcatgcgcacacacactcgtgaacacacaatcatgcaaactcatatacccactcatgaattctcatacacattcgtactcttatacgtatactctcatacacacactcgtacgtgtgcactcacactcatacacacacactggtgcatactcactcatgcacatgcactcactcatgcacatgcacacgctcatgcacacactcatacccactcacactcaggcacactcacacagtcatacacaggctcacacactggtgcacatgcacacacactcaaacacactcatgcacacacactcacagtcatgcacacacacgctagcacacatgtgcacatgatctcagtcacacacacacatctattttagatgggatgggcaaagaaggcttctttgaggaggtaatgtttaagcagatacttaaatgaccagaagacagtcagggctgtgtggaggaagaccattccaggtgacatcccaaatgtaatgagttcctaagctaccacctctcagtgggagaactaccaaagacacacctggcaccttgagtggccttacagcccagcagcctggtggctgtttatgtccccagtggccagcagcagattcacaagtcttcctcagccaaccttgcttcccaagacacccaggcaccctccagagtaaatgagctccatggtggtggctgagggagtcgtggtcagactcagacaccagcttcccctgggccacgtggctgccctgcagttctcttctcccctactccatccccactgctgccccttctggaaaactctaaacagaaaccctgctgggcttcctctttcaaatgggcctgtgacaagacagggtaagccccgggatttgaaaggtcagcaaaggagttacagtcatgggttcctgtagtcccaggaagcaaagaaattatctgtgcttatctattggtcaaccaattcatggctttacgattacacaagcctgcggtcatgccttctggtaatgagcgtccccttgcaatctgcagagtccagcaggggccatgtccataaatccactcactgttggtcaggaatggactagccctgcagtctcggttccaggaaggccttgggggtgagggcataagccctaactgcccttcaaagcctgctttgtctctgaataagcacactgtgttcagaaggctgagatcagttggcaatagccaactccacagcctcacttccgcaggctcggagaagctccaggtggtatggacatggcccatggggatgtggacaccttcagagatgtcagctgaccctatggagcaggacctgtctggcaagtcatactctctctccatccaattccagatcccaccaatgggcatggcactgctatcagacatctctgccggaggagtccaaagacccacagcatcaactccattcctggtgccatcaccctgtacctccttcttggaaaaatcaattaattgacacagcagctgcatcaaaggctttgagttatgatttcaaatggactcatttctggagcagcagcagacttggagactcggatcaaaaagaccaagtgggctgcattacaccaaggctttatctttgtcatttcagatatgccaggccagcacaaacactggatccctccgaggggcacttggccttgctcctgtactgaaagaaaccagaaaattttctggccaaggtcattttgcatgacacaaacacacttccaggtagagccctggtgctccagagccaagctggggatcagacagcgggccttttccaaggccttccagaagggaggggcaacaaagcttcctggctgtgccacttctctcggccaccccaagttcacctgacaacacacagctattgcactcctgggcatttatcccagagacatggaggtttatatttacactaaaacctgtacacaaatattcacaacagctttatttgtaatagaccaaaaactggaatcagctcaaatgtcctttagcaagttaatggttaaacaaagcgccatggtccaggtgtggtggctcacacctgtaatccccactttgagaggccaaggtgggcagatcacttgaggtcaggagttcgagaccagcctggccaacatggtgaaaccccgtctctactaaaaatacaaaaattagccgggcatagtggcacatgcctgcaatcccagctacttgggagtctgagggagtagaatcgcttgagcccgggaggcgtaggttgcagtgagccaagatcacgccactgcaccccagcctgggtgacagagtgagactccatctcaaaagcaaaacaaaacaaacaaacaaaaaacaaagcaccctggagtactactcagcaacaagaaggaatgaactactgataacactcagtgactcggaggaatctctaaaggatgatgctgagggaaaaacccagtcccacaagtttacctgctctatgattccagttacgtataacatcgttgaaatgagaaaatttcagaattggagggcagattagtgggagaaacaggcagagtctacaagggatccctccgttatttcttacaactgcatgtcaatctataatgatctcaagaaataaaaattcaattttaaaaacctgcagttccaagtctgccttgcagctggaggtagtcaatgagatggaaagcagcagctcttacggaaatcacagaagtctaggatgtacactttgctctttttctcccttccttatgtttcttgccaagaatgtgaatgtgaggatgggaatacagcagttatcttgaaccatgaagcaacactgagggaagaagccacgtgaaaagggtggtgaaatatgaaagaaggaaggaatcttggtcactgctgcctcatctggtttatgcctttagaatcacagtccgttggagtgacatcccctggagttgtgcggtgcataacctgggcaactaaacatacatgtgcaaccactaacaccgtgaaactgactgatattaatctcctggactgttaacctttagatttctgttgcataagacaggaataaacttgttttgtaaaggctgtgggttttctcttaatctctgatacttgcaaccaaatgtaaatgtcaaaatctgcatttaccagccctttcacccccatcttcagaataacctcctgcaaaggtgtgtccagcagggttatggagagacgccatgcagtgaggtagccctcacagacttcagaggaaactcagttcagctcttggttcacaacaacccagtccacagcaagaacttccagcccagcaggagaccaggaaccaggacaaagctactggagttgggaaggggattagaacaggcaccaaataaatactcactaaaggatgggagagcgcatccaggtgaggggaaacatctggctttatttttttcagccagtgcatgcacactttcagcctgggtcacagacagaggactggaccagggttggcttcatccactgagaagcatggactggagaatgtggtggggtctgactcatgcctgtcattagggtctttcctcaggtgtacccagaagggccaccgccgcctcacccacagagcaaagtctgggaggaaggagatcccttccccatccatggctggggctgacttgagcagggctccccctctgtgtcctgtagtctcaggaatgctctagcgcccctctctggagacacttcagaccttccttgcttcctaagcctgcatcttcctagaatttggtctgagccctggagcccagaccttgctgtacccaagagtacgggcctcgccacttcctctccctgcaatgggggggcgcaaagattatccaaaacaaagagctccagtcctacttgcccttgaacatggtagcaaggaatgaaattaagatcctcaaattcccaacctcttttttttcccaaggctgaatggaattgcatttttttcattctcacataacatagaagacttcatgcaattctttttttttttcctctgtcacccaggctggagtgcagtggtgcaatctcggctcactgcagccttgacctcctgggctcaagcaatcctcccacctcagcctccctagtagcaggagctacaggcatgtgccactacacctggctaatttttgcatttttatagagacaagatcttgctatgtcgttcaggctggtctcgaactcttgagctcaagggatccgcctgcttcagcctcccaaagtgctgggattacaggagtgagccaccacgcccggccttaaagcaatttttaaactgtggagtgaaaagggcatgagctttggagttaaatctcaattttgccattttgtagttgtatgaccctgggaaagtcacttaactgagcttccatttcctcagcagtgagatgaagatgttggccacacagtgtaaacaggcgtctggtgcataatgggtgccccgtgaagttagctccctttcactcccctgcaactctttgtttcgtaaactggttctcaaagcacttccaggaaaaacactgcctcacacagacagttacagcattggtgggaaaactgcctgcctcccaaatggatggctttgaagggccagatctcgtgtagatttgcatctatctgtatttctaaaattccttcatttaccacctgcaaaagtgtaacaatgctggggaaagctctgatcagagggcactcaccacgttggccagctgggtgatggccacttcaaagtgtaccgtgacagggtcggaaacgttttccacaggcctgatgaactggttgtaatgagaaaacagtttgtggaagagcctctcctcagttgcacagcccacacagcctgtgaggccaaacaaaggggagagttagagccagcccggccactggccactgcagcgattctaggcaattcttcccgggccctgtggggagcgaatgtcccagcccatgactgcatcctggtattgttaccacctgtgcgtgctccaccagtgcccatctcaccccaccctctgtgcctcagctgttcacctttacaatggagataaaaacagcaatgtctgcatttcaggactagagcagtatcaaagaaaatgatgtcggtcagagcatttcttaaagtctaaggcactgcagatataaaggagtagacacaaggcttggaatcttcacttatgtcactgaagtaactcgcagtcttactgatggcactagaccctttccagtaattcaggaaaatcctgtcctttcttgtctaaaatactgaatcaactaaaatctgtatctacaccagcaaggtgcttagctggggaaacttcactaaggaaactgaaataactagtaatttcatgatggtcttcgcaagtcatgttcttttaaaaaatcaactttgaggacatgaacagacacttctcaaaagtagacatttatgtggccaagaaacaagaaaaaaagctcaacaacactgatcattagagaaacgcaaatcaaaaccacaatgagatatcatctcaagccagtcagaatggcagttattaaaaagtgaagaaataacagatgctggagagactatggagaaataggaatgcttttacactgttagtgagagtgtaaattagttcaaccattgtgggagatgatgtggggattcctcaaacacctagaacccgaaataccattttacccagcaatcccattactgggtatatacccaaaggaatataaatcattctattataaagatacatgcatgcgtatgttcactgcagcactattcacaatagcaaagacatggaatcaacccaaatgcccatcaatgatagactggataaagaaaatgtggtataagccaggtgcggtggctcacgcctgtaatctcagcactttggaaggctgaggcggttggatcacaaggtcaggagatcgagaccatcctggctaacacggtgaaaccccgtccctaccaaaaatacaaaaacttagtcgggcatggtggtgggcgcctgtagtcccagctacttgggaggcttaggcaggagaatggcatgaacctgggaggcggagcttgcagtgagccaacatcgtgccactgcactccagcctgggcgacagagtgagactccgtctcaaaaaagaaagaaagaaagaaagaaagaaaatgtggtatatatgcaccatgcaatactatgcaaccataaaaatgaacaagatcgtgccctttgcagggacatggatggtgcttgaagccgttatcctcagcaaactaacacaggaacaaaaaaccaaacactgcatgttctcacttgaaacggggagctgaacaatgaggacacatggacacagggaggggaacaccacacactagagcctcttgagggggtccagggaagaagagcattgggaaaaatacctgatgcatgctgggcttaatacctaggtgatgggttgatctgtgcacaccatggcacacgtttacctatgtaacaaagctgcacatcctgcccatgtaccccagacttaaaataaaacaaaaatcaactttgaaattcagttattgtggagatttctgagaatgcaagatttttaaggcaaatttatttgaaacttcctttttgttgttgagatggagtctcgctctgttgcccaggcatggtcatgcagtggcatgatctcggctcactgcaagctccgcctcccaggttcatgccattctcctgcctcagcctccctagtagctgggactacaggtgactgccaccacgcccagctaattttttatatttttagtagagacggggtttcaccgtgttagccaggatggtctccatctcctgaccttgtgatccgcctgcctctgcctcccaaagtgctgggattacaggcatgagccaccgcgccctgccacttgaaacatttttaaaagttgaaattggttcttaaataatagcactttcagtcactaaattctagacaataactttatgcatatctctttgtatttttccaagaaaaccttaaatgtggggttacttttcctcatttgacataattcatttcattactacctcctctacaatttcctcacagaatttaaatttgatatctaacataggactccacaaatttctcaaagggatttacacattgaaagaaaaaaaatggaaagggattgaaaagctcatcaggcaacataaatggaaagatctctgttaaattactaaatggaaagagttgcctgacgaataccttaggaaacactgagacactagagttttagcaggaaggacaaatttaaggtaaaacatcattcttgccatcataattaatcatgatgaacatatttctccatgacagacaataaataatcctcctcattacccattttcttcctctttaagacattttatagcagataaaccctccatcagccttgaaaagcaagtcccctgcaaacctaacagcatagaaatgtgattttgttcagcagaacagcagtggtccgtttctaagttgtaacttttaaaatgaatgatcttactcatgggatagtttcagcataatcacgtgatgtttccccaaacaaacatgattacctacaaaatggaagggttcattgactgagtaatagtatcagctaacaaataaattaccactttgaaaaaatattaaacataactacaaataaataagctcaatacagccacaggggagatgaatagaaaactgtatcattctccttattatattttaattgggtttgcactatgtttcctggtcctctcctccccaccctacccctcagatttcatcttttgtattacacctaacaaataaaaaccaaatagattaattagcagttgtaacagtggtggctcctatgcagaccatagaaacttttattaatatatcttctcaagcacaactagaaaagagagtaaacacatgtagctaaaaagggaatagaagataaagcagaaatgaaacctacctttaaagaaaggtgtgaacacacacagccagagacacaagcccccatgaaggaatccctgccccttgctggtcagcatggttaaaacacacttggattcctttttcctaggcaaaggattgtggaaaacaaagagctatcagtcagccacatgcatccaaccttgacatcatcagaagcccactgcaatccgtgtgtgtcttctcagaaatcaaaacatccccgggacttcacacggttattaccaggatcagagactgaggcagacatgaagggcgaataaaaaagattcgatctgatgtcagatgagtcatcacatttcctgacagcctagatgtctcttcatgcaagaaaggggaagaaaagcagaaaagaaatgctggggcagacaggaccccgggaggatgaacacctgtgagtggctgagatctttctgtggtgcaatctcaaccgtaatcttaggggaattcactgagctccaactacaggtaaagctcatgctaggtcccaacaagtttgttctgactcatggagttctccagttaatcaaggctcaaccttgttagaaaactttctaaaatatgaatcctcatttctgtcttaatgagtgcagcttggagagaacagaaatttgtttttgttttgcttttttctgactccagggtttccagtgccttctcttttttgagttcagtgatgatccatgactagagactagatgtcagagaatgagaggaatggataccacctggatattttcacatttatttaaatattcttattgcaaagcatggtggatcatgcattaatcccagcactttgggaggacaaggcagaggatctcttaaggccaggagtttgagaccagcctgggcaacatagtgaaacctcatctctacaaaaaatagaaaattagctgggcgtggtgggcatgcctgtggccccagctacttgggaggctaaggtgagaggatcacttgagcccggtagatcaaagctgcagtgagctgagatcacaccacagcactccagcctggaagacagagcaagaccctgtctcaaaaataaataaatgggctaggcgaagtggctcatgcctgtaatcccagcactttgggaggccgaggcaggcagatcacgaggtcaggagctcgagaccatcctggctaacacagtgaaaccccatctctactaaaaatacacaaattatccaggcatggtggtgcacacctgtagtcccagctacccaggaggctgaggcaggagaatcacttgaacgcgagagacagaggctgcagtgagctcagatgtcatcactgcactccagcctgggtggcagagtgagaccctgtctcaaaaataaataaataaataaataaatatccctgttaaactggttttcttataattttcctcttttctgtataagtttaatgtcagtgggtttctttttttttttttttttttgagacgaagtctcgctctgtcgcccaggctggagttcactggcatgacctctgctcactacaagctccgcctcccgggttcacgccattctcctgcctcagcctctcgagtacctggggactacaggcgcccaccaccacgccctactgattttttgtatttttagtagagatggggtttcacccagttagccaggatggcctagatctcctgacctcgtgatctgcctgcctcagcctcccaaagtgctgagattacaggcgtgagccaccgcacccggccatgtcagggggtttctaattaattgggcctctgaccagatatcagtgttggttaaacaggagttagaactcaagaaagaccaggcgtggtggctcacgcctataatcccaacactttgggaggccaaggcgggcagatcccttgagctcagttcaagaccagcctgagcaacatggtgaaaccctgtctctacaaaaattacacaaaacaattagctgggcatggtggcatgcacttgtagttccacctacttgagaggctgaggtaggaggatcacctgagctcaggagttcgaggctacagacagccttgatcgtgtcactgtactccagactgggtgacagagacccattctcaaaaaaaaaaaaaaaaaaaaagccactctagaggaggagtcctttggaatacgccaaaagtcagcgcttgctccattctaggagtaggtgaactgcgtccccgtataccaagggtgcagagcaggaggatggggggcttcatgtctggaggttgcagaagagctctgcagaggcgaggaatgcaggagagagaatatggactctggagtcagacaaacccagagctggactctggtcctgagactcgcctgggggacactgggcaactcactgaagctacctcagcctgtcctcatcagaaaaatgtgattaaatttagtaatcattgaatctctctctaccaattttgcatgtaattattattcactctcttgccagttcaaataggtaacacaatatttaagttattcttggagcctgagcttataaggatacagtttaagtgcttataaagaaaatacattctccattcaaagaaaacatttaaactatgcccccatcatcagaaaaatgctcgagatttgtcattgaattatgtgtttttatcctgctccaaactctttttgaaaattgcaaaaatcaggccagacacagtgactcacgcctgtaatcccagcattttgggaggccgaggaccgaggatcacttgaggtcaggagtttgagaccagcctgaccaacatggtgaaaccccgttgctattaaaaatacaaaaattagccgggtgtggtgacactcgcctgtaatcctggctactcaggaggctcaggcaggagaatcgcttgaacccgggaggtggaagctgcagtgagctgagaccacaccactgggctccagcctggtgacaaagtgagacggagtctcaaaagaaaagaaaagaagagaaaattgcagagatagaagttaaaagcaaacacatggatagggagaaaataaatatgttttcaaaaaagaaaaaaaaaagaaaaaagatttaaagacattctatcttttcctgatgttgcttgatactgcttcatgttcatattccaggaattagtttttgttcagctatattgttgaaacagtctaaactttagagtgctgtccatggtttagtgaggtggaaaggatgaagggaggtggagggatacatggagccttggacggaaagaggctaattaatactggaagagctttggtgtctcctgccccttatttcccactccatgttacccctaattcctcgtagccatttttaaagagaaataagaagcagcagtggatcttaactttttcaggtccatgagtcagattgaaactatggatcctgccgggtgtggtggctcacgcctctaatcacagcactttgggaggccgaggtgggcggatcacctgaggtaaggagctcgacaccagcctggccaacatggtgaaaccccatctctactaaaaatacaaaaaaattagccaggtgtggtggtgcacacctgtagttccagctactctgaaggctgaggcaggagaatcacttgagcccaggaggtggaggttgcagtgaaccaagatcacaccactatattccatactgggtgacagaatgagactctgtcacaaaaaaaaaaaaaaaaagaaagaaatacctccccatatacgtatgaggattaaacagaattttgcatatgacttctgggaactcacagatccataaaaagccagccctgcatggagggtaattatagttggtttcacagtttcccccagtatctgtccccaatcactctatactatccctattaaaaaattatacattcttggggctggacgcagtggctcacacctgtaatcccagcactttgggaggccgaggtggatggatcacgaggtcaggagatcgagaccatcctggctaacatggtgaaaccccatctctactaaaaaatacaaaaaaattagccgggcgtggtggcgggtgcctgtagtcccagatacttgggaggctgaggcaggagaatggcatgaacctgagaggtggagctagcagcaagcccagatcgcgccagtgcactctagcctgtgtgacagagcaagactgcatctcaaaaaaaaaaaaaaaaaaaaaaatcctacattcttggctggctgtggtggtgcatgcctgtagtcccagttacttgggaggctgaggtgagaggatcacttgagtgcaggaggtcaaggctgcagtgagctgtgattgcatcactgtactccagcctgggcaacagagtgagatgagaccctgcctcaaaaaaataaataaataaataaataaacaatacattctaaagagctaatgtgttaggaaactgatagacttcagggaataattgttgggtttctttttctgttttattcatagaagctcatttcaatttggaggttttctgaaaaaaaaagaggttgatactgtttaatatgaaacttttttttttttctttttgagacagagtctcactctgtcaccccaggctggagtgcagtggtgcaatctcggctcactacaacctccccctcccaggttcaagcgattctcctgcctcagcctccttagtagctgggactacaggcacctgccaccatgcctggctaatttttatatttttagtacagacaggatttcaccatgttggccaggctggtctcgaactcctgacctcatgatccgcccacctcggcctcccaaagtgctgggatcacagagatgaggcaccgtgcccggccaaaacttttattataaaaattatttcaagcttcccctccagccccatttgctaaattaaatccagtggctcattctgctctgaaaataaagatgatttgatatggttctataaaattggctatgctcttgtttgaagtttgagggttttttggcatagaaactgcacgaatgaacatttttgttgacctttatccaactgtcagttctctttaaactcaaaatgagaacattctttagttgtccataaagaaatagaaaggaaatagccctttaaacatgtattatttataactccactgcagcaaaaacatcatcaataatttaatgatcccatctgcttttttaaaatatccactgtcattaactctcacatgttccacatccctagtcggtagtatttcacatccaccactcttgacatgtccaaatcacgcagggaaaatgaaacagcagtagggtaagtattcaaattaaatgctaattttaaaccacaaagaaacatttaataaatcactaattataaggcaggctcaaatgaactctacaatgcccagtttttgtccatctaaattttaagaaaaaaagagaggcttagaacctgggatggagtcaagcagtgaaagttaaaactgtgttgaaaatgttgagatattgaataataattagagcttcctctgagcacgtgctgtatgtcaatcaccatgctagagtctcgaaattctctcttttaatcttcacagcagctctgtgaagcaagactcgatttttcaggttaggagatggacactcagggagcaaggtgacttgcttaaaggtccatcacagctgatcagtggctgagttggaattccaatctaggtctgtctatatcaaacctatgctttaaccttaaggtgatccaaaagtgctgtttgatccataaatactttataagttcaatatatttgtagaaagctgttactgacatgggccacgcttagctccacctgcgtcattattcaccactgaccccttgttccactccacaaggtgaggaagccaaggctaattaatagagggagttgaaatggcagacataatgtgagacagaagtgggagctggggagagtgccctcttaggccacaaactaacatcaggcaagttcccaaccctgggagagtggccaatgacagccacacccatccaggccgtgctcttgctagctgtgccatgaacatcttgaagctaagagctggtgaagagcacatgggccacacccctgcagccagaatgactcctgtacagacctttgagagccttctatcaataataaccttctattatttccctccagcctttaacaaacatctctgggcctttcaaggtagaatgaaatgtgcctaaattttaagtcccttaaaacaatcaatttagttatcattgtcctagaacacagcagttattataataaaatttattctactatagtagatccagctctgtgattgtaaatgaaaatcacaatacgaatgtgtgtttgtttcctaggaccactgtaacaaattaccaccaacctggtgacttcatagagcaaaaagtcattctttcacagttctgaggctaaaagtctttttttttctttgagatggagtcttgctctgtcgcccaggctggagtgcagtagtgcaatcttggctcactgcagcctctgcctcccaggttcaagtgattctcttgcctcagcctcccgagtagctgggattacaggcaggcaccaccacgtccagctaatttttgtatttttagtagagacggggtttcaccatgttggtcaggctggtcttgaactcctgacctcccacagtgctgggattacaggcatgggccaccacgcctggctaaggctaaaagtcttaaatcaaggtgctagggcaaggccacactccctgtggaggctctaggggaggatccttccctgcctcttccagctcctggctggaatcgccccagcctctgactctgtggttgcactgctttccctgtgcctgtgccttctcctcttctgtctcttacaagcaaactggttattctggggcctcccagctaatctcagataatctcatctctagattcttaattaaattacatctgcaaagatcctttttctaaagaaggtcacattcacaggtaccaggggttaggacgtgaacatatttttttggaaggccacccttcagctcactacaccatgtcccaggagtgtggtgagtatttcattagaaaatgtaagtaacagcagctactgaaatacacagaggcaatgcacattaattttcttcttccagagaacaacattttgatgggtataatgacaggcttttggagccagtggggagacccagaaactataactgcttttacaggaaaattataccaatttcttgttcatttgaagaaaaaaacccctgaaaatctgtggatatgatggttcctgattagcagttctcaaattttaatgtgcatcagaatcaaaggtgtgggcaatcttatttatttatttgtttatttattttttgagatggagtttcactcttgttgcccaggctggagtgcaatggcaggatcttggcatactgcaacttccgcctcccagattcaagagattttcctgcctcagcctcccaagtagctgggattacaggcatgcaccaccatgcccggccaattttgtatttttagtagagatggggtttctccgtgttggtcaagctggtcttgaactcccgacctcaggtgatctgcctgccttggcctcccaaagtgctgggattacaggcgtgagccaccacgcctggcctcttttttattttttagctttttgtagaaacagagtctccctgtgtcacctgggctgggatgcagtggcacgattatagctcactgcagcctcaaactcctgtgctgaagaaatcctctcacctcagcctcccaagtagctgaaactataggtgtgagccaccatgcctggataatttttttactttttgtagaaacagtctcaatatgttgcccaggctgggtcttgaactcctgacctcaagtgatcctcctgccccagcttcctatagcactgagattacaggagtgagttaccacacccagctgggcaatcttaaaagatcagtttacaggacccatccttagaaattctgatttagtggatctggcgtggggaaccagatttaattgcagtctttaaaagcttcagagtgaccctgatgcaggtggccagcactacgcatctgaggagcactcctccagacagttgcaggaagatttccatgcagtccacttatggtgtggttctgtgatattatagagttagacgtttctgggacatctgtgtccccataaatttgtatgtcacaaagcaaaaaggttagagatattccaaagttactatataaggcactgtgtttcacgtgaaaaagctaactcaacattaggataaactctactatgttctgggcacagtgatagatgctgaaatatagttacacaaaatgcacatttatttttttcaggtacccatggatttataaaaattgacctcttgttaaggcacaaaaaagtctcaacaagcaacaaataatctatatcatatagaatattctctgtccacaaaaagcaaaattaaaaatcaattgcaagataataagccaaacttccctttgttgcagttattaaaatattacaccagttttctatttttaagaggcagttaaactaattatggataaaatatggcttcggtctctccagtctgtgaatacaactgggatattaatcacaaggtcataactgcaccagttctaaccccctacagtcatgctgaatgcagccccctcccaaaattgcccagttatttaggaatctgtgagagcttgactctgccccaggcttccctgctaccttgctgggcacagcggtcttcccaaatgccaaagccaccctagagtctgggttagtgggagaagaatgagaaatggggctgggagggggatccaggcaggtgtgccagaaagaacctacgcccagccagaagacaatggagcaatatttttaaggtatgaaaaggaaaatagaattctattcccagcaaaaatttgttttgcaagcagaagtggaataaatatttttgcagctatgtaaaagcaggaaaatgtcatcaccagcaaacctatgctataataaatgctttaaagctactcaaggagaagagaaaataccagataaaaatgtggatctaaacaaagaaatgaagagcttagtgaatgacacatatgtgtgtaaatataaaagatagtttttcttattttaaaaatctcagctggaggcaaagcacagtggctcacacctgcaatctcagcactttgggaggctgaggtgggcggatcatttgagcctaggagttcaagaccagccttagcaatgtggcaaaaccccatctccaaaaaaaaaaaaaaaaaaaaaaaaatctcagttgggtgcagtggctcatgtatgtaatcccagcactttaggaggctgaggcaggaggatagcttgagcccaggaagtcatggctgcagggagccatgttcacaccactgcactccagccttggtgacagagcaagaccctgtctgaaaataaataaataaataaataaataaataaataaataaatatctctttaaaagacaatcaccttttaaaaacaagtgttaaatgtactgtggggttagaaaaatgtatgataataatagcacaaaagcaggagaggaaaaatggaagtctattgttataatgttcttatactacatgtaaaatggtataatattacctgaagatagactgtgatatgttaaaggtgtttactacagatcctaaggcaaccactagacttgcataacaaaaaaagcatagctttgtgttcacaagaagtaggaaaaaagcaaagaaaaacatagctaataagccgagaaaagagataaaatggaataataaaagatatttatttaacacaaaacaaaggggaaaaggagagcaagcaaacaaataaaaaataggacaaataggaaaaagtagtaaaatggtaatataaacctatcggggaacctgccttgatattcacataggttcttttctattttccttaaagcattggccagcttaagaaataaagggacagagtacaaaagagggaaatcttaaagctgggcatccggggaagacatcacatgttggtaggtttcgtgatgccccacaagctgcaaaaaccagcaagtttttattagggattttcaaaaggggagggagtgtgcgaataggtgtaggtcacagacatcaagtacttcacaaggcaatagaatatgacaaggcaagtggaggcagggctagatcacaggaccacaggatggggcgaaattaaaattgctaatgaagtttcaggcaccattgtcattgataacatcttatcaggagacagggttttgagagtaaccggtctgaccaaaattattaggtgggaatctcctcttcctaataagcctgggagtgctatgggagactggggtctatttcacccctgcaatatcgaccataagagacaggcatacctgggggggccgtttataggcctatacctccaggcgtgtattctctttcccagggatgttccttgctgagaaaaagaattcagtgatatttctcccatttgcttttgaaagaagagaaatatggctctgttctgcacggctcatcggcggtcagagtttaaggttatctcttattccctgaacaattgctgttatcctgttcttttttcaaggtgcccagatttcatattgctcaaacacacatgctgtacaatttgtgcagttaatgcaattattacagggtcctgaggcgacatacatcttcctcagctgacaggattaagagattaaagtaaagacaggcataggaaatcacaagggtattgactggggaagtgataagtgtccatgaaatcttcacaatttatgtttagagactgcagtaaagacaggcataagaaattataaatattaatttggggaactaataaatgtccatgaaatcttcacaatccatgttcttctgccatggcttcagctggtccctccgtttggggtccctgacttcccgcaacataaaccaaatcatattttaagaactcattaaatgcaaatggggtcttccaccagtggctcatgtctgtaatcccagcactttgggaggccaaggaaggtgaatcacctgaggtcaggggttcaagaccaacctggccaacacggtgaaatgctgtctctactaaaaatacaataaattagctggacatggtggcacatgcctgtaatcccagctactcaggaggctgaggcaggagaattgtttgaacctgggaggcggaggttgcagtgagcagaggtctcaccattgtgttccagcctgggcaacaagagagaaactccatctcaaaaaaaaatgtaaatggataaaacacatccattaaaagacagtaaacatttgttaggcagtgaagctatttgatcctggtcttttctttgttggaagctttttgattactaattgccctggttcattttgtgatgctataacagaatatcacaggttaggtaattgatgaggaaaagaaatttatttcttacagttcttgaggctggtaagtccaaggatgaggagttgacatctagcaagagccttcatgttgtgtcatataatggcagaaggcaaaagagcaaagagggcaggggagagagagcaagagtgggccaaatttgcttctattacagatcaactctggcaataactaacccaattgtgtaataatgacattaacctattcatgaggcatcagtgacctaatcacctcctattaggttccacctctcaacgctgttgcattggggattaacttttgaacacatgaactttggaggacatattcaaaacatagcacttaatcttttaattcttataggtctatttgtgtctgtctaggaagttgtcttttcaactaagtcatctactttttggcatacaggcattcaaaatactcgattttagttatttaagataagcagagattgttttcctctttcattcttgattttagtaattgcattcttctcttttcttcttggtcagtctagctaaaagttggccaattttgttgattgttttcaaagcccaaacttttggtttcattgattattttcctctttttttcctattctgtattttactaatttctaccttaatctgtattatttccttctgcttgccttaggcttttacagtttctaaagtagaagactaggctattagtttgagatcttttctttttttttttttgagaaggagtctcactcttgtcacccaggctggagtgcagtggcgccatcttggctcactgcaacttctgcctcccaggttcaagcaattctcctgcctcagcctcctgagtagctgggattacaggcgcccgccaccatgcctggctaattttggtacttttagtagagacagagtttcatcactttggccaggctggtgtcgaactcctgacctcaggccatccgcccacctcggcctcccaaagtactgggattacaggcatgagccactgtgcctggccatcttttcttcttttttaaatataggtacttgcagctataaatttccctctgtgcactgctttaactgcatccgataagtttttataagttgtaattttattttctgttatctcaaagtattttctaatttctcttgtgatttcttctttggcctattgattatttaagagtgtgttgattaatttccgcatattcatgaatttcccagattatcttctcttattcatttctaatttaattccattgtgatcagagaataatatacttattcccagcctgggaaatataggaaaatcccatctttacaaaaatcaaaaacttagccaggcatggtggtgcttgcttgtagcccctgttactcaggtggctgaggtaggaggatcacttgagcctgggagttcaagtctgcagtgatgggagttcaagtcagccatgatcatgccactgcactccagcctgggcaacagagtgagacctcaactctataaacaaacaaacaaataaataaatacatttattgagactttttcatggcctagcatatggtgtattctggagaatgttctgtgtacacttgagaaaaatatatattcttatgcttttgagtgggaagcactatagatgtctgttaagtctcatcggtttatattgttcaagtcttttatttccttactgttcttctgccttgttgttctaaccattattgaaagtgaggcattgaggccaggcatggttgcttacacctgtaatcccagcactttgggaggctgaggcaggtggatcatgaggtcaggagatcgagaccatcctggctaacacggtgaaaccccatctctactgaaactacaaaaaattagccaggcgtggtggtgggtgcctgtagtcccagctacttgggaggctgaggcaggagaatggcgtgaacctgggaggcggagcttgcagtgagctgagatcgcaccactgcactccggcgtgggtgacagagcgagactccgtctcaaaaaaaaaaaaaagaaaagaaacctccaactattgttaattgtctgtttctcccttcacttctaactggttttgtttcatgtattttggtgctctgttatgaggtgtatatgtggttataattattatttttcctgatgagttagcaagtttgtttataaaataccccactttagctgaattaacatttttgttttaaagtatagtttgtctgatattggtatagtcactcaagctctgttttgatcatttcttgcatagtatatcttttttattcttttactttcaatctatttatatctttcaatctaaagtatgcctcctgtagagagtatacagttggatcatgtttttaaatccagtctcataatatctgccttttattggattatttaatccattcacatttactgttattattgatatgattggatttacatctgccattttgttttatgttgtctgtgtctcatgtcccttttgctcctttgtttctccttatagtcttattttgcactaagtgaatttttccagtgtagtttttttttttttgagacagagtctcgcactgttgcctgggctggagtgcagtggcacaatctcaactcactgcaacctccacctcctgggttcaagagattctcctgcctcagcctcccaactagctgggattacaggtgcacgtcaccatgcccagctaattttttgtatttttagtagagacggagttttaccatgttgaccaggctggtctcaaactcctgacctcgtgatccatccacctcgggctcccaaagaagtgctgggattacaggcatgagacactgcgcccggcctccagtgtatttttaatgaattttaagctacatttttcacttattttcattacagttgatctagggtttacaatatacatcttataatctatctacttcagaaccttaactagcttatttcaagtgagacacagaaactttacttctatatagctctgttcctttctcctcatacacttataaaaacacctttattgagatataatttatattttataaatgcacatgtccagtgtaaagaatttgatgatttgggacatatacatacacccatgataccaccaccacaatcaaggtagtaaacatattcatcctctccaaaagttttcttgtgtccttttgtgggttttttcttgcttgttagtgtgtgtgtgtgcaagtgtgtgtgtgtgtagaacatttaacacaagatcaatcctcttagcaaaaaggttttttttgttttgagacgaagtctctctctgtggcccaggctggagtgcagtggcacgatctcggctcactgcaacctctgcctcccaggttcaagtgattctcctgcctcagcctcctgagtagctgggattacaggcacgtaccaccacgcccagctaatttttgtatttttagtagagacagttttgccccatgttggccaggctggtcttgaactcctgacctcaagtgattcacccacctcggcctctccaagtactgagattacaggcgtgagccaccacacccggcctcttagcaaagttttaagagcacaacatcatatttttaactatgggcactatgctgtagagcaaatatctagaacgtcttccttccctttatatgtgctatgactggtatgcatatgatgtgtatatatgttacaaacctgacaatgcattattataattattttatataattttatgtcttttatggaaaccaaaaggagaaagtaaagtgtacatttatagtttgttatattaaccttctgatttatcatttctgttcctctccatttgtttctgtgagtccagtgaccatctggaatcctagccttactttagtacagctttgtcctcaccagcctctttgtgctattaatgtcaaatatattatatttctatctgttgcaggaccaacaatgcaattatgtacatacacttttgcaactgttttaaaaatcagttaagagaagaaaaggctgtctattcccctgatctcacagttaacctctggctggtcacgcactcagcaagaatgacacccagatgttagcatgcactagttgctggctaattcatatattgtttttgacagtacagtggggcaaaagttgctctatagtatgatttaatttaattaaagtcagggtgatgccaggctttgaagcttgctttgaccttagcagggctcttcttagctatctctttttctggttctccctggtaaacttctagctggtctgctgtttcatttcctcttagttgcttatcatgtaaatctctagtggtttggacaatgctcttagatacctgtaataagctctgttccaaataaaggcaattttcttaggaagggctgcgtagctatctgctagaaactgcccctcttgagacaaggcagggactcttcttaggggcctaccgagacctccccaaccaagacattaaaataaagaatctggctggtcatggtggctcacgcctgtaatcccagcactttgggaggccaaggtgggcagatcacttgaggttgggagttcgagaccagcctgaccaacatggaaaaactccatctctactaaaaatacaaaattagccaagagcagtggtgcatgcctgtaatcctagctactcaggaggctgagcaggagaattgcgtgaaccagggaggtggaggttccagtgagtcaagatcgcgccattgcactacagcctgggcaacaagagcaaaactccatcaaaaaaaaaaaaagaaagaaagaaagaaggaaaggaaaaaggaaagaggaggggaggggaggggagggaagggaagggaagggagaacattcctaaaatttatgagaccaaaaaagagcctgaatagccaaagaaatcctaagcaaaaaggacaaatctggaggcatcacattacctgacctcaaattactacaaggttgtagtaaccaaaacaccgtggtataaaaatagacacaagggctgggcacggtggctcatgcctgtaatcccagcacttagggaggccaaggcgggcagatcacgaggtcaggagatcgagaccatcctggctaacacagtgaaaccccgtctctactaaatattttaaaaattagccaggagtggtggtaggcgcctgtagtcccagctactcgggaggctgaggcaggagaatggcataggcaggagaatggcgtgaacccggggggtggagattgcactgagcagagattgctccactgcactccagcccaggcaatagagtaagaccccgtctcaaaaaaagtcacgtaagtcaatagaacagaatatagaacccagaaataaagccatatattaatacctacagccagctgatcttcaagaaaactgacaaaaacatccactggagaaaggacaccctattcaataagtagtgctgggaaaattggatttctatgtgcagaagaatgaaactggacccatacctctcactatttacaaaaattagctgaggatggattacagatttaaatgtaagacctcaaaatagaaaaatcctacaagaaaatgtaaggagcccggcacggtagctcacacctgtaatcccagcacttcgggaggctgaggcagacagatcgtgagaccagcctggctaacatggtgaaactccacctctactaaaaatacaagaattagccgggtgtggtggccagcgcctataatcccagccactccagaggctgaggcaggagaatcgcttgaacccgggaggcacaagttgcagtgaaccaagatcgtgccactgcactccagcctgggtgacagagcaagactccatcaaaaaaactaaagaagaaggaaggaaaggaaggaaggaaggaaggaaggaaggaaggaaggaaaagaaagaaagaaagaaagaaaaagacaggccgggcgcagtggctcacgcctgtaatcccagtactttgggaagccgaggcaggtggatcacgaggtcaggagatcaagaccatcctggctaacatggtgaaaccccatctctactaaaaacacaaaaaaattagtggggcctggtgggaggcgcctgtagtcccagctactccggaggctgagacaggagaatcgcttggacccaggaggcggagcttgcagtgagccgagattgcgccactgtactccagcctgggtgacagcaagactccaccaaggaaaggaaaggaaaagagaggggagaggaggggaggaaaggaggaaaaggaggagaggggaggggatgggaggggaggaaagggaagggaggagggaaggaaggaaggaaagaaggaaggaaggaaatgggccgggtgcagtggctcacacctgtaatcccagtactttgagaggctgaggcggcagatcacgaggtcaggagatcgagaccatcctggctaacatggtgaaaccccgtctctactaaaaatacaaaaaaaaaattagccgggcttggtcgtgggtgcctgtagtcccatctattggggaggctgaggcaggagaatggcgtgaaccctgcaggcggagcttgcagtaagccaagatcgtgccagtgcactccagcctgggagacagagtgagactctgtctcaaagaaaaaaaaaaaatgctgggcatggtgacaggtgcctgtaatcccattaagaggtgacagcgtgctggcagccctcacagcccttgctccctctcggcacctcctcggccttggcacccactctggctgggcttgaggagcccttcagcccaccgctg

SEQ ID NO: 11858 - DNA, 13283 bp, Human
cgccctccagcccagcccagccctggcccggccccacccgcgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccggaaagggcttaccccatggggcaacagggtggactcgttctcccctccccgccatagagcgtatgactcttttggagtacttgtggttttagctctcatcagtgtcaaacagagatgctttgcctggtgttactgcttaacttctccgagcctcagtttccccacctatagcataagaggataagtgtgtcccctgggaggccatcctgaggtgctggtgggagtgccacccccagttccataccgcaaccgttcattattcccggggcctctcctcttcctccaggctgccctgggctggagcccctgcgacagaagttggctgccctgcagggggcccatgcctggatcctgcaggtcccctcggagcacctggccatgaactttcatgaggtaggtccccaggcttccagactccttcacgatggcctgggaaggctgagacccagcccagggaagatgcagagggcccagcccagataccctcccagcagcctggggtcgcctctgccccagctctgggggtaggtagagggtccgaggggaagggagtggggcctgcggagtgtgagccaggccactgggggtggtggtggggagagtgagtagaggggtgggtgggagtgtccacatgagcgggaaatgagcagggtttccaggtctaggtgagagtttctggggcccagggggagagggggtgacctctggggtttcaactcaggagtgagtttctgggcccctgatccccactcctccatctgtaggtcctggcagatctgggctccaagacactgaccgggcttttcagagcctgggtgcgggcaggcttggggggccggcatgtggccttcagcggcctggtgggcctggagccggccacactggctcgcagcctcccccggctgctggtgcaggccctgcaggccttccgcgtggctgccctggcagaaggggagcccgagggaccctggatggatgtagggcaggggcccgggctggagaggaaggggcaccacccactcaaccctcaggtaccccccgccaggcaaccctgagccatgtctgggcccccagcccctggggaggacctactgctcccaggggctgagaggggttcgggagcataatgacaaactgtcgctgccccagtggctgggtgtgtgtgggtgggatggggtgggggtcctgggccccccgtgtcttcccaggtttacaatcagagaatcacagctgctttaataaatgttatttataatacacggaaacaactctggagctttcttgggatgggacctggtgggtggacattcagtctcaggggtggggcccaggcagggctgcctctggaagcagttggcaagggtaacagatgctggaaaggggctgtaaggcccctatctgagcctatctcctgcctcctgagaagcagcagcagctggcctgcctgttgccccgcccccgtgcatggctgcccagcgctggccccagtgcccagcgtctccgcccagcacccccccggccctccctccccaccccccgcctccgagctgcggggagtcccagcctgggatctttgcctcatgtccttgggctcctgccctggctggcccgtcccccaccgccatgaggtgtcagattgtgtttccggctgcctcttcccgttgaccccctcctcccccaacacctgtcccctctcccgcccaccctcattccacagccctgtagacaggaggggcagatgcacgtcccagtcagagggatgggatggaggggccggtgctgacactggggctgctggctgccctggcggtgtgtggtaagggaagacaccctccccaccctggggtcccccgtgatgcttacccaggccccacaccgcatggctcctcactcactccactcccactctgccatctctccctgtggggggccgccttctggggtccccactcccagggagtggttgggttcccccctgctcatcccaacctcatggtccagcaggacctcagggcagcttccttcctgagtcccctgcccagggccccattcagtccttgtcgctgaccctccccaggcagctgggggctgaacgaggaggagcggctgatccggcacctgtttcaagagaagggctacaacaaggagctccggcccgtggcacacaaagaggagagtgtggacgttgccctggccctcacactctccaacctcatctccctggtgagaggccctccggtgctgggttgggagggagggcagggatggctttccagtaccaggatagccatggaggaagctagaagcccccacctggcctatggccactcccttcctgggaaacgtgctgcggctgctctgtgccctgagaggctgctgtcctgcccctccagtgtcagctctgcggtgtcccccaaccacacccatagcatgccccatctgtgacacacttcagaggccactggtcctctctgctccctggcggcctacccactcctgactgcgagtgatcagggcccagatgccacggtttccctgggtgccaattgacagtgggtgaatgtaggctgggtgtggtggctcatgcctgtaatcccagcactttgggaggcccaggtgggtggatcacctgaggtcaggagctcgagaccagcctggccaacatagtaaaacctgatctctactaaaaatacaaaaattagccgggtgtgatggtgtgggcctataatcccagctactaggaaggctgaggcaggagaatcgcttgaacccaggaggcagaggttgcaggttgcagtgagccaagctcgtgccactgcactccatcctgggcaattgagcaagaccctggaaaaaaaaagagagagagagagagagagagagtgggtgaatgtgtgcggataaaagaatgatatggccctgaaggatggccctaccgtctaattacagaaagaagttgaggagaccctcactaccaatgtgtggatagagcacgtaagaatgcccctcccagccgggcgcagtggctcatgcctgtaatcccagcactttggaaggccgaggggggtggatcacgaggtcaggagatcaagaccatcttggctgacacggtgaaaccccgtctctactaaaaatacaaaaaattagcttggtgtggtggtgggtacctgtagtcccagctactcgggaagctgaggcaggagaatggtgtgaacgcaggaggcggagcttgcagtgagccgagattgcgccactgcactccagcctgggcgacagaacaagactccatctcaaaaaaaagagaatgccccgcccagagccggtggggtcggggagggaatgcagggcaccagattgcttctgcatggagatcccgtctgccttggacactgttctccaggaggggttggtgcctccctacagggaagccccaggcccaactgtccttcccccacctagtgccctcaccagccctgatgtcaccttcaagtggattaggattcacatgttggaaaattgccactttatcttgatgtttattagaaaacattctcttcctgcctgtcaaaagtccacagtacagacacaaatcgtctatgctcacagtagaaataatgctcccttagttgtgcagtgagcatcctgcacagctgtccatgacagacctgaatccgcactctgtacctgccttccccaaacctcttttgtcacagctctcagaccctgttcagtcttctctcagggaagtggggggagccaggagcctggatggctgcagagtgcactggtgacatgcctttgggattccagggctggacagacaaccggctgaagtggaatgctgaagaatttggaaacatcagtgtcctgcgcctccccccggacatggtgtggctcccagagattgtgctggagaacaagttgagccaagccctccctgacctcccctctgtcaccctgcctcctttccttaagcctcctctgcctcccccaactctgccagtcgtgagtggccagagctcactatggttcttgtccctgtcccccagcaatgacggctccttccagatctcctactcctgcaacgtgcttgtctaccactacggcttcgtgtactggctgccacctgccatcttccgctcctcctgccccatctctgtcacctatttccccttcgactggcagaactgctccctcaagttcaggtgtgcccttttctccagccacccctcaccccaaagcaccctgccagaggccaaagaaggtgactgaagcaccctcagacagaggcccctgccctgtctggattagtgctgccctccccacaatggtcctcccttaccagcccttccccactctgtggccccagccactggccgagtgtcactctctgcccattgccctccccagttccctcaagtatacggccaaagagatcaccctgagcctgaaacaggatgccaaggagaaccgcacctaccccgtggagtggatcatcattgatcctgaaggcttcacaggtgctgggaacagccgccagtgggtgggcaggtccctcagacacacacagacacactggccctgtccaccccagagacacacacgtgcacacacacacacacttaggacaccaatacacagctcctcacacacgcagctagacacagaagggcagacacatatccgcccacagaggagcacacagacactcacacttcctgaatgcaaagctatcccaaaggcagagagagaaggtgccagggccctccccatgcctctgcccaggcccggaagtcatgcttctcccacatgagatgcctgtggctgacaggggtttagtctttcctgtgcctggtgagcccaggggtgtggttggcatgagggctgtgttatcctgatgggggtgtctgccacccctcctgacatcctcatccccgatctgtacccaggctcggatcctccatggggcctaccacttgccctgtccatcagaagggaccctgtctcactgtctcaggctggcacatcatggcagggatagttttactgtcactggctcattatccccaaggcccaggccgaggagtggctcaattaatgtccaggaggcttttctttgttactcaggaagacaggctcaatgtctgagagcatttgtttgacttggtgtcttaatctgcaatacctgtttttggctcgtgtatcttttgagccaaaagatactccttatttgagtcctgtatggcctcagcttctattttttccgaaaagataaaaaagaaatcagtcacagaggaagatttcccctcacagatggaaacttccatcccgaccccccagggaacgacacccaccaacgggaccccgtagacagcccatctgcgtctctggactggcttgccctgcccagcccctcattctgtccccaggccctgcctagcccccttggcctggcctgaccctaagatgtccatgtgccgccctcagagaacggggagtgggagatagtccaccggccggccagggtcaacgtggaccccagagcccctctggacagccccagccgccaggacatcaccttctacctcatcatccgccgcaagcccctcttctacatcatcaacatcctggtgccctgcgtgctcatctccttcatggtcaacctggtcttctacctaccggctgacagtgagcctccaggccccgtcccctgctccccctccccaagcccacctgagcacagccagccccagccctgccccctcacttcctcctgggagccacctggggtctccattcctggagctccctgcctggatccaggtgtgagggccaggtggccacccagagggagggctgtatgattctgggcaacatccccaaatggacagggcagggcatctccaagatgctacttcccacggactctcagaagaactgctaaactgtccctctgtcagggcagagaccaagtccctcacggtcaccagtgtgtgaccgtgggcctggcacacaggaggccctcaactgttgaaccagtgggtgaataacagggtctctaggacagtagggtgtgaggcagaaaacccatctatgctcacctgactctatgaggcagtggtttacaagttcagagtatttactatgagcagggcatagtgagtcccagggtcaaaggccacccagcccctgcccccggcaggacttgaggagggagaagtggggcaccttccatctgcagtggggttgggagggcttctagaggaggtggagtttgaatggacttgagcaggattgggtggggctaccacaggcaggaggagcaatgccaataaggagggggccaggcaggggctgaagggacctcagcaggggagccccccttcccgcccttgccatcacgtgcaggagctcaggtgggaagagcaagacagcactgggctggggtctctgagtgaggggctgggagttgaggtgttatcctggttctacaaggacaacctggcactttctaagcggggagtaacgcacgcaggtctgtgctccaggagggttcagtggcgtgggtgggttgtgacagctgattttcatgagcacttacccagtgccaggcagagtgatgcgtgttaaacacactctgtcaccacatttaacagttgagaaaactgatgcacagagaggttgggctacttgcccaaggtcacccagctagtaagtggcagagctgatatttgcacccaggcactctagctccataacccgtaattttcatcagggtatgatggtactacagaggtgccaggggccacagcgggaccctctaggaccggtgccccaaggtcacagctggaccctctaggaccggtgccccaaggtcacagctaagtctggcttccccaggtggtgagaagacatcagtggccatctcggtgctcctggctcagtctgtcttcctgctgctcatctccaagcgtctgcctgccacatccatggccatcccccttatcggcaagtgagtgacgctcaagcccggcctcaccctgcttgccagcccagccctgggagctccaagctgagtgtttgcccacaggttcctgctcttcggcatggtgctggtcaccatggttgtggtgatctgtgtcatcgtgctcaacatccacttccgaacacccagcacccatgtgctgtctgagggggtcaagaaggtgagtacttggcccggcgcaaaagctcaccactgtaatcctggcatttcaggaggctgaggcgggagaatctcttgagcccaggagttggagaccagcctgggcaacatagagacacccctgtctctataaacaatcaaaaaaattagccaagtgtggtggcgcatgcttgtattcccagctactcaagaggctgaggtggatcacttgagcctgggaggtcaaagctgcagtgagctgtgatcgcgccagggcactccagcctgggcaacagagtgagaccttgtctcaaaaaaaaaaaaaaaaaaaaaaaaaaagaaatgagcactctcaatagccaaaagctggagactaagccaggtacagtggctcacacctggagtctcagctactcgggaggctgaggtgggaggatccctggaacccaggagttggaggttgcaatgtactatgatcacagttgcaccccagtctgggcaacagatcgagaccccatctctaaaaaaataaaataaaatgaaaagcagggaccgggtgtggtagctcacacctataatcccagcactttgggtggctgaggcgggtggatcacctgaggtcaagagttcgagaccaccctggccaacatggtgaaactccatctctactaaaaattcaaaaattagccaggcgtgatagtgtgcgcttgtaatcccagctactcggggggctgaggtacgagaatcgcttgaactcgggaggtggaggttgcagtgagccgagatctcaccactgcactccagcctgggcgacaagagacaagagcgaaactctgtctccaaaaaaaaaaaaaaaaaaaaaaaatctggaacttgtccaaaggccatctgtagaatgggtaaagacactggacatatactcccacgggagtgccgctcagccgtgcagaagcacctgcggctgctgcagccctgcacgtgtgaacctcctggcacagtgttccgtgaaagaaaccagacgcagcagcacatgctgcaggcctcactttgtaagaagttcaagaacaggccaaatcagtgtttggtgatggaagtcagaatggtggctatctctggggctgggagggtactgagtgggggcaggtgtgagggagatttttggggatcatgttcactatctcatcactggtgatttacccagtggaatgcatctgtaaaaattcatctagctatatacttaagatgtgctcattccactgtatgctgcaactcagaaggaagaaggggaggactgagtgcagggtgctcaggagggggctgcccttgcctctcggctgctgcagggccggctggctgttctgggacagctgaaggcagtttagcaactcttttttttcttttttgagatggagtctccctctgtcgcccaggctggagtgcagtggttcgatctcagctcactgcaacctctgcctcccaggttcaagtgattttcatgcctcagcctcctaagtagctgggattacaggcgcccgccaccatgcctggctaatttttgtatttttagtagcgatgggtttcaccacgttggccatgctggtctcgaactcctgacctcaagcgatccacctgcctcggcttcccaaagagctgggactataggcgtgagccactgtgcccggccttagcaactctttttgtctttcagcatttgatgggggagactctagcatttggagcatttaccttagtttttggtctttaattaatcatttttagtgaatgggttctgctccgcaccatgggtgatgtgggagagctggaagcaacctgcatgtgcatcagtaggagatcggggaatcaatgacagagtcagacgggggagcactttgtggcagccaggaatgaagtcacagatgttaggatgtgtaaaggtcaccccatgcttgtaaaatggcctttttggccagacacggtgcctcgcccgtaatcccagcactttgggaggccaagtcaggcagatcacgaggtcaggagagcaagaccatcctggccaaaatggtgaaaccccatctctactaaaaatacaaaaattagctgggcatggtggcgcgtgcctgtagtcccaactacttgggagactgaggcaagaaatcacttgaacccgagaggtggaggttgcagtgagccgagatcgcgccactgcactccagcctggtgacagaatgagactccgtctcaaaaacaaagaacaaaaaacaacgcctttcttgtggccccttgacatggccccagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcgagaagcagtcagagcggcatgggctggccaggcgcctcaccactgcacgtgggtccccgctggtcttggttttcagcccatctgtgggaggtgggtggaggcaggcctcacacccactctggcccctcgtctgtaggccggcccccagcaagctctgagcaggcccagcaggaactcttcaatgagctgaagccagctgtggatggggcaaacttcattgttaaccacatgagggaccagaacaattacaatgaggtaagggaccacaggattgccatgtacaggtgttcaagtagggcactgattaagtgtattctatcttaagagggcagggttccccttagaggcacacaccaacttagatgagggagttaatgtgacacagattccaggcccccccgccagggagagagaactcctgcctggcaccctatagcagcactggggccaggcacacacacataggcacacagctccaccctgtccaggccacactctgagcatcccttaggatcccttctttctcccagctgccaatcattttctgtccctactcagttccaagcctgatactccagacagaaccagacattttaaaggtagccatatatggttattcaacattatacaacttctaaaaactatctcttgagaaagggcaccttttcccagttcacatatgggctggcagcagccctgacttgctgagatgggggagaagaagagaggggtctatccaccttcctcagcccctaggagagacccctgggcctcagttcctctctagccccagagccctgtgctacagcagagagggaggctatggtctgttcccgcctcctcaacagagtgatcagccctgcctgtggccagaggggcctgggaccttgctggggacaagccagcattatcctgcaagcccgaggcagcctctgcaggcacactgagccgccctctgcctccatggctgggccccagcttgggggtggggctttgtggcctgaggcccttctcaccccactctctctgcccctacccacaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacagtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaaggtgtggggtagagcaggcaggaatctgcgccttcactctctggcccctccagcctccctcttcctacctacccttcaacctcaggcttctgaggcctcacctgggactgaggttgaggacacctccctccctccagaccccagagtatcctttcctagctctttctgccttgacctctctgcctaggtccctttgggaagttgaggactggagtggaaaggtcaggatcgacatccacaaagacttggggtcagcctgaggttgcacacacaatcctagaggaccagaacgcagcacctctccccaaagggtccctgccccccagcacctactcctctccaaattagggttgtcatgcattatttggggcatacatattctaaaaaatcattcgttgtttctctgaaatttgtcccctatttttatttgctaaatctagcaaccctatcccaaaggcagcctccactcaatcttatcctgagggccaaaggccaaggctgcaggaattgggagacaagggtctgtttgtatggtggtccacctccaagatggccccagtgatgcccagtattcacacccttgtgcagtcccctcactctgtaccagggtgggtctgggtaaccaatagaatgaggcagaagtgatggtacctcacttcccagatttggttaggaaagacactatggcctctttcttgctcattagccctcattctcacatcagttggatctctcactttggggaagccagctggcatgttaaggagccctatggagaggcccacatggcaaggaactaaggcctcctgccaacagccacgtgagtgaatgtggaagtggatcctctgccccagtagggccttcggatgagatcacagcccagtagacatcttatgtgcagccccatgaaagtccctaagccagaaccaccagctaagtgactcctggattcctgacccccagaaactgtgtgagataataaatgtgtgttgttttaagtgacaacgttttggtgtcatttgttacaccagcaatgtgaccttgagtgagctgctcctcatctcactcctcaccttccatcttctaatctgcaaaatgtgtgtctagtaagtcctagtcatggggtgttgtgaaaattgaatttctagtaggagcattttcatgtgacctgcacatttaatgggtggtgatttaacccatttccctcaggggggaattggtgacctcattaactcagatatacagaaggtgagatttttaatgtttagatgtaaccaaggaaaaagaaaaaccatttaaaaccaaaactgaccctagtaacttctgccttccagcatgaactattcacaaaattcaaggtacaaatctttaattgtcctgtctaaataggaaagccagtttgttctcacacctgtcaggtgagcaggaaatctgagacttccccaggaatagcccatcaactcagggagggtccgtcttgtgcacagagagtctagggccctcagccacagtctttgcttctctctgcctcatggtggcgctgctggcagcaggtcttggttcaaccaccaggtgagtcctcagttctattaggccctgctcaagtggctgtggacttccagagaagacaaccccaaaatgtcacacaaaaccgggggggtgcctcctgcacaggctcccagggtcaccacagtttccaccagaggcacccactcccccagcacggtggtgctgtcaggactggtccactctgactgacatagaactccatcttctgtccccaggaagccatgctcacaggcacagctttccgggaagccagagagtgttcct

SEQ ID NO: 11859 - DNA, 11758 bp, Human
  misc_feature (1)...(11758): n = A,T,C or G
gaaacaactttcctcttctcccattcatggccttcaaacatgctctgtttctctattggattccccatccatctgccttggcatcttcacaggttgatcccacagttttctcattttcaggaataaaagcccactccagtctaaatcaaaacttccctctcacatccatgccgggcacagtggctcacacctgtaatcccagcagtttgggaggccaaggcagaaggattgcttgggcccagaagttcaagaccaacctgggcaacatggcaagacctcctctctacaaaaaaatgtttaaaaataaaaaaattagccaggcatggtgcacacacctgtgattgtggtcccagctactcaggaggctgaggcaagaggattgtttgagctcaggaggtcgaggctgcagtgagccatgattgtggcacatgaaccccaacctgggtgacagagcaagactctgtatctaaaaaaaaaaaaaaaagatagcaaacttccttttcacatccaatttaaggcttgtcctcctcctcctcttagatctgactgagatctgggtccatattaaagactcctttagtacaacaaacaccatatatcctcacgtaagtccatgaatatctgacatttctcatatctactttctctcgatttattgatagataggtatacattgttttaattttatgggtacatagtaggtgtatatatgtatggggtacatgaaatgttttgatacaggcatgcaatatgaaataagcattcatggagaatggagtatccatcccctcaagcaaggataaacctttgagttacaaacaatccaattacactctttaaaggtgtacattttttttttttttgagacggagtctcactctgtcgcccaggctggagtggagtggcacgatcttggctcactgcagcctccacctcccaagttcaagccattctcctgcctcagcctcccgagtagctgggatcacaggcacatgccaccatgcctggctaatttttgtatttttagtagagacggagtttcaccaggttggccaggctggtcttgaacacctgatctcaggtgatccgcccatctcggcctctcaaagtgctgggattacaggtgcgagccatcgcgcctggcctagaggtgtacattttttaacagaaccattcaaaaggaggttgtggggatcatgacacttccatgctacagcattaatctcctaagaataaggatacactcccacataccatgacactctgttcacacctaaaaaaatttacatttattccagaatatcatctaatctccagtccgtgcttacatgtccccaattgtccccaaaacatcttttatagatttttttaaaattttgtttaaatgccatatccaatcgatatggcaatcaaatgcaaatccatattgcatttggttatgtctcttagtctttttgcataaggggggcctctctttaggatgcaaaatctttatcatctcttcttttccacttggggacttgggctgaaaatcaggagtggctggaacacgcccatttactgtttggttttgcaggttgttggagggtactacagaagaacatccctctggagaggggccgtgagcctggttggcctagactgagtgccctggcagagctcttcctcatgtgtgcagtgggaaagaagcccagatcagtccaaaggcctaacccccactcccagaccctaccctactcttcagagaaataggctccctaccctgaaccctaaagacagctgtaccttcatccccagggacccagcaccccttctggcctatccccaaagagtcaccctgggtcttaggtagtaggtggagctgagggataatggcccaaggccaagagttgatccttccaactttgttcagtgatccagctttcatatcaggtgatcaggacaaccaggccaatctgatagggggcggtgtttataaaaaggccactcacctagagccagaagctccacaccagccattacaaccctgccaatctcaagcacctgcctctacaggtacctttcttgggaccaatttacaatctctgggatccccaactatagaacctggaagctagtggggacagaaagacggggagcctgggctaggtgtaggggtcctgagttccgggctttgctacccagctcttgacttctgtttcccgattttaaatgagcagtttggactaagccatttttaaggagagcgatggggagggcttcccccttagcacaagggcagccctggccctggctgaagcccaaccccaacctccaagactgtgagaggatggggactcatccctggaggaggtgcccctcctggtattgataaagaatgccctggggagggggcatcacaggctatttgaaccagccctgggaccttggccacctcagtgtcactgggtagggggaactcctggtcccttgggtatatggaaggtatcagcagaaagccagcactggcagggactctttggtacaatacccagcatgcatgctgtgccaggggctgacaagggtgctgtccttggcttccccattttggagtggtcacttgcctctactccagccccagaagtggaaactgagatgatgtgtggaggagagagccagcgttcatgttgggaatcttgaggctcctttccagctctcagattctgtgatgctcaaagggtgagctctgtgggcacaggacgcatggtagatggagcttagtctttctggtatccagctgggagccaagcacagaacacgcatcagtgtttatcaaatgactgaggaaatgaatgaatgaatgtctccatctcaaccctcagcctggtccctccttttttccctgcagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaaggtgagcccggggtgcaggtggcaaggggcaccttgcagggcctgggtgcagcccctccctcccagctccagcatgcccacacagctgctgtgttgccaaggcctaggaaggctctggacacctcagaccagctgtgtgacctggagccgactcttccccttctctgggcctcagtttcctcatccttgaagcccccttctcagggctcctcaaagcccccaagaaaaaagccctggaaatggggccctagcagagtcctgcaatgtggggggcctatgagtgagaaagctttcattctgcagaaacctaaaccccaacagaggctaatccccagctctggtgtcacgttgcttccctgtgttcacactaaccttttccttctttgaaattggacccctggtgttattgggaggaagggtcaatggggcataaaatgacactttaagccatacccagggctgctaccagctcctgctgcaagctgcaaccccctgcctagagaccaagttgggaggataggggggtacccagccaccaggtacaggccaggggagtggagcaacgttcagcctttgaccttggaagtgccagaggtgcccctaagcttgtgccccctcagaacagtgtccgggacatcacgggtgccctgttcaagcacagcaagaaggggcctagagccagcggcaacctcatcccacaggagaagattgtcaaccttgtcaatgacatctttggagcaggtaggaaccagaaccttgcccctccatccaacaatgcctgctgttcacccacagccttgcccagcccctcagtccatgaaataacccaccaaccctacaccagatggtacaacatactgagatctggcttgggatcagggtttgagcctgggctatgccaccaattcccagtggagaaacagcaaagtccttctcctcccctaggcttcagtttccccatctgaacaataaggtgttctctggcctgtaagtctaggcccctataattccagcagctaattctgaaacctgtatctcaagtttatgttgaagagacccagcctctgtcttcaggaaactcacaggctagggccagagaaagctaatgctggatacatacatagcagatacttgggaaatgatggtttccttgtttctgtcttccttctttcctcaccttacactacacggttcaggatttgacacagtcaccacagccatctcctggagcctcatgtaccttgtgaccaagcctgagatacagaggaagatccagaaggagctgggtacatgggggcccccaaccctatagccaggagaagccttgagacccaggttgtttgttcagtctacaaacacctgttatgtgcctgctgtgtgcaagccctgggcacacagtagtgcctgcccttgcctagaagatgtgggaggttagtggggtcgcagacttgtgaatagacagtcttacataagagtgacatggggtataagaggggataattcatggggcagttagggcagcccctgagctctgcttgtcctctgtgttctacagacactgtgattggcagggagcggcggccccggctctctgacagaccccagctgccctacttggaggccttcatcctggagaccttccgacactcctccttcttgcccttcaccatcccccacaggtgaggcctgccggttctgccctcccacctctaaagtgcttgccatgttttctcttcctggcttctcagccctggccctggctcagcatctccttcccgacctcgttccccacagatcccggcctcagtctgcccccatccagtccaaacataatctaacccccagctctcaggagaaagttccacttgtgatctcagcgctcattcccctctgttcatattccctccctcccagtgccctctgtgccagtcaggtcggcctcaccctcacaagcatgaccctattggcctccaatcttgctaacgctgaaccttctgcctggaataccttctagcctcttctctgaccaccagaatcctacccttgctcaaagtcaatgccgacacgagcttcctctccccagaagccttttgactcatccagctggcacagcttcattcctgatgtcttataggacttacagccatcagcccttgatcatgccctggaattttaacaatgtcaagagagttagtgagcatttacttctacccaaacgttgttctagttattcctgcagtaagaggcctgaatccccagccaggctagaaattccccggggctgccccaggctgcctgctgcttttttttttttttttttttttttcatagaaaatagaaaaacatttatctgaaattgcctgcttcttggctccagagaacagccaagtgcgcagccaggcgcaaagagaagtttagtaaatacttgctgaagttaaagaacaggacgcaaggaagagggaggatgtttctacctcttccctgttcctcccctcccctcccagtgtagggatggagatggcggtgggcaggctgtctggatggggtggaggtaggagcaacacatgccccagctttccagccctgagcctcacagtgccctcttccctcctcagcacaacaagggacacaacgctgaatggcttctacatccccaagaaatgctgtgtcttcgtaaaccagtggcaggtcaaccatgacccgtgagtacatacccctcacgaaaaaatgtgtgcaggttcagcagtcaggaaggctgtttgtccctgctaggaactgtttatataatgaaaggaggggacctcaattgctatagtctgctctaagtgacgatatttacaaaagtttcacaaactttagtgcacaggaatcaactaggatggccaggcgcagtggctcaagcctataatcccagcagtttgggaggccgaggcaggcagatcacttgaggtcaggagtttgagaccagcctgggcaacatggtgaaaccctatctctactaaaaatacaaaacaaaaattagccggacatggtggtgcgcctataatcccagctactccagaggctgaggcaggagaattgcttgaactctggaggtagaggctgcagtgagccgagatcgctccactgcactccagcctgggtgacggagtgagactctgcctcaaaaaaaaaaaaaaaaatcaaccaagacgtttgttacaggtgatggttcccccaggattctactgtggtatctaaggtggggtacctcaggcgattctgatgtgaatggctcagagacctctctttggaaagccccactttagtgtataggtagggggaccatatatataatttaccatccacactgggacatttgagtgtgaaaatgctatcaatgtttatgctagtcatcattactccaaaacaataaacataagccaggacatactgttgaggccccttaggaggcatattttgagtaggatgaagaaacgtatgtctttctttcttcctttcactttaatttttaaatagagacaaggtcttcctatgtggtccaggctggttttgaactcctgggttcaagggatcttcctgcctcagcctcccaaagtgctagggttacgggtgtaagccaccaaacccagcctgtttttcttcttttaatttcttttagataaagcattatttaaagtaaattaatattaaaaggcactatctttaaggctggtcattttagagagagctttgtaaaagaaataagcatcaggccaggtgtggtgactcatgcctgtaaccccagcactttgggagtccgaggaaggtggatcgcttgagctcatgagtctgagaccagtgaaaccccgtctctgcaaaaaaaaaaaaaaaaaaaaatacaaaaattagccggatatggtgcctgtagtcccagctacacgggaggctcaggtgggtggttggcttgagctggggaggcagagagagtgcagtgagctgagatcgcaccactgtactccagcctgggtgataggagccggagggtgtctcaaaaaaaaaaaaagaaagaaaagaaaaagaaataagcatcaaagttcagtttggttccttcccacctacccttcattgctttcaaagtgccctcacacttgtgttctcaacagaagtctccctcccccaggcacctcctcccagggcctctccagccctgaggtcccatctcctctgttcctcttgcagagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaattgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgtttttttttttttgagacagagtcttcctctgtctcctaagctggagtgcagtggcatcatctcagctcactgcaacctctgcctcccaggttcaagtgcttctccagcctcagcctcccaagtagctgagactacaggcacacaccaccacgcctggctaatttttgtatttttagtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatgagtggtcttttgtgactggcttctttcacttagcacaatgttttcaaggcttatgtgtgttgtggtgtgcgtcagtaagctcttggtgcttgagtcctgagactgggtctaggtctgtgctctcttaagtcgttgataggcacctccttcactcctctcctctcctttcatgttgtttgacccaagttttttaacaattgaagggaacaaggagaaagggatccagtctcaggggccaaacccagttgggtggatggggatccctcctgtcccattctcaaaaggcagaacacgtgacttctcacaaggccttgatttcttcattcacagcccgggaggggataagcttcccagaagtgcttaggttatttgaaaaaggcccaggtctcatcaaaggacactatcaagaaattgaaaggaggccaagcacagaggctcacgcctgtaatcccagcactttggaacgccaaggcaggcggatcacttgaggtcaggagtttgagaccagcctggacaacatagtgaaacctcatctctactaaatatacaaaaactagctgaatgtagtggctagcctcagctgctcaggagactgtaatctcagctgatcaggaggctgtaatcccagctactcaggaggctgaggcatgagaatcacttgaactcaggaggcaggggttgcagtgagctgagaccctgctgttgcactccagcctgggctacagagtgagactctgtctcaaaaaaaaaaaaaaaattgaaaagacaacccacagaatgagagaaaatatttgcaaaacatatagctgttgaagcatttatatatagaatatataaagaactcctggccgggcacgatgcctcacccctgtaattccagcacttcgggaggccaaggcaggtggatcatctgaggtcaggagtttgagaccagcctggccaacatggtgaaatcctgtctctactaaaaatacaaaaattagccaggcatggtggcgggcgactgtaatcccagctactcaggaggctgaggctggaaaatcgcttgaacccagggacagagtttgcagtctcactctgtcgcccaggctggagtgcagtggcaccatcttggcttactgcagcctcaacctcccaggctcaatcgatcctcccaccttgggacaacatatgcaggccaccatgcctggctgatttttctaatttttgtagagatggggttttaccatgttgcccaaactggtctcgaactcctgatctcaagtgatccacctgcttcagcctcccaaagtgctggaattacaggcatgagccactgcgccaagccaaaaaaatttttaagagtaaaacctggccaggcacagtggctcacgcctgtaatacctggcctttgggaggccaaggcgggtgnnnnnnnnnnnnnnnnnnnnttccaggtagcttgagacccctcctgttgcactccagcctgggcctacaagagtagactctgtctcaaaaaaaaaaaaaaaattgaaaagacaacccacagattgggagaaatattttgcaaaacatatagctgttgaagcatttatatatagaatatataaagactccctggccgggcacgatgcctcacccctgtaattccagccctttgggaggccaaggcaggtggatcatctgaggtcaggagtttgagaccagcctggccaacatggtgaaacctcgtctctactaaaaatacaaaaattattcgggagtgtggcacacacctgtaatcccagctacttgggaggctgaggcaggagaatcaaatgaacccaggagatggaggttgcagtgagctgagattgcgccactccactccagctgggcaacagagggagactctgtctcaaaaaaaaaaaaggtcggggcggtgctcacacctgtaatcccagcactttgagagaccgaggtgggtggatcacaaggtcaggagttcaagaccagcttggccaatatggtgaaacccc

SEQ ID NO: 11860 - DNA, 36643 bp, Human
gtgctagaattattaactaaattaatgtttattttgaaagtcactgattagattaatccacaagtattgaattttagtcaatcttggtggcccggtttaactggatgttttgcttaaaaggaaggcagcaagatgcaggggttatggtttccagccccagcttggtcacttgcattctgtgtgtccttagctaaagtactgaatctccatggtctaactttctcctctctaaactgggaataattttacagtgggcaaagataattgagagaataaaaagagatgtgatgagtgtgaaaattctctgtaaatttgtcataatgtctataaacataatcgataaaacattgtataactgggtcttaatattttcttaatgaaagagctggaaataactgtactggtcaatttagaataaaggtaatcttttcagagcatgcctttgtatacacactttgttattagtgatctagtaatgttcataaatccagttgtatttagatcttcatgaccattgactatcagttcccatttcaggtctgcacattgcagtggttctgtgccctgggtccattcagtgatttccctgtgttccatcttctgttgaatccacaactgttgttctgtgtataatttctcttccttgctgtgtatgattacattctattatttgtaacaataacagaccaaaaacaatagaagcagccatgtctggaggtgactggaaggtggagaagccatagattttcaagccctgtgccataaattatgtgagattggccctttccttaatagtgctgaacaactttcacttgtgaggtgatgcagaggggagaactctaatttttatttcttcttttgagcgtctccggtcctcttatccttataaacaaataacggacttctatttaatgtgaagcctgttgctttctgaacagagtcaaggtggcgtatcttcagagtaactaatgtctggggtttgttttgtttttctaaaattgttcttgagccagctgtggtgtaagtggtaatgaaccccaatgggtatcagaagatctctgctcaaatcccggttttaccggcaatgagctgtgtggcactgacaggtgtcctgttctcccagagtttctttcccaatttgaaaaataaaaaatgataatctttatactccagtctcttttaatgatgaatatacatttatatatatacttttatatatttaatataatatttaatagtataaatatgtatttatgttattattatgtaataatgtatgtaacactccctgctaattcagtttgtctctttgacatgtaaagtaaataatcacctattattataataatgtaataataacacaaatattattatgtaataacatatatatttatgtatattgtttatatacatttaaatatatataaatatacatttattagctaataatttgatatatgtatggtaattcaacatgtatgagttatattcactatttcatgtttaggcagctgtattttaagtgaactatactaaatatttgaaaggcttttgttatcaagggctaagtctcctattttttgatatagcattacaatgtacattttttatatacaaaatatagaatacactgatttccctcaaggtcataaattcccaactggtcattaatctgagaatattgaattttgagtatattctaacatagaatcatttacttcagtgtttctccatcatcacagcacattggaacaaccagggacttttaattaaaaatacctgggctccaatccaatacaattaaaccagaatctcctagattggcactggaaagaaggagtaggacaaaagaacattttatttctatccatgggccaaagtccactcagaaaaaaagtataaattggatctaggtgattgtttactttacatgtcaaagagacacacactaaattagcagggagtgttataaaaactttggagtgcaagctcacagctgtcttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatgtaagtctgccttatgttcctccagccaattgcaaagggtaagttatttgactgctatttttagacaaaatatattcctggaagcacactattataatagatcattgtaaagcaaaatactccctctgaacttctttgatgtttcttttgtcttcctatttttttttttttgagacggagtctcgctctattgcccaggctggagtgcagtggcactatctccactcactgcaagctctgcctcccaggttcacaccattctcctgcctcagcctcccccgagtaactgggactacaggtgccctccaccatgcccggctaattttttgtatgttttagtagagacagggtttcaccgtgttagccagaatggtctcagtctcctgacctcatgatctgcctgccttggcctcccaaagtgctgggattacatgtgtgagccaccgtacctggcctcttttgtctttctaagtctgtcattgtcagaaatagcggagtgagttgatgcattttgtgaatacagaaacattggggtcattgtattatataatcatttaatacagtggcaaaagtttaaagtgctgtttctcctctttgtttcacagtgttttgctatgatttttgactgaaggtgaagggaagtgtgtgtgattagaaatttcatccaataagttctctactatagtagtcatgtgttttattcagaatggtcatgaaaattgaacttctctgaagattcatttgatggctgatgtgaaataaatatctgtgggttcagggcaaacataagtgcatgaaagaaagaagtaatcagtcagggcccaataggtagttaacagaattcttttggattctgaagaaagccactgtctgtggccaaggttgctggagaatggaagaaattgttcttccaggagatgctgaatgtcctgattctaactttgtggtgcttcatcgttccatattggtaataccagcagttacaaactggactgggcattagaatcacctggggtgacactgtaaatacagatttctagggttcatcacaggactgctgtatcagaatcctcatgttaagagctttacaagtgaccctgaagtctttagctgggtagtggcctcaaggtggacatgggggattgattaattgctcaagcatcagtttaaattagcagagattccagtttggagcttctacatattacctgtgggactctgagaatgaatctgcaattctctggcctcagtttcttcatttttaaaacaggtcaaatgaatgtgctgaatgtgttgaagtgaggatgaactgtgtgatttgtgtaccaattgcctgggtcattgcgtggcacatcacaggccatctataagtggcagctataacaatcaccatcacatttatgtacaaaattcagaaatatcgaatctatgtgtggcaaatatgaacattaaaaaatacaatgaaaatgtcagtctgaatcatacatagtatttggagcaaatagcgacttattttgctgctatttgcatttcctttcccagttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggtaggtgcacatatttctgtgtcagctttggtaactggggtgagggggatggaaaacagagccctaaaaagcttctcagcagagcttagcctatctgcatggctgccgagtgttgcagcactttcttccttggctgtgaattctcccagtttctgcccctttttttattaggaatcatttccagcaatggaaagagatggaaggagatccggcgtttctccctcacaaccttgcggaattttgggatggggaagaggagcattgaggaccgtgttcaagaggaagctcactgccttgtggaggagttgagaaaaaccaagggtgggtgactctactctgcgtcattgaccttaacagttacctgtcttcactagtgacgtccttggaaacatttcaggggtggccaggtcttcattgcgcatcctggttgtcagccctcaggtggtggagggagatttgaagcacagagacaagggaggttttgtgtatctgtgctttgcctgtataaatgtgttggttcatagggtgtaggaataaaaggtcatttaatcctattttctgctcaattttgtttccttgttttcaaatcagaaattataaataagggtcttgagttcatttttgaagagttaaagaaggtttcccccatagcataaatctgcattacctccaccagaacatttcaccagagaacacttggaaagtggacatggtgaaagtgacctcatcacacttcatgaaatatgaaccaagttatatgtgctttcatttaattcgagttttttcatatggtcatactcacatgtctggaaattccttccaggtccatgcctacagctctggccagcaatgacactatgtatggttttacttgcttaggtatatctcagtacagttttcatcagttcttatttctcgggaaacacagtactatttgaaaactgtcaggattaattatttcttgttaaccactacttactgtagcaattaatatattttaagtaaatataatctatagtataactcagcaaatacacaaatactaatttgtaaataatttgtttaactagattttaactattatgaaaaactctttatcctgtcttctttaaatgtaatttggctatgttttcagttttgtcatcttttttcccctgtattggttcttagctttgaaatttgtgctaatcatttttctcccactgccaatttactcacctatgaagtgcttgttataatcaatctgattatcagctgggatataaaattacctttttaaattcactctcccaaatgcagtaaaaaaaaaaaaacctggatatcagattgtacctgagaaacacacacacacacacacacacacacacactctctctctctctctctctctctctctctctctcaccaaggcttcccaaattacctttcacccccttggctaaaacaacagtttttctgaaactttagagccctgtaatgtttaaaggagtctggcatagaagcagctaactcagcaggtttcttgttgttcaatgttccaactttattcacaaccctttcatttcgtgtcactcttatttaggacctatagatgtgaatttgggcaccctttccatttatgttcactagtcacttggttacagcaatttcattttagagattccttcaccgaataaaagcctttttaataatttctttacctgtaaaattacagatttggcctaacttatggtcaaatttaaaactttattaaaacatacttatcttgatgactatactgaataatatcccagaatccacaagagtagttttgcccaaatgaattaaatttggaagatgattggaaatgataaacattatttccaaaggaaggaaattcattttttacaaattgaaaaaataaataaaaagattccatttatcaatttactttttggttagctttactgggatttagatttgaaataaaaagttagcattttacttatttagataaacaaatctgttatacttaatgctcatttatattagtttttcttctcatatcatatggatgtacttgcttttcacatttgttccctaaaacacatgaattcacccacaatctccctaactttattcccattggttcagcacattatactttcagctatatgacatttctaggtccccaacttttctcttcctatctctgtgttttattgtccagaggctttgcaaacagacatgattctgctctaaaaacttgaattattaggatttcaaaaaagtcttctttttccttccaaaataaaagacacttggggttaaaagagtttaaataaaggcagtggatgtgaataaccacatgcgaaatgacattgtttagctagcctgtaatgctcaactcatatttaaggtaaaagtaatgtgtttatttcatccatgctgattttttttggacacatggggaatttgtaagatattgtttaaaatttctaaatttcctttatgtcttaacaaatgcaaatcttttaaatatttattttttaataatttttttaaaaatttttaaatctttagcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtaaggccaagattttattttccttggaaaccatttattcaaggttgtagggaagacttggtttaaaaatgagaaaattgatactaaaatgcttttatacaataaaaatgatgtatgagtgaagaaaataattaccacctttgatttcctgttcaaaattttcagcctccaatctttaggtacagaaaattgctatatgtgcacaataaaaatttccccatcagaagtgcaaggggtcagggaattccctttcctagccaagcaaagctgtgaacagatggcacctggaaaattgggtcactcccaccctaatactgtgcttttctagtggtcttagtaaatggcacaccaggagattatatcctgcacctggcttggagggtcccatgcccacgaagcctcactcattgccagcacagcagtctgagatccaactgcaaggcagcagcgaggctgggggaggggtgtccaccattgctgaggcttgagtaggtaaacaaaaccaccaggaagctcgatctgggtggagcctactgcagctcaaggaggcctgcctgcctctgtagaatccacttctcggggcagggcatagctgaacaaaaggcagcagaaacctctgcacacttaaatgtccctgtctgacagctttaaagagagtagtggttctcccagcatggagtatgagatctgagaatggacagacggtctcctcaagtgggtccctgacccctgaatagcctaactgggaggcaccccctagtaggggcagactgacacctcacagggctgggtacccctctgagacaaaacttccagaggaacgatcgggcagcaacatttgctgttcagcaatatttgctgttctgcagcctctgctgctgatacccaggcaaacagggtctggagtggacctccagcagactcgcggctgaggatcctgactgttagaaggaaatctaacaaacagaaaggacatccacaccaaaaccccatctgtacatcaccatcatcaaagaccaaaggtagataaaagcacaaagatgggggaaaaacacaacagaaaaactgaaaattctaaaaatcagagtgcctctcctcctccaaaggaatgcagctcctcaccagcaacggaacaaagctggatggggaatgactttgacgagctgagagaagaaggcttcagatgatcaaatttctccaacctaaaggaggaagctcaaacccatcgcaaagaagttaaaaaccttaaaaaaagattagatgaatggctaactagaataaccaatgcagagaagtccttaaaggacctgatggagctgaaaaccatggcaggagaactacgtgacacatgcacaagcttcagtagttgattcaatcaaatggaagaaagggtatcagtgattgaagatcaaacaaatgaaatgaagcgagaagagaagtttggagaaaaaagaataaaaagaaatgcacaaagcctccaagaaatatgggactatgtgaaaagaccaaatctacgtctgattggtgtatctgaaagtgacggggagaatggaactgagttggaaaacactctgcagggtattatccaggagaacttccccaacctaggaaggcaggctaacattcaaattcaggaaatacagagaacgccacaaagatactccttgagaagagcaactccaagacacataattgtcagattcaccaaagttgaaatgaaggaaaaaatgttaagggtagccattgagaaagggcgggttacccacaaagggaagcccatcagactaacagcggatctctcggcagaaactctacaagccagaagagagtggtggccaatattcaacattcttaaagaaaagaattttcaacccagaatttcatatccagccaaactaagcttcataagtgaaggagaaataaaatcctttacatacaagcaaatgctgagagattttgtcactaccaggcctgccctaaaagagctcctgaaggaagcactaaacatggaaaggaacaaccggtaccagccactgcaaaaacatcagattgtaaagaccatcaaggctcggaagaaactgcatcaactaacgagcaaaataaccagctaacatcataatgacaggatcaaattcaagcataacaatattaaccttaaatgtaaatgggttaaacgctccaattaaaagacacagactgggaaactggataaagagtcaagacccatcagtgtgctgtattgaggaaacccatctcatgtgcagagacgcacataggctcaaaataaagggaaggaggaagatctatcaagcaaatggaaaacaaaaaaaggcaggggttgcaatcctaatctctgataaaacagactttaaaccaacaaagattaaaagagacaaagaaggccattacataatggtaaagggatcaattcaataagaagagctaactatcctaaatatatatgcacccaatacaggagcacccagactcatcaagcaagtccttagagacctataaagagacttagactcccacacaacaataatgggagactttaacaccccactgtcaacattagacagatcaacgagacagaaagttaacaaggatatccaggaattgaactcagctctgcaccaagcggacctaatagacatctacagaactctccacccctaatcaacagaatatacattcttctcagcaccacaccacacttattccaaaattgaccacatagttggaagtaaagcactcctcagcagatgtaaaagaacagaaattacaacaaattgtctctcagaccacagcgcaatcaaactagaactcaggattaagaaactcactcaaaaccactcaactacatggacactgaacaacctgctcctgaatgactactgggtacctaaagaaatgaaggcagaaataaagatgttctttgaaaccaatgagaacaaagacacaacataccagaatctctgggacacatttaatgcagtgtgtagagggaaatttatagcactaaatacccacaagagaaagcaggaaagatctaaaattgacaccctaacatcacaattgaaagaactagagaagcaagaacaaacacattcaaaagctagcagaaggcaagaaataactaagatcagagcagaactgaaggaaatagagacacaaaaaacccttcaaaaaatcaatgaatccaggagctagttttttgaagatcaacaaaattgatagaccattaggaagactaataaagaagaaaagagagaaaactcaaatagatacaataaaaaatgataaaggggatatcacaaccgatcccacagaaatacaaattaccatcagagcatactataaacacctctacacaagtaaattagaaaatctagaagaaatggataaatttctccacacatacaccctcccaagactaaaccaggaagaagttgaatctctgaatagaccaataacaggctctgaaattgaggcaataattaacagcttaccaaccaaaaaaagtccaggaccaggtggattcacagccaaattctatcagaggtacaaggaggagctggtaccattccttctgaaattattccaatcaatagaaaaagagggaatcctccctaactcattttatgaggccagcatcatcctgataacaaagcctggcagagacacaacaaaaaacgagaattttagaccaatatccctgatgaacatcaatgcaagaatcctcaataaattacggcaaactgaatccagcagcacataaaaagcttatccaccacgatcaagtgggcatcatccctgggatgcaaggctggttcaatatacgcaaatcagtaaatgtaatccagcatataaacagaaccaagacaaaaaccacatgattatctcaatagatgcagaaaaggccttttaaaaaattcaacagcacttcagtctaaaaacactcaataaattaggtattgatgggacgtatctaaaaataataagagctatttatgacaaacccacagccagtatcatactgaatgggcaaaaactggaagcattccctttgaaaactggcacaagacagggatgccctctctcaccactcctattcaacatagtgttggaggttctggccaaggcaatcaggcaggggaaagaaataaaaggtattcagttagaaaaagaggaactcaaattgtccctgtttgcagatgacatgactgtatatctagaaaaccccatcatctcagcccaaaatctccttaagctgataagcaacttcagcaatgtctcgggatacaaaatcaatgtgcaaaaatcacaaacattcctctacaccaataacagacaaacagagagccaaatcatgagtgaacttccattcacaattgcttcaaagagaataaaatacctaggaatccaacttacaagggacgtgaaggacctcttcaaggagaactacaaacaactgctcaacaaaataaaagaggctacaaacaaatggaagaacattccatgctcatgggtaggaaaaatcaatatcatgaaaatggccatactgcccaaggtaatttatagattcaatgccatccccatcaagcaccaatgactttcttcacagaattggaaaaaactactttaaagttcatatggaaccaaaaaagagcccgcattgtcaagtcaatcctaagccaaaagaacaaagctggaggcatcaggctacctgacttcaaactattctacaaggctgcattaaccaaaacagcttggtactggtaccaaaacagagatatagaccaatggaacaaaacagagccctcagaaataataccacagatctacaactatctgatctttgacaaacctgacaaaaacaagaaatggggaaaggattccctattcaacaaatgttgctgggaaaactggctagccacatgtagaaagctgaaactggatcccttccttacaccttatacaaaaattaattcaagatggatcaaagacttaaatgttagacctaaaaccataaaaattctagaagaaaacctaggcaataccattcaggacataggcatgggcaaggacttcatgtctaaaacaccaaaagcaatggcaacaaaagccaaaattgacaaatgggacctaataaaactaaagagcttctgcaaagcaaaagaaactaccatcagagtgaataggcatcctacagaatgggagaaaaattttgctatctactcatctgacaaagggctaatatccagaatctacaatgaactcaaacaaatttacaagaaaaaaaccaaacaaccccatcaacaagtgggcaaaggatacgaacagacacttctcaaaaggacatttatgcagccaaaaaacacatgaaaaaatgctcatcatcactggccatcagagaaatgcaaatcaaaaccacaatgagataccatttcacaccagttagaatggcaatcattaaaaagtcaggaaacaacaggttctggagaggatgtggagaaataggagcacttttacactgttggtgggactgtaaactagttcaaccattatgaaagacagtgtggtgattcctcagggatctagaactagaaataccatttgacccagccatcccattactgggtatataccctaaggattataagtcatgctgctttaaagacacatgcacacgtatgtttattgtggcactattcacaatagcaaagacttggaaccaagccaaatgtgcaacaatgatagactggattaagaaaatgtggcacatagacaccatggaatctatgcagccataaaaaaggatgagttcatgttctttgtagggacatggatgaagctagaaaccatcgttctcagcatactatcacaaggacaaaaaaaccaaacactgcatattctcattcataggtgggaattgaacaatgagaacacttgaacacaggaaggggaacattacacactggggtctgttgtgtggtggggggagggggaagggatagcattgggagatatacctaatgtatatgacgagttattgggtgcagtacaccaacctggcacatgtatacatatgtgacaaacctgcactttgtgcacatataccctagaacttaaagtataataaaaaatgtatatatgtataaaaatttcccttcaaaatggacatgatgtcttattcatatttatagttataatttcaatcagggcttggtgtaagatacatatatcttatgacatgtttatatttaatattcttttctcttttaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatcgattgcttcctgatcaaaatggagcaggtaagatattagcaacagatcagtattttgatttcttgtccattttgtgattcatcgaatccttctgtaatttactaaggatgtttaaatgatcaggccagtaatgcttgacaagcatcttaattacttattgtatttatgggcctgcactaaacatcatggaaaatacaaaattgtccaatggctagaatgcatagaccctcttcttgaaataaaaataatctacatgagtagaataatatagacactgcagtcaaatggaaacaattataaataagtagaaaatacaaaatatcctaccacaaactgaagatgaatatcaatattgcacatagattatgtgacaatggaaaagaatggcttatcataaatgggcttcctgtatgccctgcacattgacatagcccttaatatattttcagtgtggaacagaagaaaggtttcagatggaatgagtagtttgtggagaggtgagtggtgggaaagagttggtggatggaagagagaaggtttaatttagtgtaacctaaaatgaatttgcacaaaggagttggaggttgatgtttatcaggtaacctgtgagagtgaatcctgttttcattgaactatttattgaaaaagtatattttttcctattgaattgtcttgacaacctcattaaaaaccagttgagtataaatgtgaggatttgtttgtgggctctcaattctactccattggtctgtctgtccttatgtcagtagtacctcattttgaagtcttaattactgtagttttgtgtcaagttttcaaatcaaaaagtatgagtcctcaaagcttttttcaagactatttgggcttttttgtgttcattcagtcgcaacaaaaatttaagaataaacttgtcaatttctgcaaacaagcccataggaattttaagattgcattaaatctatagattaattcagaaaattatgacattttaaatattgagatgaaattcatataccatatatcacccaatttaaagtgtacactttaatggtattttgtttaattacaatactgtgcaactgaggtaggaggtgggagtcaactccagaggtgggtcttggacatgggaccagattgatggctagctaaaacagggccaggatgaaagcagctttcaatcattcctgcccaccagtatgccgtgtcaatttactattcccatggcaacacccaggagttacctcccctttccatggcacccaatgatccaaaagataggaccccttccttgcacaaactgtcccttaatatgcatgcaattaaaagtgggtataaaaatgaccacaaaactgccctgagcttctactctctgcctatatcatagccctgctctgcaggagccctcgcagagctgtaccactgcctgttcaacaaagctgttttcttctacctctgagttgcctttgaattcttttctgggcaaagccaggaaccctcccaggctaagctccacattgggactcgcctgccctgcatcacaactaccattcctctctactttcaaaacttttttatcactccacagaaacatactatatcattaaatagttacacctcattcccaactccatcatgtagtaaacattaatcaactatctttatggatttgcctataatgagtataacatttgacccatggcatatgtgatcttttttcctggcttctttcacttagcataatgatatggagggtcaactaagatttagcatgtgatagtactttgttgttttgtgtggttcaataatattccattttcatgtacacatatgacaatttgcttatcattcatctgttgatgatcatttgtgttattttcaccttttggctcttataaataatgttgctatgaacatttgtatacaagttacttcatgaatatattttcatttttccagggtatagtcctaggagtgttatttctgggtcatatggtaattttatgtttaactttttgagaaacaactaaacatttctacagtaaatgcaccattttaaaatcccatcagcaatgtttgagggttcctcttttccatattatagccaatatttgtaattttctgttttttgtgtcagtgcaaagtggtatttcattgtggttttgacttgacctatgatattaattagctttttaccatttttacatgttctttagagaaatgttattcaaggcccttgttcatttttattttattttatttatttattttggagacaaggcctctctgtgttgctcaggttggagtacagtgctgtcatcttggctcactgcaacctctgactcttggtctcaagtgattctcctacctcagcctcccaagtagctaggagcacaggcacaaacccccacacccagctaatttttgtattttttttgtacaaacttggtttcaccatgtttcctaggctggtctcaaactcctgagctcaagcagtccacccatgttggccctcccaaagcactgggattgcagttgtgaggcaccacacctggccctttgcttatttctatactgggttgcttgtcatttgttgttgaactgtaggtaattgtttatggattctgggcattaaacccttactaaatacgtatgaaatacaaatattttctcccattctacaggttgtcatttcacatttttaattttgtcctttgatgaacaaacattttaatttggtgaggcccagtttatctctcttattttagttgttttggtgtcaaatctatgcatccacttccaattctgaaggcattaatatttaaccgatgttttattctaagaattgtatagttttagttcacatttaagtttttcgttcactttcagttatattttgcataagagtgagataggggttcaacttcattcttttgtatgtggctacccagttgtcccagcactgtttgttgaagaaacgcttcctttatttatttatttttttttgaaactcttcctttagattaaatgatcttggtacatttgttgaaaatgaaccgggcatagatgattaggtttatgtttggatttcaattttattccactggtctttatttctttccttttgccagtaccatgctgttttgactactatagttttgttttgaagtctggaaatttggaaattgagtcctctccctgtagttgcatataaattcaggattggcttttccatttttgcacaaataaaaattttaaaaaggacattggaattgtgacagtgattacattcaatctttagattacttttggaagcattgccatcttaacaattttaagtctttcattattattattattatactttaagttttagggtacatgtgcacaatgtgcacatttgttacatatgtatacgtgtgccatttcaatcctttaaaatgacatggtttgccatttatttagatactccttatttttctaagcaacatttcatagttttcagtcttttatcttcttgattataggttctcagggcttttggcccttttgatgctattgcaaatgtaactatttccttgattttattttcatattgctcattgctgatataaacagacacaactgatatctggaccaatcttacatcctaaaattaagctgaaaacatttatcagctctagttgttttttgtgggttatatggacttttctttatatataattgtgttatcttaaaatagaaatagttttacgtcttcctttcttacctaaatgccttttatttctctttcttgtctaattgttttggctaggaccttaagtgctatgctgaatagcagtagtgaaattggatatacttggatcttttccccctgattttggggtataagcttttagattttcacaatttgatataaaatacctttggaatttttataaatacattttctcataagaaatttcccttctattcatatctttgagtgattttatcaggaaaagtattgaattttgtcttatgctttctcagcttctattcagatggtctatcttgttagatttttcctttctttctaatatggtggtgtattacattgattgattttcttattgaagcactcttgcactcctcatatagatcccatttagttatggcacataatccttaattttttttaaaaaaatccataatatacaagttgctacattatttctctttcttgtctaattgttttggctgggaccttaagaacgatgctgaatagcagtagtaaaagtagatatacttgggtttttttaccccctgattttagggcataagcttttagattttcacaatttgatataaaacatctttggaatttttataaatacattttattatgataaggaattttcccttctattcatatttttgagtgattttttatattatactttaggttctgggatacatgtgcagaatgtgcaggtttgttacataggtatacatgtgccatggtggtttgctgcacccatcaacctgtcatctaggttttaagccccgcatgaattaagtatttgtcccagtgctctccctccccttgctccccaccccccaacaggccctggtgtgtcatgtttccctccctgtgtccatgtgttctcattgttcaactcccacttttgagtgagaacatgcagtgtttggttttctgttcctgtgttagtttgctgagaacgacgtttccagcttcatccatgtccctgaaaaggacatgaattcattcttttttatggctgcatagtactccatggtgcatatgtgccatattttctttatctagtctatcactgatgggcatttgggttggttccaagtctttgctattgtaaatagtgctgcaataaacacacttgtacatgtgtctttagagtagaatgatttataatcctttgagtatatacccagtaatgggattgctgggtcaaatggtatttctggttttagattcttgaggaattgccacactgtcttccacaatgactgaagtaatttacactcccaccaacagtgtaaaagtgtttctatttctctgcatcatcgccagcatctgttgtttcctgactttttaatgatcaccattctaactggtgtgagatggtatctcattgttaattttatgtgtggatattgtaaatgggattactttttaaaattattttttaaattgttcgctgtaggaatatagaaatactaccgatttttgtatattattttgtatcttgcaactttacggaatttgtttattatttctcatagttttttagtggagtctttatgtttttttaaatataagattatattctctgcaaatgagtataatttgacttcttccattctaattgggatcccctttgtatctttctctgattgctctagctaggtattccagtacaatgttgaataacagtggtgaaagtaagcatccttgttgttttccagaccttagaggaaaggcttttagtttttccctatttagtatgttactagctgttggtcttttgtagatagcttttactatggtgaggtatgttccttctataccctgttttttttagggcttttaccatgaaggggtgttgaattttatcgaataatttttcagtatcaattgaagtgaccatatgctttcgttctttattctgttgatatgatgtaccacatcaattaattggcatatgttaaagcacccttgcatacagggataaatcccacttggttgtgatgagtgagctctttaatgtattcattaatttggtttgcagctattttcttgaggatttttgcatgaatattcctcagagacattggcctataacttttttttttaatgtgtctttggttttgttatcagagtaatactggccttatagaattaatttggaagtattccctccttcactattttgtggaatagtttgagtaggattggtattagttctttaaatatttgctagaattcatcattgaagtcattgggtcttgagcttttctctactaggatgctttctcttgagttcaatctgattatttgctataattttgttcaggttttggatttcttcatggttcaatttcagtaggttgtatgtatctaggaatttgttcattacttctaagttttccaatttattggtatatagttgttcatggtagccaccaatgatcctttgaatacctgtgatatcagttgtaatgccttctttttcatctctgacttatttggatcatgtcacatttttccttagtctggctaaaggtttgtcagctttctttaatgcttctaaagaacaactttttgctttgttaatattttgtattgttttctttatttcaatttatttctgctctgagtttattatttcttttctcctactaattttgggtttggtttgctccagctttcgtagttttttaaagtatattgttaggttgtttatttgatgtttttcttctattttgatagttgacacttacagctattaactttattcttagtaccacttttgctgaatcccataggttttgatatgctgtgttttctcatcatttgtttcaagaaatttttcaattttcttcttaatttcttcattgtcccactgttcactcagaagcatattgtttaattttcatgtatttgaacttatacaaaattgacttaagctggattaatgacttaaatgtaagctccaaaactataaaaaccctagcagaaaatctgggcaatacaattcaggacatctttgggagttttattattaaattcctggaagtagtcttcattgggtttaatctgcttggtgttctatcagcttcttgtacttagatagtgatacctttctctagttttggaaagttctctgttattttcccttaaataaattttctactcccttctctttctctacctcctctttaaggccaataactcttagatttgcattttgagactattttctagatcctgtaggtgtgcttcattgttttttattcttttttcttttgtctcttctaacagtattttcaaatagcttgtgttaaagctcactaattctttcttctgctggatcaattctattctattattctactaaagactccaatgcattcttcagtatgccaattgcatgtttcagctccacaatctctgcttgactcttgtaaattatttcagtctcttcgttatgtttatctgatagaattgtgaatttcttctctgtgttattttgaatatctttaggtttcctcaaaacaactatcttatattctctggctgaaagatcacacatctctgtttctccaggattggtccctggtgccttatttagttcgtgtggtgaggtcatgttttcctggattttctttatacttgtagatattcatcgggggctgggcattctagagttaggtatttttgttgtctttgtagtctggggttttttttgtacacatccttcttgttaggctttccagatattaaaaaggacttaacctattttcgatttgcccctagaatactgcaccggcagtgaactgcactttttttaataaatgggaaatgagttaagtgttgtgatctaagctgtatctgctttaggggcactccaagcccaataatgcagtggttcttgaagacttgtagaggtactgccttgatggtcttggacaagatccaagagaattctctggattaccagaaactcttgttcccttcccttaatttctcccaaataaacaaagtctctctctctgttctgagtcaattgaaactggggatggaatgacacaagcactcatgtatccaccaccactgtgactgcactgggtgagacttaaaacaagcagagcactgggtcttgcccaaagcttgctgcaaccattccctggctactgcctatgtttccaaggatctggggccctacaatcagttggtggtgaatccagccaggcctgtgtccttcccttcagtgaagcaaattcttccagtacccaggcatgtccagaggtaccacccagaagccagggactagagtcaaaaaccttagaagtctatttggtgttctattgtactgcagctgagctgacactcaaaccacaaaatgcagtccttctcactcttccctttcctttccaaaggcagtggaatctcaccccctgagcagtgctaccacaggcccatgcagaatacagaccctgtacaagagccaagtcctggttttggagagtccaggagtgcacttggtgctctaccctcctgtgatcaagctagtacctagttgcaagacaaagtcgactttatatttcactctgatttctcaagtagaaggagtctttcctgatagccagctagctgggaatgtgttgagtcttacctgaagccggtaagcctcagagacttacccaaagccctcaacatagtacctgggtattgctgctagctattcaagccccccactcctcaagcagaagaaagcagtttcttttggaagtgaaaactgtgcagcttgggattaggagaggggggatgtcagcactcccttacccatccccagctgctgtctcagtaggttgcacctcccaccccagtctactgtctctgggcccagttcagcaccaggactcacataaaagttacagtacttgtagccaacactgcctttcaggtttatttaccatcccagagccctatagtccacagtgatgaggcttgtagaaactcggttccaaccactggtatcagagattcacctctggccagggctggtttaaatgctccctctgtgagtgggcatcagctgattttgggcctgttttcctttctgccttaacagaactgcactaattttatgctctataattgctgtgctctccctccctcagtactcagaaatactctctgaaccatgccactgctgccaggggaagagaggatgtcagtaattcaatagtattttttctatctcttcatttcctctttcagtgatatatatttaaatcaaggtgcatgctcatctgattttggttcttatgaaggtacattttgtgtagatagctgttaaactgatgtctttgcttggggaataatcaatgaagcattcaattctgtcatcttgctccactctcccatttgtatatcttcttttgagaaatttctgttcatgttgtttgcccactttctaatgggattattcggatttttttcttgctgttttgagtttcttgtagactctggaaaatagtcctttgttgaaggtatattttgcaaatattttctcccattctgtaggttgtatgtttactctgcttgtcatttcttttactgtgcagaagctctttagtttaattaggtcccattgtcaactgtttttgttgaaattgcttttaaacattgagtcataaatccttagcctacaccaatgctcagaagagttttttataggttttttctagaatttttatgatttcaagtctcatatttaagtctttagtccatcttgagttaatttttgtatgtggtgagatataagaatcatatttcattcttctacatgttcccctgggtaatatcagccaagcacaaatcccgcagctaccagcgtaggtggctctttcctgcaagaaccacctcctagctggaagccaataggcacagcctattacaacatctgctggcaaaataacatagcatttgggaaggagaaaacttttatcgtatctcagctaacaccatacccacatcaccccagctaatcggaaggtcttgagtgtgttcacaaacccaatacattgctagtacagctggcatttgagaaaattaccacactaaacctatttataaccaagtaaatcttacaaagtctatgtcactctcttgccacctcgatcagaggtggtgcttgcacctgctgctaggagaccagaggacagttaggcccagttaagccccattcaacattgccctcctttgtagcaaagagtggaacccaagcactgtacatctctcaaacctttccacagcctgaggcatcagagatttccagttggctgacaaagatgtcaatgttcaattatcctcagaaggaagagccaatattacaggtgaataatcataagccaaatggactgttaaagagagagcaatggagcttattggtcaattcataagaagaaagaatctacaactcacaaacacgcacacacacatacacacaaataaagtaaaaagaagctggcagaggtgaaaccctgagagacttagtaatccatggaaagggcaggtaggagtgttctcagcctccctacccaatttggcagactgctgggatctgaactcaaggtgaccttccttgccttcatgagcacaagtactggagtaggctgtggttttgagacttctcgaggatattaccttgttcacacaaggtccctttccttttccttggatctgagctgtttttaactattttggtagaattcactagtgaagtaatcttgagctggaactttttttgaggggggtggagttcttgattactaattcaaataattttcttattgtaggtgtattcacactttcaatttatgagaactttattcgattagtcccttggccttggcatttgcattgcccctactcttctttatccaatataggcagttaatgcctcaagtttttgtattaataattgccatttctcttcactttgtattttcctatttattcctgaacttattcctaagaataagttgcctgttgcctatctggattacaactttgttagacctgtcttgtctttgtgaactcattctctttcactatatttcattcttggttttgttgacatatttgttttacacatttcagctttgtaatgaatatgtaggtgatactgagtctttgtaaatttttgacagaagaaaattgcaaactcttgattcaagagtgtaacacttttcatgatatagccctaatttacctatatctataaactaaaattgtgttcacttacaaataataaaaaaatcataaaaatgaatgtgttaggctgttcttgcatttctataaagaaatatctgaggccagataatttataagaacatgaggcccaattggctcacggttctgcaggctgtacaagcatgatgcttgcatctgctcagcttttggagagtcctcagggagtatttgctcatagcagaaggcaaagcaggaacaggcacgtcacatggcaagaggagaagcaagttggggaaacagttttaaaaaaccagatcttatgtgaactcacttattatcaggataacatcaagggaaataatgctcatgagaaatctacccccatgacccaatcacctctcaccagattccacctataacaatggggattaagtttcaacaaaagatttgggagagataaatatttattatccaaactatatcaagagcttaatcaaatagttggcttatatatctcaaatacaagaagtcttatagtgggctagactagaaataatatggtagccctgaagcatgagagagtcaagtgccttcttttttttttttttttttttaccatatttagtatagaagtcttcattactatgatcaaatgctcatgtcccaagatgatgtcaatcctacctcccccttcacatttgtgttttgagtaatgaggagaaaagagaagaagattcatgttctggtttgaatgtgtcctctacagttcatgtgctaaaagtgaatgcccaatgcaacagtgtttgtgggtgcagcctaacaaaacatgactaggtcatcagtgttctgacctcataaatatactcatgttgttattgcaagagtggggtagttcttgatagcttgttataaatgtgagtgtgccccccccaattgctctcactcttaccctttcttgcccttctactttttgccatgcaatgaaataggatgaaggccattgccagaagccagtgccatgctcttggacttcccagccttcagaatcatcagaaataaatttcttttctttataaattaccaagtctatagtattctgttttataacacaaattgaagtaagacagggcatcagtatacttctgcttttatttctggggaaagaaatattctgtgtgactaacctaagcagcgaatgatttcatgaatggaacttgtaggtctgtcaggaaataaagtttgagtcaactgatctgcagtttctgccataccacacagttgctttttctaatactgtactgtccagtatctcttttggctaactttaaaaaatagtatgttttttaaaatttagtgtatttagatatactggcacataatttgtcagataattgcatgaaatcacttctaggaaaaggacaaccaaaagtcagaattcaatattgaaaacttggttggcactgtagctgatctatttgttgctggaacagagacaacaagcaccactctgagatatggactcctgctcctgctgaagcacccagaggtcacaggtaggaccacagatgatgaacaaagtgaatttcagaacaatgctgagaagatggtgccagtatcctccaccttgtttctctcagagaaggctcattctttaaatttctgtgtcatcagctgtaatctgtctaaatttgatgacacaatttaaaatgacatctttgtacaatggaggaggatgacagagatcagtaaaaacagtatggcagtagcaaaataagtaaagcactgatgaagtgtctggatttcagcaaaggtaatttgtggtaaggagagccagcataaattgccctagtattgaatgttggttttattatgaaaagtccactttgaacagtaggttcatttctcattttaaaaattccatgctctaatgctgtggtggggagatgaaaacaatctttattgaagcataagtggaaattctagaattgtactgaggcatcctgacataaattccagtctgggaagtaatctaaaagttagtctcttacaaaggtgtttctatttaagcagaggccatacctaaaggaattttattattctaggagtgtgtttcataaaaatgctatttgaccaaatagggatatttggaagggggtttaataattgcatctttcacatacaacttttctttagaatttacaatttacctttagagtaaactctacatttccttagaatttacatttaaatagttcctgctttgcagcagataacatacctttttccctgtgtcaggatcccactgaaatttcaataactaaattacaaattaaaattatcctgctgaagtgaaaagagaggagaatagaaaatagccaataagtctttggcaaatttctaaaacatggagagacaatggagggctgacaattgacacagcatagaggatggagttgtaagtattagcagaggaagatttatcaagaggagaagctaatctgtgtcactgtgattctcataaggttcagtatttggaggcaccaagagccaaagacagtagggaatgagactgaaaagggaggctctcctgcccaagtttcctccataactccttttatcaggtacctgattttttcccactgggaaagggaagcatactctccagagaaactgagcctaagaacccctgtactcggcgacactttacagggccaggaaactgtgagatgtgaagacagaaaaaaaaaaggtttgagaaagatctattcctcagattcaaagactcagcatttttcttcatcttgcttcctgacattcagcagccagctagatactctccagagaagaaacaagtctggagaaaagacctccgtattttgccaacttaatagaaagttatctataaatgtccagcagagtgaatgaaattaaaacatccatcacaggacacaaagtcatggaatttcagagcaccagaagtaaagggaaaattaaaatctttcagagagttatatcaggtcatatataaaatatcagcattcaaacagcatcagaattctcaagcatactatcttgtgtattcatagaaaaaaagtatttgggacctacatggttgctacaaattttaccctctatactaagtttctccaatactgggggttgtgctccatctcatgtctgaaactaagtcagaagaaataatgggtgccaggaatcaggagacctcatgtaagagaatgagagtgtcagagaggctgctgtgctcctaggaaacaaccacttcagaagggaccaggtgaataatacatgtagaggagacttcaagaatcaaagagatgtgattgatagtctgagatttccctataattgggaaattattactaggagtttcaaacatgtgcaaatactctaacttgaagaatagaaaattgtgatttaactaaagaaccaaggaagaatgtgtatgtgtgtatatgtgtgtgtgtgtgtgtgtgtgtgtgcttctgtgagtatatttagaatgatgtaaacaatgaatagtgatataaccagaaattgtggtctaaatatattctggtaagtagaaggaggagaattgtgtgtgtgtacgtgtgtgggtgtgtctgtgtgtacacatataactttgtgggcgtgtgtctatatatggaatagagatggagatgaaaattctcatctctcataccagaaaatcattaaatattgtctaaaaattgttaagtaaaaaatagaaagaaatagtggttatttagaaatacaaatataaatttcagaagaaactgctagcatgctcaaagtggccacaattggaaatggaagaatgaagacagtaccattgctaattgcatcactgcccctgctccaccaccgcacacacaaatatatttataaaaccattacaatttaacattataccccatatattattttgataatacatatttgattgtttttctgtttgcaagcactgtaatttattgacttattatgttctgtttattttttaaataatgtattacttaaatttgtattgtcatatatgctaatttatagaaatgtacttatgcactgtaatgactagtttgtaggagagtggtatgtatctatattatggtaattctttttatatggctggttgtacttctggacatgtaactcatgtttgtaatgttgctgggatttttatatcatgttaatgtggccatgaattgctatgacaaatgttccatatatcttcgtttccatcagttctttcttgtgtcttgtcagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaaggtaagcttgtttctcttacactatatttctgtacttctgaaatttccaaagtgctggtttggttccaaccctctaacaacacaagatgagagaagtgcaaaactcatacatgtggcagcttgatggactttctgctattttgtttggggctataaagatttataaagctaggtctccttaataggctgctcttaggtgttacactttcaaataattgttgaaaatatcagtgtgtcaatttcccaaaacactcttctgagatttttatcaaagtgacattcattgtgtagttcgatatggaaagacttaacatgttcatgcattgaattttttaattcatgaatatggttatgctcccaacttattgagctttattctattttctcagtaatgtcttattttcagtgcagtggtttacaactcttttattaggtttttcctagataattaatattttgttgtgttataattttttaattttttttatttctttgtaattggtataagtaattgtattcaattatactattctgatgaccttatatctaacaactttcctaaatttactgatcattgctgataatttatctgtagatatacttggaatttctatgtatattattttgctatctgggttaatatgtattttatatcttattttccaatgattttgtcttcaatttatctttattgcattattgtgctggataggattttcaggttagcattgaacagaattggtgatagagggcatccttatttcatttctgatctgctggggggtagagtataagaatattaatatttcactactgagaatgatgttttaagtattttttttaaataattgacttttatttaacttcatttataaaagaattttcacgaatatagtttgaaatgatactctacatttgttatgaaacagatagttggtattttcataaaatcccagcccccagaaggctcatgtcattccaagtgatcagactcctgtaccttccctaaataaggctagcaaactggggatggcagggagcagagcccagagcaccttggtagttttgcacagatttttttttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggactacaggcgtgagccaccgcgcccggccttgcacagattttttaaaagccagtaacttccttctggctgttctaaaagacaaacactttggagaaaagttgtgcagtaagggaaactatcaaaaatcattctcatagaacagtaaggcagtgaggcaaacacgatctccctcatgattttaaagtctgtaatagaaattaacagtgtcatctgcagcccaattatgcactttaagatcccaaaaaattgctgctgttttaagtattttagtagatattctttatcagaaatctttaagattttagtagatatcctttatcagattagggaagttttttctcttctctcatttttatataaatttgtgtcatgaatgtgtgtgcaattttatcaaattgattctctgcatctatttatatgattgtatatactggcctcacatccctcactaaatatacataagtatacacaaacagctggatttgttctgttacttattgttcaggacttctgtattcataagatattttggtctgcaatttttcttcctcaaaattttcttttcagagctttgataacaagataatgctggctgcataaaactaggtgagaaacgttccctaatgtgggtctgtttttattgctttcccttccttccacttttcttcgtgtgactgcttagttgtatccttgaaatgcctaaaaacctatggctcagtaccagatattatatatgaaaaaatgcagaatttcagagaacatttatctttttccagaatgtattcattcccctctcataggcaattataatgacaacacctcctgtcctgattcagaattgaatatgacatgaacacagtcaaaaattgactgtaggtatgagcttacctctctgaagttcttccgtcactggggccaattattgtctttataatctggaggccaattttggtctttgcagctttacaatgctgtctatcacatggtttctgtattcatccagatgttttagttgctatgctataaactacacaattccacttattatttttcaattaaaaataataaaggttatatcttcatgaaggaaaacaatgagactgataaggtttcaattactaatgtcatcctctggagaagacagaattgataacttatcaagatgtgatggggttttccctaattatcactgatttttttacaaggattaggactacaatccacagttttcatcaaagcacacaaccagaagaggtttttctttctcaatacaagggtctatctacacctcaatactgcagtatgtaatgccccaaaacaaagatttttcttttacacaataatagtcacactcagtagctattgttcaaataataatacagcctaaatttaaattttcacaatttttctagaatatttttatggcttttttctcctgcagtttactatacaggcaaggaacaagcatatagttcatttatgttgaccttttcacctcctgtaatcaaggaaagttcctttcctggtttgtttcttttcaatcagttgacctttttgagaccagcagtcatttaaaatgttcctcaggctggttttctatgactgttttctagaggcagattccagctacaattttggcaagaaaactacataggtgctttaaatatcctgctgaatcacattgatgaggtgggagcatgaaatgtcacatatgtcattattggtcatgctaagttccccacataataaggttgtatcctccagatcttaccattgtaggggttctgctttttatatgcaactagtaaaaatctatgggagtgcattaagattatccgaaactcctgcttccagaatcacacacccaacggttctagctttaattgatgatccttacctgacctgatgatcctgacttgaattgttgcaaagtgataatctttgtaatttcatcatcttttcagtgttttaagctaaaattaatctgtagcatggcagtaataaacacacaatagtttttacttcttattgcacttgtggttgtcatcccagatgacatcatattaaaatagattacatgtttatttacaaaagttctatgaacagatactctggacatttcaagtgtcaacagagacttccattttaaaccataatctacataatcaaaatacaagatgtgtcaaatttgaagtgatgaaatagagcggcaaatgaggccagaaaagggcatccaaacttgatgatctggagaacacattcagaaggttgcacacaagtatccaagatgtaagacttcaaatgtgattggaaagctctttagcaagcttccaccactggccttaagctcatccatgtaaattactgtgtctggctggacctgagtttcctcatctatagatcaacgttatggcgctacgtgatgtccactacttctcctcacttctggacttctttataaatcagattatctgttttgttacttccagggcacaaccataatggcattactgacttccgtgctacatgatgacaaagaatttcctaatccaaatatctttgaccctggccactttctagataagaatggcaactttaagaaaagtgactacttcatgcctttctcagcaggtaatagaaactcgtttccatttgtatttaaaggaaagagagaactttttggaattagttggaatttacatggcacctcctctggggctggtagaattgctatttgtccatgatcaagagcaccactcttaacacccatgtgctccaccctcacaatacaccatcattattgggccagatagcggggcttgcaggagttaactctgttgttcccaattgagaaaatgaacatcttggtttgactgaactctgccactagatacatcactaaggcacccaagagctcctcctagaaggtaaaattcatctgatctttccttacctgccttgacaaatgtatctaagtccacaactgcattgagtgtcttctacatggtgtctgtcacctcccaggctgagctccaagggcacaactttcaatgagaacagaggctcactcttgagttagggaagaagagtaaacaggtcattgtaatttagtcagaccaggactgtgagagaggaaagcacaggcccttgggtagcggctagagggggactctgcatgcttcttgctctctcatataacacagtgaggcataaaatggagtaagcaactcagaggatgtttcatgtgcttcaaaggaggtgataaaatttaagggaagctaagaggttacataagctaagaggttattttgcagtgattccagagcaccctgtcttcttccaatcatgatcatatatcctggatacttgcttttcacacctgtgttttgtgtgctaagtctctggccatggaatctccttcctttattctttgatcttttatgtctgctttatatttggcactgtagataccaacatgacaaggacagagaccttccttcaagaattcacattttaccacaatagataaataaatacagaattacgattcctggtaatctgtgctttaatgaaagcatgagtatgctgttgaggaaaaccagagagcataggatttgattacttgaggggattgtaaagagtgtgaagatgaaatgaaattgaacctatgtcctgaatgtagcctaataaagatgtatcttagccaaaatgaacaacaggatatgaaacttgaaacttcatggtgtgttcaagattgatgaagagagtgtatgaccagagctgagaacagattatgtgaaaagtggaaggaaaaatcatggaatatcaggcttggaacaggaaacaagaatgtgcatgtatttccataatgacagatggaaactcaaaatggcaaaagagctgttttaatgtgggaataaataaagaaatgactgttatggagctgataatcaatgaatatttgttgaatgaagggtgcctattgagattagatgttagacagatagcaaatatatctctttttgtacatttgtttgtcccaccatccattaatcaatccatcatgtcatccatccattcatccacatgttcattcatctacccaatcattaatcaattatttactgcatattctgtttgtgcaagtcacaaatgactgtttgtcacagtcacagttaaacacaaggagtaactacttcctttctttgttatcttcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgccgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagatccatttcttttgtgaatgtgctaaataaaaagtgttattaattgctggttcagttctcagactttccctcttttgtgcataatgcaagaaataaagaaaagagagtgccaggaggccaggcttgtcctcataataataagcagatagtgacaaaggagaagagggtgaggaaggtctctggatgtttgtcatctagagttactgaaggtttggctttataacagagaaagtctgtccaagggaagaaacaaccttcagggaaatattgagaaaatcagttcagttgtgtattatttggagataaaatgaggctaattacttcagggccatagaatcaaattaccaatgcatttatgttaagtgtaaaacaagaaatataaattagaaaaataatgtaatctgttgagactttccaaggattttgttcttgtttggagacagaagaataaaacccagaacatatgattagcaatatgaaagtatatattcatacttgactctaagttgaaaacataaagtgaaaaaaattcaaatattattagtgttcacaataataccaaaacagaggcatgaatttagacacttaatctccatttctacttcactgatccactcatctttaaccccataggcgaaaaaatggagcagggacatgagggcactcaagcacaaagcctctataaacagtcagaaccagtacagcaggttcagtggtcctcttatcagaataaagttactgaaatcagtctcttgtccaatgaaagctgtagctatggcttgtggaacagtgggaaggggtgagcatctggtggaggcccgtgcttgtatagttgctagagaaaaattaaaaccttgtgccagttagaacacagtttattctttaagtgtagaggtgaatgacctaactcttgcctgccatgaccttaggtcctatttataagttggtatcttattgccacaaaaagtccaccccatcagtcttacgacctctattttaacactaatgttgatgagttgttttgtgtaaaccacaaaagagagggggtctaaagaggcgtgtctgacctcccatcctctcgtggccaggaatagtttttaaggtttttgctgaggttcccttgtccaagcaggcttaggatttatttttagtttacaataattacaaaatttcaaagaatctacccacagaatacatctaagttacatagttgagaagaacctagttacaatggagaagacagccacaaactatctaaacctagtaatcaaatgacatcattctgatgaaacacattgaaattgtctatcactcaaaaatgaaaagtatcctctgtgatattcctagcagagattcctctgctgaatttagtcatcaaaaaacatcagacaggcctaaattgagggacattttataagtattcagcctatactctcaaagagtggcaatgtcttggaagtcaaataataactgaagaactgctccacactgaagttgatgaaagagacatgacagctagttgtggcatgcgattctggattctgaactaaattatgagagggacaaaaagcatatattttgggacttttggtaaaacaccaacaggaacaagaattagaaagttccagtgcattaacattaattttctgatcctgatggttttactatagttatataagagaagcacaagcacattgttttgagtaaatacatactaaaatacctcaagtatctggaatcaggttagtatttactttcaaaaggttccatgtgaaacaattatttgcatgaacaagcagttcttctatataccagtgattgtttttttaaaaaataaagccaacagtgcgcttatgtatgcaaaataaactaggctttcacaaatgaaggatcactgttgacaatgcaaacttgaattgctcagcatcattaagctttatggaaatacaaactaaaacttcaattagatattattatataattcatcagaatggttcaaatgaaaaaaggacacattatgttgtctgttgatgagaaagcgaaacaatcacagt

SEQ ID NO: 11861 - DNA, 54707 bp, Human
ataaagacagcaaccgagcttattttacccaaaataaggtagtatatttctgttagagtttagagtttcatgagtcagggaccaagttattgcttttctttgccctgtataaaggcttctccaaggcctttgacttacctaagtactaaatgttataaaaccaaactcttctgacctctcaatctagtcaactggggctgtaattattaatgaaattaatgtttattttgaaaataatttactagactgaattacgaaatcctgaatcattgtacactatcagtaaatattggtggacccaactgaactgaatgttttgcttgaaatgaaacctttgagatgcagggcttatgggttctagtcccagctctagcactagcagacagcatgttcttggctaagatactgaatcttcaaggctcagcttcctcattccggaaatgggtcaattttattgtaagcagaggtaattgagagattcaaaagggacatgaggtgtaacaattctctgtaaattgttagaatccctgttaaaaatgaccagtaaagctttgtgcaactgtgtcttgacataactttatttttcttaataaaagaaatggaaataacctcactagggaatttagaacaaatatgatgatatctttaaagaaaatggctttgcacaagtattgacattaatgatctagtaaagtgtatctttctagttgtatttagatcctcaactcagtatgtcagctcctgttaaggtctatacattgtggtggttctgtgctgtgggtccatttagtgatttccctacctcccatcttttattgcatccacaactgtggttctgtccataatttcctttgctttctgtgcattattacatcatatctgaaaatgagaaaccaaaaacaatagaaagcagccatgtctggaggtgactggggggtcgagaagccctagtttctcaaacccttagcaccaaatttttccctcagttacactgagcgtttcacttctgcagtgatggagaagggagatcccttatttcttctcatgagcatctctggtgctgtttcccttagagacaaataaggggttctatttaatgtgaagcctgttttatgaacagaataaatgtggtgtatattcagaataactaatgtttggaagtttgttttattttgctaaaattgttctcaaggcagctctggtgtaagagataatacaccacgatgggcatcagaagacctcagctcaaatcccagttctgccagctatgagctgtgtggcaccaacaggtgtcctgttctcccagggtctcccttttcccatttgaaaaataaaaaataacaattcctgccttcaggaattttttttagggggtttaatggtaaaggtgtttatatctgctaaggtaatttacttgatatatgtttggttatttaagatatatgagttatgttagctatttcatgtttaggctgctgtatttttagtaggctatattaaatatttgaaaggatttcattataaagaacaaagtctcctaatctttgatatagcattgacatactttttaaatatacaaggcatagaatatggccatttctgttaaatcatatattcccaactggttattaatctaagaattcagaattttgagtaattgcttttgcatcagattatttacttcagtgctctcaattatgatggtgcattagaaccatctgggttaacatttgttttttattaccaatacctaggctccaaccaagtacagtgaaactggaatgtacagagtggacaatggaacgaaggagaacaagaccaaaggacattttatttttatctgtatcagtgggtcaaagtcctttcagaaggagcatatagtggacctaggtgattggtcaatttatccatcaaagaggcacacaccgaattagcatggagtgttataaaaggcttggagtgcaagctcatggttgtcttaacaagaagagaaggcttcaatggattctcttgtggtccttgtgctctgtctctcatgtttgcttctcctttcactctggagacagagctctgggagaggaaaactccctcctggccccactcctctcccagtgattggaaatatcctacagataggtattaaggacatcagcaaatccttaaccaatgtaagtatgctccttcagtggcttgcaaaaggtaagtaaattcacctgtattttttaaataaagtgtatccctagaggtacatgttacaagaggtaatggtaaagtaaaatactttgaaaggcttttgttgccttttccagtctgtcagtgtcagaaatagtggaatgaaaccatgtattttgtgagtagagaaagatttgggtctttgcatgttagattcaaaataacaagtgtcaatagtttgaaaagctgtgttccttcttcatttcataaccatttgctataatttttggctgaaggtaaatggtaaggtattgtgggatctggtcagcagcccacaaagcaactgggctctctcttttttcccaggtggatcggcaggttgagaaataatagacacacaagatagtgaaagctgggtccaggggggtcaccgccttctggtcccatggtgccaagaatgcactggatataccagcatttattattaagtttagtgagggcaggggtaggttagtgagggatttagggtcatttgattatgaggtgagatggtcacatggggatgaagtaattctttaacataacatttgtatgtagaagtacagtacatttgtatgtagaagtacagtatacggagataagaatttacaatatagtgtgtgcgtcagtaatttctaacagagccttaaaacagaaacacaatctttccataacctatgattagcaagatattaatcagcagtaacaattgcaacaaaagctggttacaaacaatccatggaaataggatgtgaagctagacaaccagttagaccagaaattctcagaagggagtatgccttaaccctaaagaggcctagaagagccatggcaagatgagggcatttatagccctatcttatccatatggacaggtgccccccatgcgtccatttataggttctccacaaaggtcgcattccattcccagagctatgaacatctgcttttctgggataggaatcttggtgatgtgaaacctctctgactgcacgtccattcataggctctctgcagggggaagcacatcacgcgctgttggctcattctggcagtccagcctggcactgtccttacacaatcctgcatgcaattttgtatttacaataatcgggagcatttcatcttttattccgtagcaatagtttcagggggggtctccctacagtaaggaacatgtttgttattagagattttattaaataagtcctctactatattagccatgtgttttattcagaatagccatgaaaattaaacttctctgaagaattaatttatgcctgttgtaaaggaaataactgtgggttcaggaccagcaaaagcagataagtggtagaaaagaagttatagacttccatttttagatccacaaagtactgttttaattatactatagctacaatatataaaccccaaaatgaccttagcatttagtaatggtaggaagaaggtcagaagatgtataagtattagggttttttctcaagtgaaagatggtttagcagtgttaatatgatatgtgaacacccctcgttgtgtaataattaccatatacagagagtaaagggctgcaattagtatattaagtcttataagcatgatggtatgattagatcaagagaatgacgctgtagttatgaagactactcctactagattgatggtagggggcagggcaaggttggcaagactagctaggagtcatcacatggctatcagggagagaagtgtttgaaggccttgtgttagtagtatggtttggctgtgaactcgtttgtagtttgagtttgcaaggcagaataatagggatgaggttagtctgtgggcagttattagggaagttgcactggtaaaacttcagggggtttgaatgagaaaagctatgataacaagtgccatgtggcttatggaaaagtaatgagtgattttagatcagtttggcacagacaaaaggagcttgttatgattatttctcaaaaggatagtaagaaggaggaataagctataaactctgttagggggttaagaattaaggtgatttgtataatcctatagccatctaattttaggagtactgctgtgaggactattgacctggcaattgcggcctctatgtgggcttttgggagtcctaggtggagtccatagagagatatttttagtataaatgctatgatgcatgctaatcataaaaggctattaaaccaggaaattgttagttcttgaagctgggtattggtcttaaggtagactcgaaagtgctgataaatttctcaagcatcagtgtttgaataagcggagtttcaaattttggtctgctgtacattagctgtgagacactgaaaatgaatttgtcattctctgagctcagttttttttttttttttttttttttttgagacagagtcttactctgtagctcaggctggagtgcagtggtacaatcttggctcactgcaacctccatctcccaggtccccattcaagaaattctcctgcctcagtcccccaagtagctagcattacaggcatgcaccaccatgctcagctaatttttgtatttttagtagagacgtggtatcaccttgttggccaggctggtcttgaactcctgaccttgtgatccacctgccttggcctcccaaagtgttgggattacaggcaggagccaccacacctggccgtttgtttaaaatagagtaaatagacctgctgaatatgttgatgtgagtattaattgtaatctgcatagcaattgtctgaccattgccttgaacatcacaggccatctgagtggcaagtataatcatcatcatgtttctatttaaaattcagaaatatttgaagcctgtgtggctgaataaaagcatacaaatacaatgaaaatatcatgctaaatcaggcttagcaaatggacaaaatagtaacttcgtttgctgttatctctgtctactttcctagctctcaaaggtctatggccctgtgttcactctgtattttggcctgaaacccatagtggtgctgcatggatatgaagcagtgaaggaagccctgattgatcttggagaggagttttctggaagaggcattttcccactggctgaaagagctaacagaggatttggtaggtgtgcatgtgcctgtttcagcatctgtcttggggatggggaggatggaaaacagagacttacagagctcctcgggcagagcttggcccatccacatggctgcccagtgtcagcttcctctttcttgcctgggatctccctcctagtttcgtttctcttcctgttaggaattgttttcagcaatggaaagaaatggaaggagatccggcgtttctccctcatgacgctgcggaattttgggatggggaagaggagcattgaggaccgtgttcaagaggaagcccgctgccttgtggaggagttgagaaaaaccaagggtgggtgaccctactccatatcactgaccttactggactactatcttctctactgacattcttggaaacatttcaggggtggccatatctttcattatgagtcctggttgttagctcatgtgaagcgggggtttgaagctgagagccaagggaatttgcacatatttgtgctgtgtgtgtacaggcatgattgtgcgtacagtgtgggtataaaaggttcatttaatcccatgttctcctgaactttgcttttttgctttcaaataagaaatgatgaatatagattttgagttcattttttgaaagagttaaagagcagtgtttttcccattacctattccagaacatgtcaccagagaatacttgacaagtcaacatggtgggaatggccctatcatacccatatggagcatgaaccaaatggcatgtgcttttatttaattggactgtgtttgtatggtcagcctcactgacttctctggggtttcttttaggcccgtgcttgccattctggccagtaatgacattctacagtttttattgcttaggcatatcttagtgcagttctcatcaattattatttctctgtaaacacagcattattttaaaaatagtattaattatttcttgttactgtattgatttatatattttcagtaaatacatcctgtagcataattctgtgaaatacccaaatgtcaatttataaaatgatttatttaacaagattttacttattagtaataactctgtaatctgcattccctatgtatgatttggctctgtttcagttttgcttatctctttccaaccatatttatgaaattttggcttagaaatttatgttaattattttttttccatggccaactctactcatctatgaagttttacaatgaatctgtttatcagcttggataccaaattaccttgtttttaaattctgttttcccaatgaagttaaagactgaaaatcagatttatctgtgaatgacacacacaaactaacagatttccaactgttcaatgcctggccattcattcagagtacttttgattaaagtcactatttagggcctatagatatcaggggaaattcagcccctgatatttcaatgtgaatccttttctattctccctaagtgttggctggtctgagaaataaagggaaagagtacaaaagagagaaattttaaagctgggtgtccaggggagacatcacatgtcggcaggttccgtgatgccccctaaaccacaaaaccagcaagttttcattagtgattttcaaaagcggaaggaatgtgtgaatagggtgtgagtcacagagatcacatgcttcacaaggtaataaaatatcacaaggcaaatggaggcagggtgagatcacaggaccggagtgaaattaaaattgctaatgaagtttcaggcactcattgtcattgataacatctcatcaggagacagggtttgagagaagacaaccagtctgaccaaaatttattaggcaggaatttcctcttcctaataagcctgggagcactatgggagaccaggccttatttcatcccttatctacaactgtaaaagacagacgttctcaaaacagccattttagagaccaccccttgggaatgcattcttctcagggatgttccttgctgagaaaaagaattcagtgatatttctcctacttgcttttgaaagaagtgaaatatggctctgttctgctcagcccacaggcagccagacttcaaggttatctcacttgttccctgaacatcgctgttatcctgttttttttttcaaggtgcagatttcatattgtttaaacaatttgtgcagttaacacaatcatcacagggtcctgaggtgacattcgtcctcagcttaggaagatgatggtattaagagattaaagtaaagacaggcataggaaatcacaagagtattgattggggaagtggtaagtgtccatgaaattttcacaatttatgttcagagattgcagtaaagacaggtgtaagaaattataaaagaatgaatttggggaactaataaatgtctgtgaaatcttcacaatttatcttcttctgccatggcttcagctggtccctccgttcggggtccctgacttcctgaaacatatagatgtgaatttgggagctctttaactataaagtttaatatctcaaaataataagagctatttatgacaaacccatagccaatatcatattgaatgggcaaaagctggaagcattccctttgaaaaccagcacaagacaaggatgccctctctcaccactcttattcaacatagtattggaagtcctggccagagcaatcagtcaagggggtattcaaatgggaagagaagaagtcaaattgtctctgtttgcaggtgacatgactgtatacttagaaaccccatcatctcagccccaaaactgtttaagctgataagcaatttcagcaaggcctcaggatacaaaatcaatgtgcaaaaataacaagcattcctataaaccaataatagacaagcagagagccaaatcatgagtggactcccattcacaattgctacaaagggaataaaatgcctacttacacaacttacaagcgatgtgaaggacctcttcaaggagaactacaaaccacttctcaaggaaataagaggtgacacaaatggaaaaaaattccgtgctcatgaatagaaagaatcaatactgtgaaaatagccatactgcccaaagtaattcatagattcaatgctatacccgtcaaactatcattgactttcttcacagaactagaaaagaataatttaaatttcatatgaagcaaaaaaagagcctgtatagccaagacaatcctaagcaaaaacaaagctggaggcatcattctacctgacttcaaacaatactacaaggctacagtaaccaaacagcatggtactgggaaaactggctagccatatgcagaaaacagaaactggaccctttccttacaccttatacaaaaattaactcaagatggattaaacacttaaacataaaaccaaaaaccataaaaaccccagaagaaaacctaggcaataccattcaggacataggcatgggccaagagtttgtgactaaaacacaaaaagcaatggcaacaaaagccaaaattgacaaatgggatctaattaaactacagtgcttctgcacagccaaagaaactgcatcagagtcaacaggcaacctacagaatgggagaaattttttgcaatctatccatctgacaaagggctaatatccagaatccacaaagaacttaaatttacaagaaaaaaagaaatatccccatcaaaaatggacaaaggatatgaacagatgcttctcaaaagaagacatttatgcagccaacaaacatatggaaaaaagcttatcaacactggtcattagagaatgcaaatcaaaactacaatgagataccatctcatgtcagttagaatggtgatccttactaagtcaggaaacaacaggtgttggtgagaatgttgagaaatatgaaccctcttacactgttggtaggagtgtaaattagttcaaccattgtggaagacagtgtggtgattccttaaggatctagaactagaaattccacttgactcagcaatcccattactgggtatatgcccaaaggattataaaccattctactataatgacacacgcccatgtatgtttatgtggcaccgttcacaatagcaaagacttggaaccaacccaaatgcccatcaatgatgtactggataaagaaaatgtggcacatatacaccatggaatactacacagccataaaaaaggatgagttcatgtcctttgcaggaacatggatgaagctggaaatcatcatcctcagcaactaacacaggaacagaaaaccaaactccacatgtttgcactcataaatgggagttgaacaatgagaacacatggacacagggaggggaacatcacacatgggacctgttggggcacggggggccagcagggggacagcattaggacaaatacctaatgcgtgtggggcttaaaacctagatgacaggttcataggtgcagcaaaccaccatggcacatgtatacctctgtaacaaacctgcacgctctgcacatgtatcctggaacttaaagtaaaataaaagaaaatttaaaaaatataaagtttatcgatcacttgattataacaacttcatttcagagatcctccaccaaacaagaaaacttttcctataatttaattcatttagctattaaatgatacgctgggcctaatcaatatcaaattaaataggttaaatttgcaggatgattagagatgagggcatttagttcctaaagaagaaaattcattttaaaaaaggtacagaagaaaaaaactccacttatcaatttacactttcttgtttgccttacctgggatttatatttaaaataaaagtttttggccaggcgcggtggctcatgcctgtaatcccacaactttgggaggccaaggctggtggatcatctgaggttgggagttcgagaccagcctgaccaacatggaggaacctgtctctactaaatatacaaaattagctggatgtggtggcacatgcctgtaatcccagctacctgggaagctcaggtggagaatcacttgaacctaggaagcagaggttgtggtgagctgagatcgtgccattacactccagcccaggcaacaagagtgaaactccatctcaaaacaaacaaataaacaaaaaacaacaacaacaaaaaacaacaacaaagttttcatttaattttttaacaaactaatctatgttaatttgatattagtttgttaacataacaaactaataatatgttaggcatattattcatttatatttgttttccttctcataaaacacattctgctcttacatttattttcttaaatacatgaattcaccaacagtctctttggttcctctctactggttcaacacatgactctttcagctattcattatatataaaaagctttgaaatctccaactattcttgccctttccatctcagtgccttgctgtctactgactttgcagactgatgtgattccctctgaaacatgaattattaggtttttagaaaatgcctttttgttctttccaaagtaaaagacaaataggctgggaatgtaaatttagcatttgaacaaccattatttaaccagctaggttgtaatggtcaactcaggattaatgtaaaagtgaagtgttgattttatgcatgccgaactcttttttgctgttaagggaatttgtaggtaagataatttctaaactactattatctgttaacaaatacagtgttttatatctaaagtttaatagtattttaaattgtttctaattatttagcctcaccctgtgatcccactttcatcctgggctgtgctccctgcaatgtgatctgctccattattttccataaacgttttgattataaagatcagcaatttcttaacttaatggaaaagttgaatgaaaacatcaagattttgagcagcccctggatccaggtaaggccaagatttttgcttcctgagaaaccacttattctcttttttttctgacaaatccaaaattctacatggatcaagctctgaagtgcatttttgaatactacagtcttgcccagacagccttggggtgaatatctgggaaagacggccaagccctttattttatgcatgggaaataaatgcctcaatataggcctgatttctaagcccattagctccctcatcaatgttttttctgctaaactccaaagccctgtttctgtaaagtactttgttgacagccctaaagcgtgctcatagcactccatggatatccaggcactttggaggctcccattactcacaagacttgtccttcaattaacactttgtcgtattatgtggcagaaatatcctaatttaaaagacattatctccttctagtagggagaatatttgggaccatagaagctgccaagaaacactgaatagggcaggggtgtttgatatctcagttgggatcctagctgatgagatagctgggttaggaatgacaaaattattggttttatggtgtatgaaccataaacagacatcacacttataccctgtgctgagctggcatgttttattctctgcctaaataataattgtgtgattttatagaagtcatttaactgctctggtgcacagttggaatttgaagtatctttgagcccctcccacttctaaaatactaattccatttcagaggctgcttgatagaaatcaatatagtagggactagctttgtactatcaatcaggttgtccaaattcttttaacctatgctgtcatctacaaaacgtgaatgtagtaattcatgccatcttatatttcaagattatagagaagaattgtaaaaagtaacagaattaacataaagatgcttttatactataaaaaggaggtctgagtctaggaaatgattatcatctggttagaattgatcctctggtcagaattttctttctcaaatcttttataatcagagaattactacatatgtacaataaaaatttccccatcaagatatacaatatattttatttatatttatagctgtaatttacaaccagagcttggtatatggtatgtatgcttttattaaaatcttttaatttaataaattattgttttctcttagatctgcaataatttttctcctatcattgattacttcccgggaactcacaacaaattacttaaaaacgttgcttttatgaaaagttatattttggaaaaagtaaaagaacaccaagaatcaatggacatgaacaaccctcaggactttattgattgcttcctgatgaaaatggagaaggtaaaatgtaaacaaaagcttagttatgtgactgcttgtgaatttgtgatttgttgactagttctgtgtttactaaggatgtttaactggtcaatcagtaatgcttgagaagcactttaagtttttattgtatgaatgaataacaaaatagaccactagctagactaataaagaagaaaaaagagaagaatcaaatagacacaataaaaatgataaaggggagatcaccactgagcccacagaaatataaactaccatcagagaatagtataaacacctctatgctaataaactagaaaatctagaagaaatggataaattcatggacacatacactctcccaagactaaacaaggaagaagtcaaatccctgaatagaccaataacaagttctgaagttgaggcggtagttaatagcctaacaaccaaaaaaagtccaggaccagatggattcacagccaaattctaccaggggcacaaagaggagctgacactattccttctgaaactattccaaataatagaaaaagagggactcctccttaactcattttatgaggctagcatcatcctgatacccaaaccgggcagagacataacagaaaaagaacatttcaggccaatatccctgatgaacaccaatgcaaaaatccacaacaaaatactgccaaaccaaatccagcagcacatcaaaaagcttatccaccatgatcaagtagccttcatccctgagatgcaaggctgtttcaatatttgcaaatcaataaatgtaatccatcacataaaaagaaccaatgacaaaaaccacatgattgtctcaatagatgcagaaaaggcctttgataaagttcaatacccttcatgctaagaattctcaataaactaagtaatgatggaacatatctcaaaatagtaagagctgtttatgacaaacccacagccaatatcatactgaatgggcagaagctggaaggattccctttgaaaaccagcacaagacaaggatgccctctctcaccactcctattcaacatagtattggaagctctggccagggcagtcaggcaagagaaagaaatgaagtattgaaataggaagagagaaagtcaaactgtctctattcgcagatgacatgattgtatatttagaaaacccctttgtctcagcccaaaatctcaagttgataagcaacttcagtatagtctcaggttataaaatcaatgtgcaaaaatcacaaccatttctatacaccaataatagacagacagccaaataatgagtgaactcccactcacaattgctacaaagagaatataatacctaggacacaaacaaatggaaaaacattccatgctcatggataggaagaatcaatatcatgaaaatggccactgcccaaagtaatttatagattcaattctatccccatcaagctatcattgcctttcttcacagaactagaaaaatctactttacattttatatggaacgaaagaagagcccacatagccaagaaaatctaagcaaaaagaacaaaaagttcataatcactgggacattggagaaatgcaaatcaaagtcccaatgaggtaccatctcatgccagttagaatggtgatcattaaaaagtcaggaaacaacagatgctggagaagatgtggagaaataggaatgcttttacaccgttagtgggagtgtaaattagttcaaccattatggaagacagtgtgctgattcctcaaggatctggaacaagaaataccatttgacccagtaatcctgttactgggtatatacccaaaggattataaatcattctactataaagacacatgtgcacgtatgtttattgcagtactattcacaatagcaaagacttgggaccaacccaaatgctgatgaatgacagtctggataaagaaaatgtggcacatatacaccatggaatacagtgctgccataaaaaaggatgagttcatgtcctctgcagggatatgggtgaagctggaaaccatcatcctcagcaaactaacacaggaacagaaaaccaaacattgtatgttctaactcattaatgggagttgaacaatgagaacacatggacacatggaggggaacatcaacaccggggcctgtcagggggtgggggacttggggagggatagcattagaagaaatacctaatgtggatgacaggttgatgggtgcagcaaaccaccatggcgcgtgtatacctacgtaaaaaacctgcatgttctgcacatgtatcccagaacttaaagtataaatatataaatctacccaaggagaaacagaatgcacattccaggtgaaatggaatcaattactgacaaatatgaaaacataaaatatgccctgtgatgaagatgggtgtcattattgcacacagtttatttgagaatgggaaagaatgacttaacctaggtgggtttcctgcattcctgcaaattgaaataggccataaaatatttgcagtgagagtcagaggaggggtttcagataggttggaatgctctacatggaggtgcagaggtgggtgatgggaaagagtaggtggatggaagagggaaaggaagcctttattgagtgagaacaaaaatgatttgtacagataacagttggaatttagtgtctatcagataaggcgtaaacatcaatgccgttgtcatcgcaccattgttgaaaacgctattttttcccctattgaattgccttggcaaccttgtcaaaatccaattgactataaatgtgtgaaaggtttttttctgtgtgctctcaattgtactccattgatctatatgtctgtcgtaatccctatagtacaccatcttaattactgtagtattgtattaatatcaagttattatatcaaatcaaggagtgtgagtctttgttgttctttttcaatacgttttcactattctgggtcccttgaatcttcatatgaaatttagaatacacttgtcaattttctcaaaggagccaatggggattttgacacgattgcattaaatcagtagatcagggaattatgccatttttaaaattgaagtgaaattcacacaatatacaattaaccattttaaagtgtagacttgagtggtatttagtgtattcacaatgttgtacaaccaccagctttctctggtttcaaaatgtttttattacttcacaaaaacatatcatattcattaaataatcactccattcctccaacccatcatgtaattacctctaatcttctttctgtttctatggatttgcctgttatggatatataaaggactcacagcatatgtaacctgttatgtctgagtcctttcacttataatgttttggaggctcatctaagttgcaacatgtatcagtacttcattcttttttgtcgctgaaatatattttatttttccatgcacatatatcacaatttgttattcatctgtttatggacatttgcattgtttccaacctttggctcttatagataatcttgctttgatcatttgtgtatgtttctttatgggcatattttcatcattcttgggtatattctcaggagttgaattgctgggtcaaatggtaattttatgcttatcttcttgtatataagagccaatcttttctacagtgaatgtggcattttatattccttccagcaatgtagaaggatttctattttccacatagttgctaatacttgtaactttctgtatttattgaagccatcctagtgaatatagagtgttatctcattgtggttttatttatttattcatttatttagagacagagtcttactctgtcacccaggctggagtgcagtggcatgatctcagctccctgcaacttccacctcctgggtttacacaatcctcctgcctcagcccccagagtagctgggattacaggcatgtgtcaccatacctggttaattgttatatttttggtagagacgggttttctccactttggccaggctggtctcgaactcttgacctcaggtgatctgcccatcttggcctccctaagtgctgggattacaggtgtgagccactgcgcccagctctcattgtggttttaacttgtgtttaatggccaatgattttgaacttcttttaatatattattacccatttgtatatcttctttggataaatgccattcaagtacattttctgtttaaattaagttgactttatttttctttttaagctgttagaatgatttatgtattcaaaacattaaactcctacatatacataatatgaagatatttcctcccattctgttggttgtcatttcacattctcaattatattcttgctgcacaaagtttaattttgatgaagtttggtttatctatctttccttttgccactctggtatcaaatttataaatctattgccaaatatgaagtcatgaagatttacccctacattttattctaagagttttatcgttttagctcttatatttaagtttttccatccattttcagttatatttttcatttggagtgaagtaagggagatctcagcttcattcttctgcatttcgctgtcctgttgtctcatcaccatttgttgaagagactctttcctcagattgaatggtctaggcacccttgatgaaagtaaatttgccatagatctttaggtttatttcgtgatttcagttttattccatttgtcttgatgtctatctttatgctagtaccacactgttttgattattacagtttgtagtaagtttgaagttggaaactgagtactcactgatacagaaattaagtagaaattacttaggcaaatagtaagcatttgggagtcctcagtaaggtttttctttatactggaaagcagccccaaatcattttctaacaaagagcagcttgtaaaatcgagctgcagacatacacaaggaagctggaaacttgcacgagtgaaagctggtagtaaagaactacctgtgaccaggcaagttcaaaatggcggctccttccccacccactatgtaaatgtcacacctgattaaaccaatctctgggccatacgtaaatcagacactgcttcctccagcctccctatgcaatctgctgtggtccacctccttcccccttttccgatgtccctctctttcacaagaagctgcttttttctctcctttcttctattaaactttctgctacataacccactcagatgtgtccgtgtcctaaatttttctggggcatgatgacaaacctgagggtgtatatcccagacaacgtagctgcttcatcaccatgtagttgcatattaattgaacaatcaactttcccatttctggaaaaaagaccattggtattgtggtagggattgcctgagtttttagatcactttgaggagtactgccatcttaacgatattaagtcttccaatccctgaacatgagatagttttcaatttatgtaggtattagatattcttttttcttctgttgcaagggtctggtttagtttaaaaggcaagtttatcttaaatttttttatttagttatgaccattgaggattttaaaatgataccatatgaaatgccttcttttaaaaaaaatttcaacttttatttatttatttatttatttatttttattatactttaagttttagggtacatgtgcactatgtgcaggtctgttacatatgtatacatgtgtcatgttggtgtgctgcatccatgaactcgtcatttacattaggtatatctcctaatgctatccctccccactctgccaccccacaacaggccccagtgtgatgttccccttcctgtgaccatgtgttctcattgttcaattcccacctatgagtgagaacatgcggtgtttggttttttgtccttgagatagtttgctgagagtgatggtttccagcttcatccatgtccctacaaaggacatgaactcatcattttttatggctgcatagtattccatggtgtatatgtgccacattttcttaatccagtctatcattgttggacatttggcttggttccaagtcgttgctattggaatagtgccacaataaacatatgtgtgcatgtgtctttacagcagcatggtttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcaccttttgtttcctgactttttaatgatcgccattctaactggtgtgagatggtatctcattgtggttttgatttgcatttctctgatggccagtgatgatgagcattttttcatgtgttttttggctgcataaatgtcttcttttgagcagtgtctgttcatatcttttgcccactttttgatggggttgtttgttttttatcttgtaaatttgtttgagttctctgtagatcctggatattagccctttgtcagacaagagggttgcaaaaattttctcccattctgtaggttgcttgttcactctgatggtagtttcttttgctgtgcagaagctctttagtttaactagatcccatttgtcattttggcttttgttgccattgcttttggtgtatgagacaagaagtccttgcccatgcctatgtcctgaatagtattgcctaggttttcttctagggtttttatggttttaagtctaacatgtaagtcttgaatccatcttgaattaatttttgtataaggtgtaaggaagggatccagtttcagctttctacatatggctagccagttttcccagcaccacttattaaatagtgaatcctttccccatttcttgtttttgtcaggtttgtcaaagatcagatagttgtagatatgtggccttatttctgagggctctgttctgttccattggtctacatctctgttttggtaccagtaccatgctgttttggttactgtagccttctagtatagtttgaagtcaggtagctttgttcttttggcttaggattgacttgacaatgcgggctcttttttggttccatatgaactttaaagtagttttttccaaatctgtgaagaaagtcattggtagcttgatggggatggtattgaatctataaattaccttgggcagtatggccattttcacgatattgattcttcctacccatgagcatggaatgttcttccatttgtttgtatcctcttttatttcattgaacagtggtctctagttgtccttgaagaggtcattcacatcccttgtaagttggattcctaggtattttattctctttgaagcaattatgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaatttgacttcctcttttccttattgaataccctttatttctttctcttgcctgactgccctggccagaacttccaacactgtgttgaataggagtggtgagagagggcatccctgacttgtgccagttttcaaagggattacttccagtttttgtccattcagtatgatattggctgtgggtttgtcataaatagatcttattattttgagatacgtcccatcaatacctaatttattgagagtttttagcatgaagagctgttgaattttctcaaaggccttttctgtatctattgagataatcatgtggttcttgtcattgattctgtttatatgctggattacatttattgatttgcctatgttgtaccagccttgcatcccagggatgaagcccacttgatcatggtggataagctttttgatgtgctgctggattcggtttgccagtattttattgaggatttttgcattgatgttcatcagggatattggtctaaaattctctttttttgttgtgtctctgcccggctttggtatcaggatgatgctggcctcataaaatgagttagggaggattccctttttctattgattggaatagtttcagaaggaatggtaccagctcctccttgtacctctggtagaattcggctgtgaatccgtgtggttctggactttttttggttggtaagctattaattattgcctcaatttcagagcctgttattggtctattcagagattcaacttcttccttgtttaatcttgggagagtgtatttgtcgaggaatttatccatttcttccagattttctagtttatttttgtacaggtgtttatagtattctctgatggtagtttgtatttctgtgggatcggtgatgatatccccttcatcattttttattgcgtgtgttggattcttctctcttttattctttattagtcttgctaacagtctaccaattttgttgatcttttaaaaaacctgctcctaaattcattgattttttgaagggttttttgtttccatgtaattgagtttccattgtttccatggaatgcaaaaattccatgttttgagtgagtttcttaatcctgagttctagtttgattgtgctatggtctgagagacagcttgttataatttctgttcttttacatttgctgaggtgtgctttacttccaactatgtggtcaattttggaataggtgtggtgtggcgaaaagaatgtatattctgttgatttggggtggagacttctgcagatgtctattaggtctgcttggtgcagaactgagttcaattcctggatatccttgttaactttctctctcgttgatctgtctaatgttgacagtggggtgttaatgtctcccattattattgtgtgggagtctaagtctctttgtaggtctctaagcacttgctttattaatctgggtgctccgttattgggtgcatatatatttaggatagttagctgttcttgttgaattgatccctttacctttatgtaatggccttctttgtcccttttgttctttgttggtttaaagtctgttttatcatagagtaggattgcaacctctgcctttttttgttttccatttgcttggtagatctttctccatccctttattgtgagcctatgtgagtctctgcatgtgagatgggttttctgtgtacagcacaccgatgggtcttgactctttatccaatttgccactctgtgtcttttaattggagcatttaacccatttacatttaacattaatattgttatgtgtgaatttggtcctgtcattattatgttagctggttattttgctcattagttgatgcagtttcttcctagccttgatgatcttacaatttggcatgcttttgccatgggtggtaccagttgttcctttccatgtttaatgcttccttcaggagctcttttagggcaggtctggtggtgacaaaatctctcagcatttgcttgtgggtaaaggattttgtttctccttcacttatgaagcttagtttggctggatatgaaattctgggttgaaaattcttttctttaagaatgttgaatattggcccccactctcttctggcttgtagagtttctgccgagagatcagctgttaatctgatcggcttccctttgtgggtaacccggcctttctctctggctgcccttaacattttttccttcatttcaactttggtgaatctgacaattatgtgtcttggagctgctcttctcgaggagtatctttgtggtgttctctgtatttcctgaatttgaatgttggcctgccttgctagattggggaagttctcctggatagtatcctgcagagtgttttccaacttggttccattctcctcgtcactttcaggtacaccaatcagatgtagatttggtcttttcacataggcccatatttcttggaggctgtgttcgtttctttttattcttttttctctaaacttctcttctcacttcatttcattcatttcatcttccatcacttataccctttcttccagttgatcaaatcggctatggaggcttatgcattcatcacgtagttcttgtgccatgattttcagctccatcaggtcctttaaggacttctctgcattggttattctagttagccattcatataatcttttttcaaggttttttacttctttgccataggttcaaacttcctcctttagctcagactagtttgattgtctgaagacttctctcaactcatcaaagtcattctccatccaactctgttccattgctggtgaggagctgtgttcctttggaggaggagaggcactctgatttttagaatgttcagtttttctgctgttttttccctgtctttgtggtttcatctgcctttggtctttgatgatggtgacatacagatgggattttggtgtggatgtcctttctgtttgttagctttccttctaacagtcaggaccctcagctgcagtctgttggagtttgccagaggtccactgcagaccttgtttgcctgggtatcagcagcggaggctgcagaacagcggatattggtgaacagcaaatgttgctgcctgatcgttcctctggaagttttgtctcagaagagtacccagccttgtgaggtgtcagtctgcccctaatggggggtgcctcccagttaggctacaagggggtcagggacccacttgaggaggcagtctgtccattctcaggtctcaagctttgtgctgggagaaccactattctctccaaagctgtcagactgggacaattaagtctgcagaattttctgctgccttttgtttggctataccctgaccccagaggtggagtctacagaggcaggcaggcctccttgagctgcggtgggctccacccggttcgagcttcccagccgctttgtttacctactcaagctttggcaatggggggcacccctcacccagcctcgctgctgccttgctgtttgatctcagactgctgtgttaggaatgagtgagcctcagtgggcataagaccctctgagccaggcacgggatataatctcctggtttgccatttgctaagaccatcagaaaagcacagtattagggtggaagtgaccttattttccagatgccttctgtccttggctaagaaagggaattctctgaccccttgcacttcccaggtgaggtgattcctcaccctgcttcagctcaggctccatgcactgcacccactgtcctgtacccactgtctcacaatccccagtgagatgaacccagtacctcagttggaaatgcaaaaatcattcatcttctgcatcgctcatgctgggagctgtagactggagctgttcctattcagccatcttggctccaaatgttctcaacttttattttgaagtgcacgttcatgtgtcttacataggtatattgtgtgatgctgaagtttagggtacaaataatgccatcacacaggtagtgagactagtacccaataggtagtttttcagcccttgcctttatatctctctaccctctatagtaattccttgtgtattttttccatctttgtgtcccacttttatatgagaacatgtggtatttggatttctgttgctgcattaattccctcaagataatggcttccagctacatctatgttgctgcaaagacatgattttttttaatggctgcatagcatttcatggtgtatatacaccacattttgtttatgtgacacatgattggttggttctatgtctttactattgtgaatagtgcaggaatggacatactagcacgtgtcgttttggtagaacaatttgttttcctctgggtacatactcagtagtggaattgctgcatcgaatggtagttctgcttttagttctttgagaaatctcaaaactggtttccatagtggctgaactaacttacattcccaccagtagtatataagtgttctcttttctctgcagtctcaccaacatctgttattttttggctttttaatcatatccattttgattggcatgagatgatatctcattgtggttttgatttgcatttctctgatgattagtgatgttgagtgttttctcatatgcttgttggccatgtgtgtgtcttctttggaaggacatatgtcctttgcccactttttaatggggttacttgttttttaacttgttgaattgtctaacttccttatagattctcgctattgaaacattgttggattcacagtttgcaaatattttgtcccattctgtaggttgtctgtttattctgttgatagtttctcttgctgtgcagaagctctttaattaggtcccacttgtcaatattcattttggttacaattgcttttgaggagttattcataagttctttgctaaagcctgtatccagaatgttattttatagatatttttccatcagattcttatagtttgaggtcttaaatttagatcattaatccatttcgagttaattattgtatatggttcaaggaagtgtttcagtttcattctgcatatggctagtcagttatcctcattcaatttactaaatagagaattctttcctcattgattattttttgtcaactttgttgaagatcagatggctataggtgtgtggctttatttctggcttctctacttctgttcaatttgtgttttgtaccagttacatgctctcttggttactgtagcttacagtatagtttgaagtcaatgtgaagcttcccactgttctttttgtttaggattgctttggatttgggctcttctttggttccatatgaattttagaataaaataatattggtagtttgataggaatagcattgaatctgtagatagctttgggcagtctagccattttaatgatattgattgtttcaatccataagcctgaactgtttttccatttgtttgtgtcatctatgattttgttcatcagtattttgtagctctccttgtagagacctttttgccccctttgttagttgtattcctaggttttttcttgtggctattgtaaatgggattgagttcttgattggctttcaggatgaacatttttggtgtttaaaaatgctacagatttttgcatatttattttgtgtactgaaatctcactgaagttgtatgtcagttccaggagtttttggaaagttctttagggttttctaggtctgaattgggtcttctaggtctgagatgggtcttctacttctactagtaggagatgggccttgcaatcttgaagacagtagaaggatgggtcttatttttaatccaacttcctactctttgccttttatgtggagcatttagactttatcttcaatgttaacactgatatatgaggttttgattctattgtgaagttgttagctggttgttttgtagtttctattgtgtgattgctttatagagtctgtgggctatatacttaagtgtgttttgtggtagcaggtattgttctttcacttccatatttagaactcccttaatgatctcttataaggctggtctaatggtaacagattttcctggtagttacttgtttggacaagattgtatttcttccttgattttgaagcatagtttggcaaaatataaaattcttttttgtaatttttattaaaatgaatgttgaaaataggctgagcatccttttagcttgacaaggttctctttgtatgtgatctgatttttttctctagctgcctttaaaattattttttagccttgactttggacagcctggtgagtaaatgccttggtgatgttaattttgtatagtgtctcacatatattccctgggtttattgtatttggatgtctacctttctagcaagtttgggaaaattttctcaacttattagcccaaatgtattttctagattgtttactttttcttctctctcaggaatgccaataattcctaggtttactccttttaaataatcagatatttcttgaagactgttcatttattaaaattattttttctttatttttgtctgacttggttagttcaaaagactggtgttcaagctctgaaattggtccagtctattgataaacgcttcaattgaattctgaaattccttaagtgactctttcaattccagaagctttgattgatttctttttaagatgtttacttctcgctccatttcctggactgctttagtagtttgtttgcattaattttcaaccctgccttggatcactgagcttacttgcagtccatattttgaatagtttatctgtcatttctgagttgccagtttggttagggttcattgctggggagttcatgtgatcctttggaggttttacgacattcagacatttcatggtgccagaagtcttatgctggtttcttcttatttggagaggctgccgcttctgatttttgaaattatttttgtgcagatagaattgtttttctctccctatttttgttctttcctttttctcttccccttcctatgggatgtgactataaagtatgttgggtagggcctttgacttggattctatagctgtgttcacttctgtgggtagttttatattggcctgtgcagtttgacatacatgtcagtagatggcacttatgagcaaaagccagctgtgactaggacaacttgatatagcacagcttgatccttgttttctgggggaacttctctgtttcctcagataatctgttcatctgtggaattcagagtagtctgggctccctgctgagccccagggggataaagatcggtgtcactggactgggcagtcctgtctacaggtcccctaatggcaggcactagcaccagcactgagagacaactgatttttgcattgatcttgtaccctgaaattatgctgaaatcatttattagctctacttattttctatctgtattgcatgagatttttctatatagagagaatcatgtttcagtcaaatacacatgatttgaatttttcctttcctatttgaatgtgttttatttcatttcttgcctaattgctctggctagaacttccaatactatgtttaatagtagtaaaaatggacatccttgttttttttcttttctttctgattttaagttacaagttttagtctttcacaatttagtatgctttagctttgcagttttcataaatatgctttattatgataaaggagttttatttcatttatagttttctgagtgtttttgttatgatgggtattaaaagttgtcaatttttttttctgcatctaatgagatgaacatgattttctcttttattctgatatggtgtagtgcactgattgactttcttgttgaaccacttttgaatttctgggataaatctcacttgcttattgtgagatttatttttataatgtttattattataattttttaattttgtaaaaaattgttgcaaaatacacataacataaaagtttctgtattaatcattttaagtgcatagtattttggtattaattacattcacattgttgtgcaaatgtcactgccatacatctgtagaattcttttcatcttgcaaaacagaaactttatacccatttaataataactcttggccgggcattgtagatcatgtctgtaatcccagcactttgggaggttgaggtgggcagattggatgagctcaggagttcgagactagcctgggtaacatggcaaaaccctgtctctaccaacaaagcaatcaacaaacaaaatgaaagtaacataatttcctcaactgtgcaaactaattcatattaataattccatgaaatgtgtccatagtaacacaagagcagaagatgggccttgtaaaggtggcccaccacattatttgaggtctttgtcagtcttatctgccagatactgtgtggactaactgcagttaaaattcccattcccttatcacttgccctgaaatttatctgaaatcaaagggaatgggttgcccaaagagaagtgtccagagacgtggatgatgcgacaagaaatgttgtagaaccacacccccacctcaaatgataactctacatttctcccttccaccaccccatggcaaccaacattctactttgtgtctctataaaatcgagtatgctgggtacctcataaaagtggaatcattacatatttgccttttgtgactggtttatttcacttagcctaatgttatgttctcagggttcattcatgtttttgcatgtgtcagatttttcttcctttctaagggtgaataatattccgttgtatgtataaaccaagtttgcttacccatttatctgttgatgggcacttggattacttttcaccttttgactttttgagtaatgctattatgaatatgggtaaaaaaatatctctttgatgtgctgctttcaattcttttgggtataaataacccaaaagaataacccaccacgcctggttaattttttgtatctttagtagaaactgagtttcaccatgttggccaggctggtctcaaactcctgaccctgtgatccacccacctcagcctcccaaagtgctggaattataggtgtgagccacgtcgcccggcctacatttattgatttgcatatgttgaaccaggcttgcatcccagggatgaagccaacttgatcgtggtggataagctttttgatgtgctgctggattcagtttaccagtattttgttgaggattttcgcatggatgttcatcagggatattggcctgaaattttcttttttttgttttatgtctgccaagttttggtatcaggatgattcttcccttataaaatgagttaggaaagagtgcgtctttttctactgtttggagtagtttcagaaggaatggtaccagctcctctttgtacctctggtagaattcggctgtgaatccttcaggtcctgggctttttttttgcttggtgggctattccttgctgcctcaatttcagaacttgttattggtctcttcacggattcgacttcttcctggtttggtcttgggagggtgtatgtgtctaggaatttatccatttcttctagattttctagtttatttgcatagaggtgtttatagtattctctgatggtagtttgtattcctgtaggatcagtggtgatatcccctttatcatttttttgttctctctatttgattcttctttcttttcttctttattagtctggctagcagcctattttgttaatcttttcagaaaattagctcctgtattctttgatattttgaagggattttcctgtctctatctccttcaattctgctctgatcttagttattttttgtcttctgctaggttttgaatttgtttgctcttggttttctagttcttttaaatgtgttgttagggtgttgattttagatctttcctgctttctcctctggacatttagtgctataattttccctctaaacactgctttagctgtgtcttggagattctggtacactgtgtccttgttctcattggtttcaaagaacatctttattttgccttcattttgttatttacccagtagtcattcagagcaggttgttcagtttccatgtagttgtgcagttttgagtgagtttcttaatcccgagttttaatttgatggcactgtggtctaataggttgtttgctttaatttctgttcttttgtatttgctgatgggtgttttacttccaattatgtggtcaattttagaataagtgtgaagtggtgctgagaagaatgtatattctgttgatttagggtggagagttctttagatatctattatgcccgcttggtccagagcttagttcaagtcctggagatccttgttaaatttctgtctcattgatctgtctaatattgacagtggggtgttaaagcctccatctattattgtgtgggagcctaagcctctttgtaggtctttaagaacttgctttatgaatctgggtgctcctgtattgggtgtgtatctatttaggatagttagctgttctcgttgcattgatccctttaacattatatgataccacccctttttttaatctttgttggtttaaagtgcgttttatcagagactaggattgcaacccctgctttgttttgctttccatttgcttggtaaatattcctccatccctttattttgagcctatgtgtgtcttttcacgtgagatgggtctcctgaatacagcacattgatgggtcttgactctatccaatttgccagtctgtgtcttttaattggggcatttagcctgtttacatttaaggttaatattgtgtgtggatttaatcctgccattatgatgctagctgattattttgccttttagttgatgcagttttttttatagtgttgacggtctttacaaaatttggtatgtttttgcagtggctgttcccagttgatcctttccatatttagtgtttccttcaggagctcttgtaaggcaggcttggtgatgacaaaatccccttgtggtgatgggcttccctttgtggtaacccgacctttctttctggcttcccttaacatttttcctttcttttaaccttggtgaatctgacaattatgtgtcttggggttgcccttcttgaggagtatcattgtgggtgttttctgtatttcctgaatttgaatgttggtctgtcttgctagattgtggaagttctcctggataatatcctgaagaatgttttacaacttggttccattctccccatcactttcaggtacaccaatcaaacgtagatttggtcttttcacatagcgccacatttcttggaggctatgttcatttctttttattcttattttttaacttttttcttcacattttatttcattaagttgaccttgaatctctgatatcctttcttctgctttatcaatttggctattgatatttatttatgcttcacaaagttctcattctgtgttcttcagctccatcaggtcactcatgttcttctctagttagcaattcgtctaacattttttcaaggttcttagcttctttgcaatgggttagaacatgctcctttagctcagtggagtttgttattacacaccttctgaagcctacttctgtcaattcatcaaattctttctctgtccagttttgtccccttgctggcaaggagttgtgatcctttggaggagaagagatgttctggtttttgaaattttcagcctttttgtgctgttttttttttctcatatttgtggatttatctacctcttgtctttgatgttggtgacctttgaatgggttttttgcgtggacatcctttttgttgatgttgatgctattcctttctgtttgctagtttttttcctaacagtcaggcccttctgctgcaggtctgctggagtttgcttgaggtccactccaaaccttgtttgactgggtatcaccagaggaggccacagaacagcaaagattgctgtgtgtttattcctctggaagcttcgtcctagagggacacttgccagatgccagccaaagctcttttgtatgaggtgtctgttgacccctgctgggaggtctgctgttctctttagagccagcaggcaggaacatttaagtctgccgaagctgcacccactgccaccccttcttccaggttctcagtacagtgagatgggagttttatctataagcccctgactgggactgttgcctgtctttcacagatgcaactgctcagagagtaggaatctagaggggcagtatggctacagtggctttgcggagctgaagtggactccacctagtcctagcttcctggaggctttgtttacactgtgaggggaaaaccacctactcaagcctcaacaatggcagactcccctcaacaccccccccaagctcgaacatccccagtcaacttcagactgctgtgctggcaaacagaagttcaagccagtggatcttagcttgctgggctccatgggggtgagatcccctgagctagatctcttggctccctggcttcagtcctctttccaggggactgaatggttctgacttgctggtgttacagcaccactggggcataaaaaaacccctccagctatcttggtgtctgcccagatgaccacccagttttgtgcttgaaacccagggccctggtggtgtaggctctgaagggaatcttctggtctgtgggttgtgaagaccatggaaaaactgcagtatttgggccagagtgcaccgttcttcacagcacattccctcaaggctttccttggctatgggagggagttcaccaatcccttgggcttccaaggtgagacaacattcctccctgcttcagtttagcctccatgcactgcacctactgtctaaacattcccagtgagatgagccaggtacctcagttggaaatgtagaaatcacctaccttcttcattgatctcgctgggagctgctgactggagcttttcttattcagtcatcttgccagccaccctcctgattgagtttctttaaggtaattattttgaattccttttttgaatatttgtggattttttttcattgaggtctgttatttgagagttattatgtccctttggtggtgccatatttctttatttttcatgttgtgtctctgaatttatgtctatgcatgtgatggaacaattgctattccaaaatctctagagtgaatttcatagagaaagacttttatctgaagttgagtgtttgtgtgcaggtgacgaagagtgggtaactcagtttttgatagatgcattgtgatagtatctgtgtagtttctctagctatggccaatatcagcaataattttgggtgcctcagtggcctaggctgtagaagtttgcagcagtatcaggagcagtgtaggttgttaatgtccttagtgtcaaagtatttgggcgtcctcctatttttattttcctaaaattggggtgacttagcctaagggattccttttggtgtcatctctgacatggcattaactcagcggcattggtgctgggttacaagtacagatccttgaagttgtcatagaagcatcattctagactcagggtcttttaatcatgtattgtgacacctgggtcttgcggtgcaggttcactctctgtggcagtgttgaatgcagattacccacagaaccaaggtctatgactctagcacaccttagcagctgaagcccacagactgagttgtggctgtgaatctgtttctgagggtgaggtgcaggaaaatgccgtggcctgcctctgatgtagaaggggtgctctttagatttgagcccagcaagtagaatatggctactatcattaataagataggatatactaccttattaatgctaagtaaccaagctcaagtcaagagatggaaatgttaatactggtttgtgactgcactgttcttcttacttaagagtaattttcaacatggcaagcttagaaaactgtgtgaagctgatgttaccaagggagaggactgtctttgtctacacatgttgagagaatctagtctatttcagtggtgttgattacacaatattcaacatgacacacatcacttggagactctaaaagcatcattaatttattgctgctggccttggggctggttaaaaagtaatacgttttttatattgatgatctctttcaactaagtattccttatccattgctttctttctcccaacttccaaattatgagaactccagtctctaagccttggcatatgcagtatccttactctctcctttatcccctgtggcaattaatccctttattctccatcttcatcattgttctttctcttcactttgtatatttttgtttattcctgcactactgcaccctagaacaagttgtctgttgcctcccatctagattataatagtgtgggcccatcttgtcattgtaaacccattctcttcctctataatttatcttaggttttgctgtcatattgcttttttaatatttgtttttacaaaatttcaactttataatgaatctgggggcaatattgagtccatgtacctttctgacagaaaaatataattgcagactcttgattcaggctcacagtgtctaatgatatggccccaatttacgttttctattaatttagattgtggttgtctacaggtaataatggctttaacacataatgtctttatttatctcaaatacagggattctcttggtggggcaatctaggataatacagcagccccaaagcagcagagagtcaagtgccttcctttttcccactaaatttagtatacagaccttcattttgatgattaaatcccaggatggggtctactctacctcctacttcacatttgtgttttgagtatgaaagaggaaatagaggaaatggacctagagaccttctgcttatatattttagcaaaaaaaaatatgctgtgtgactcagctagctgcaaagagcctgatgaatggaatttttaggcaagcatggaataagggagtaggaaataaagtttgggcaagttggtctacagcctctgctatacaagcagtattttttttctagtactgtactttccagtttctatgttggtaactatataactatgtgaataattttgaattcactgtaatcaaatatgctggtaaataatttgtcagataattgcatcaaatcattcctaggaaaagcacaaccaaccatctgaatttactattgaaagcttggaaaacactgcagttgacttgtttggagctgggacagagacgacaagcacaaccctgagatatgctctccttctcctgctgaagcacccagaggtcacaggtatgatcagagatgataagttaattaattttcagaaaagattttgggaaggtgttgctagtgtcctccttcctgtttctcttagagaagcttcattatttaaacttttgtgcttccagctgtaatctgtttcaaactaatggtgattacaatgggatatcttggcctggcatggtggctcacacctgtaatcccagcactttgggaggctgaggtgggtggatcacttgaggctaggagttcaagaccagcctggccaacatggccaaatcccatctgtagtaaaaatacaaaacttagccaggcatggtggcacatggctgtaatcccagctactcgaggggctgaggcactggaatcaattgaacccaggtggtggaggttgtagtgagccaagattttgccactatactccagtctgggcaacagagtgagactctgtctcagaaagaaaaaaaaagaaaaaaagaaaaagaaaagataaaaggggcatctttgcacagtagaggaagataactgagagaaatgaagacagcatggcagtagcaaaagcagtagaactctggtccaatgtgtctggatttatggcaggaagagacaagataaattggcctgggattgcatgttggttttattatgagaaggccattttaaatagcaagtatattcttcaagataacttttctcattctcaaaatttcaggttcgaatgctggagtagggaaacttgaaactctccttattgaaggataaatggtaatcctaaaaatgtagtgatctgcctgagaaaattcctagtccaataagtactctaaaaagttagattcataagaaaggtgattctgtttactagaagaggtatataaagaatgttccatttaggcagaatatgtacctgagacagtttccatgaaactgttgttgggcaaaataagatttttttgaggaagtcaataattttatcttttatgaacaactttactttagaaatttacttttaaggacttttggttatgctgcagataagaaatattctttttttctcctatgtcagtatcccccattgaaatgacaataacctaattataaataagaattaggcttttttttgaacagttactagcctatagagttctagaagattttttgtcaaattttattatagattaaagggtacaaatacaggtttgttacataggtaagttgtgtaacactgaggcttggggtcccagctattccatcacactgacagtaaacatattacccaacagatggttcttcagcccacatctcttctctccctcccccatctagtgatcctcagtgtctattgttcccatctttatgttcttgtgtattcaatgcttacctcccacttataagcaagaacatgtggtatttggttttctgttcttgtattagattgcttaggataatggcctcctgcttcatctataatgctgcaaaagacataacttttgttctttcttatggctgcataacattccattatgtatgtactagtctgttctcacgctgctaataaagacatacctgagacagggtaactcataaaggaaagaggtttaatggactgtcaattccacacggctggaaaggcctcacaataagtctctgatagagacttattcactatcacaagaatggcatgggaaagtcaggcctccatgattaaattacctcacattgagtacctcccgtgacgtgtgggaattatgggagctacaattcaagatgagattttggtggggacacagcctaaccatatcagtgtatatttggtacattttccttatacaatccactgtcgatgggcacataagttgattccatttctttgctatcgtgaatagcactacatattggggtgaacatattggggtgtgtgtcttattgatagaatgaatattttgggggcatatactccatagtgggattgctgggtcaactggtagttctattttaagttctttcagaaatatccaaactggtttccacagtggctgaactagtttgcatacccaccaacagtgtaaaagcatttccatttctctgcaacctcaccagcatctgttgtttttggactttttaatattaataattgctattctgactggtgtgagatggtacctcattgtgattttgatttgcatttctctgatgattagtgatgttgagcattttttcataagtttgttggctgcttgtatgtcatctattgagaagtggctgttcatgtcttttgcccaattttaattgattttttttgttttttttttttttttgcttgttgatttgtttaagttttttatagattttgtctgttgatacatatttagattttggatattagacatttaggtcctttaaggtaggaagagtacaggaaatagtcaagaagactttaacaaatttctaaaaacagagagcatatagaggaatgatatatctgtacagagagggtaaacttataaccaaaaggtcagaagagaaaaatttatcaaggatgaaaagttaatcagtgtcccttaaatcctcccaatattggtatttggaagtaccgagggtcaaagatggtggagaatgaggctgaaaaaggaggctctccctgcctacgtttcctccacaactcttttcatcaggtaactgatttccttccacaagaagaaggaggctcactctctagagaaactgagcttaagaagccctgtactcagagacacacagcagtgccagaaaaggcatgaggtgtaggctagaaagacagattaggtacacatccactccttgaattcagagactcttagctcttttattcatcttccttcctaaaattcagcagctagctctatcctacagaaagggaactgatctagagaaatggcatttttcttttgccatcttaacagacaattctcttcaatgtccaacagagtgaatgaaatgaaaacatatactgctagatacagggttatggaatttcaggacatgagaattaaagggaaaatcacaaaaactttcagagctgtaccaggttatattgaaagaattagaattcagaattctcaagaagaactattaatattatcttgtatattaataaaaatagtgttttcagatgtgcatgtttgccaaaaatttttaccattttccctttctcagaaaaatactgaagaatgttcttcattcaaatgcctgaaaccttgttagagaaagtcctgagctccagcaatcaggaaacctcgtgtaggagaatgagagtgtcagggaggctgcctagcaccagacctagaaaacaactacttcagaacagacctgggggataattcagaagtgagatgagacagcaagaacaaaagagatgtgacagattttatgagagtttccaataactaaaaaggagtttcaaacatctgctggaacatttgtaaataattctaacttgggaaatggaaaattacaaattgaaataaagagacattgttaagcccaggaaagtacaaaaataaaatttaatcatagttgtcttaccagagaaccatatttgtgtagtcagaatgatgtaagcaatgaatactgatatcataaaaattgtcatctaaatatattctggaaaaagcagtgtggaaaagtgagtgtgtctatctgagggtgtgttcaaatatgaggggaagatggagattaaaattctcatctctcttaataaaaaattattaaatataatctacaaaaagataagtaagaattagaaacagagtatttaaaaatgtgaatgtatgttcagaagaagctgctagaatgttcaaaatggtagatttggaaagtgtgagaatgaagagaataccattgtgatttgtgacccctcccacacacagatgcaccaatacagtcatatatatgcataaatctgatagtataatttaacgtttaagcaacatatgttattttgatatgaaattaatctgtttttcaaagacagtaatttcatgactaaattatatgcttactttatgttttcaaacattttattatttttatttgtattaattatcatatatactaatgtatatgtatatacatatcttttaattttttttaatttttatgggtacaaagtaggtatatatcaatatgtttgggggtacatgagatgttttgatacaggcatgcaatgtgaaataagcatgtcatggagaatggggtatctattccctcaagcatttattctttgagttacaaacaattcaattacactctttaagttattttaaaacgtacaattaagttattattgactatagtcacccttttgtgctatcatatagtagatcttattcatctccacctcccctccccccacactaccctttcgagtctctggtaaccatctttctacactttatgtccattagttcaattcttttatttttagatcccacaaataagtgagaacatgctatgttcgtctttctgtgcctggcttatttcacttaacgtaatgatctccagttcccttcatgttgttgcaaatgactgaatctcattctttttatggctgaatagaactacattgcgtatatgtactacattttctttatacatttgtctgttgatgcatatttaggttgtttcaaagtcttagctattgtaaacagtgctgcaacaaacaagagtgcagatacctcttcgatatacctatttcctttcttttgggtatataccaagcagtagggttgttggatcatatggtcgctttatttttaggattttgaggaacatttaaacagctctccatagaggtcacactaatttgcattcccaccaacactgtacgagggtccacttatctccacatcctcactagcatttgttattgcctgtcttttggatataagccattttaactggagtgagatgacatctcattgtagttttgatttatatttctctgaggatcagtggtgttgaccacctttttgtatgcctgtaacccatttatatatcttcttttgagaaacatctattcaaatcttttgcccacttttggattggattattagattttttttctatagagttgcttgaatttcttatatattctgattactaatctcttgtcagatgaatagtttgcaaatatttctctccattctgtggattgtcttttccctttgttgattgtatctttggctgtgcagaagctttttaacttgatgtgatcccatttgttcatgtttgctttgaatgcctgtgcttgtagggtattgctcgaaaaatttttgcctagaccaatgtcctggagattttccctagtgttttcctatagtagtttcacagtttgaggtcttagatttaagtctttaatccattttgagttgatttttgtatatggcaagggatatgagtccagtttcattcttctctgtaggatattaaattttcccagcacatttattgaagagactgtctttcccccagtgtacgttcttggcacctgtgttagtctgttctcatgcctctaataaagccatacacaagactgggtaatttataaaggaaagaagtttaatggactcacagttccacatggctggagaggcctcacaatcatggcagaagatgaatgaggagaaaagtcatgtcttacgtggtagcaggcagatagctttgcaggggaactcacatttataaaaccatcagatgttgtgagatttagtcactatcatgagaaaaatatggaggaaaccacccccatgattcaatgatccctacctggcctcccccttgacttgtggggattatttcaattcaagatgagatttggggtggggacacagccaaaccatatcagcccctttgtcaaaaatgagttaactctagatacgtgaacttgtttctgaattctctattctgttccattggtccatgtgtttgtttttatgtcagtaccatgctgttttagttagtatagctctgtagtttaatttgaagtgagataatgtgattcctccagttttgttccttttgcttaggatagttttgactattctgggtcttttgtgggtccatatacattttaggatttattttttctatttctgtgaagaatgccattgatattttgataggaattttattgaacctgtagattgttttgatagtatgggcactttaacaatattgatttttccaatccatgaacatgaaatatttttctgtttgttgggtcctcttaaatttctttcctcagtgttttatagttttcattatagagatctttcaattctttggttaaattaatcctaggtatttaaaattatgtatggctattttcaatgggattattttttaaatttctttttcttttttttcactgttggcatataacaacactactgatttttatgttgattgtgtatccttcaactttactgaatttgttcatcagttctaataattatcttgtagaatctttagtttttcctactataaggttatatcatctgcacacaaggatattttgacttcttcctttccaattttgatagcctttatatctttctcttgtctgattgctcttgctaggtcatccagtactatgatgaataacaatggtgacaatgggcatccttgttgtgttcctgatcttacaggaaagacttcctattttctccattcaggatagtactagttgtgggtctgtcatatagcttttttatgttgaggtatgttccttctatctcaagttttttttatgaattttcatcaagaagggatgttaaattttatcaaatactttttcagcatcaactgaaatgatcatatggcttttatccttcattctgttgatatgatgtatcacactgcttgatttgcacatgttgaaccattcttgcatccaagggataaatcccacttggtcattgtgaatgacctttttattgtattgttgaatttggtttgctagtgttttgttgaagatttttgcattagtgttcatcaggtgtattggcctgtagtttttttttttttttttttttttgatgtgtcttagtctgattttggtatcagggtaatactggcctcatagaatgagtttggaagtattctcttctcctttattttttggaatagtttgagtagggtcggtattagttcttctttaaatgtttggtaaaattcagcagtgaagctagccagtcttgggattttctctactgggatgattttatttctcgtttgatctttgtgctggttattgcatgttcagattttggatttcttcctggttcaatcttgatgggtcatatttgtgtagggatttgtccatttcttctagattttccaatttattggcatatagttgctcatagtaaccaataattattctttgaatttctgcagtatcagttctaatgcctcctttttaattttttatttatctgaatctactctttttttttttcttagtctggctaacggtttgtcaattttgtttaacttctcaaaaaagcaactttttgtttcattgatcttttgttttgttttcttcacttaaattttatttatttctgctctgatctttattattccttttcttctactaattttggttttaatttgcttttgcttttctaattctttaggatgcatcattaaattgtttgtttgtcaattttctccatttttgatataagctcttgtagctataaacttccctcttagtactggtcttgctgtaacccctaggttttggtatgttgtgtttccattatcatttgtttcaagaaatttttcaattttctttttaatctcttcatgggtccactgttcatttatgagcatatttttaaatttccatttatttgtgtagtttccaaaattcctcttgttattggttgctggttttattacattgtggtcagagaagatgcttgatattatttcagtttctttgaatattttaagacttgttttgtgacctaacatacggtcaattcttgataacaatccatgtgctgtggaaaagaatgtgtattctgtagcagttggataaaatatcctgcaaatatctatgagatccatttgatctatagtgcagatgaatttcaatgtttccttgttgattttctatctggatgacctgtccaatgctgaaagtggggtgttgaagtctccaggtattattatattggggcctatctctctctagttctaattatatgtcttttatatatctgggtgctgcattattggttgcatatatatttaaacttgttccatcttcttgccaagctgaccactttatcaccaatagtgatcttctttgtgtctccttatggtttttgttttgaaatctactttgtctgttttaaatatagtaactcatgctctttttttcatttccattggcaggtactgtctcattcaattcctttattttcagcctatgtgtgtctttataagtgaagtgtgtttcttttaggcaacagattaataggtcttgtttttccatccaggtcagtaacaggtcagtatgtcttttgattggagattttattccatttacattcagtgttattattgataagtaaggacttacccatgcccctttgttatttgttttctggttgttttgtggacttctcttccttctttcatttcttcctgtcttcctttattgaagagaattttctccacttatatgtgtacagatttttcttaatatctggtttatggcagttacacatttgtgcatctgtaaccatcctctctttaagtttgcatatacttccagcactataatttaaatttataatgatgtttggataccttcatgattcatatacccctgaattgctacaacaaatgtgccatttttctccttttccatcagtttttacttgtgtcttatcagctaaagtccaggaagagattgaacgtgtgattggcagaaaccggagcccctgcatgcaagacaggagccacatgccctacacagatgctgtggtgcacgaggtccagagatacattgaccttctccccaccagcctgccccatgcagtgacctgtgacattaaattcagaaactatctcattcccaaggtaagtttgtttctcctacactgcaactccatgttttcgaagtccccaaattcatagtatcatttttaaacctctaccatcaccgggtgagagaagtgcataactcatatgtatggcagtttaactggactttctcttgtttccagtttggggctataaaggtttgtaacaggtcctagtgtctggcagtgtgtgttctccagatttattatctttcttcaagattggtttggctactcttaggtgcttatatttccaaataatttttaaaggtattagtttgtcaatttcccaaaaccttgggctggaatttctggcagggtgacactaaatttataggctagtttggaaagaactgaatcttgacacgttgaggctttccattcctgaatataattatgcttccaatttgtttggggtttcttttatttaaccaggaatgttgtgaatttgttgtcatggctttcgagtctttggttttccctagataattaatatttttgttgtagaacataaatagtttttatcattctgatgatgttaatctgtcaactttgctaaatttactagtcactattcgtaatttatttctggattcattgtaatttctgtgtatattatactgtatctgagttaatattgttttatttcttattttccatttctcatgggcttaatgtctctttatcgcattcattattgcattagctagaatttctaggagagcattgaatagaattggtgacagtggggatccttgtttctcatttctaatctgcaggaagcagtggaagttttccatttcaatattgagaatgatgcttgaagtagattttggtagatattttttatcagattagagaagtttgctgtcatatatatatatgtcataattgtgtgtaaaatcttgtcaaatcaacactctgcatctatttatataattgtgtgttagtccatttccattgctataaaggaatatctttgactgggtaatttataaataaaagagtttcattttggctcatggctctgcaggctgtgcaagaggcataatgtgggcaggcatctactcctagtaaggacttcaggtagctttcaatcttcggagaaggtgaaggggaagcaagcatgtcacatggcaagagagggagtaagagaaaaaggagtagaagtgactttaaacaaccagctagtgtgtgaactaacagaatatgaactcacttattatcatgggaagaggtttaagccactcatgaagaattcacccccatgtcctaaatacttctcacaccagaacccacctccaacattgagaatcacatttcaacatgagatttggaggggacaaatatccacacaacatcagattatatatattgggcttacatttctcactaaatagaaataagtatgcacatagagatgaactggccttcttcatattgtttaggacttcagtgtttacattcacaagagatttggtttatagttttatttctcagaattttcaagatttttgatattaagattatgccagccttataaaactatgcaagaaatgtttcctaatgtgagactgtttttattgccgttccctctccccacttttcttcttgtgatcacttagttgtatctttgaaatgcctgataacttttggttaaataccagatggtatatgtaagaaattgcagaattgcagaggaggtttatattcttcaaagaaagattcattcctctcccatcggcagtcataatgacatgatacctgttgtcatgattcagaattggacataatgtgaatccagttgaaaattgagtgtcagtgttagcttagctctctgaggttctcctacctttggaagcttgagaccaatttttgtcttgacagctttgcagtgccttctatcacatggtttctgtatttatccagacactccatttgccatctcaaacctactcttttccaatcaaaaccaatatatattattagtaaaataaaaaataatataactgaaagttgtattttcaaggggaaaaagcaatgagacttggtaaggttgcaattactaatgtcatcttttgaagaagacagaattgataatttacttagagattatggggcttaccctagtggtcactgagttagtacaagagaaaagacttcaatgcactctgttttcacaaacacaggagataaccaggagactttcgcttctcaaaattagggtctgagggtaatggtaatgaaacttacttcttctcctataactaattaaatgagaaatatactgaagaatcaggcacgagttgccagtctccccagttcactgcatcagctttggtgacctcctggaggggaacgctgcatctgatgagctcatgctgtgcctgatgtcttttgagccctgagaagccagagcccaaggggattacccattgaatcccttcttcgtggaatagcccagtgcagaaaaaagcagcactgtgtggccaattctaccctctttacaaatcagatacatgtgttcttctgctacaggctggatccacttatctagctggagatgatagtctgagacaggagttggcaaactgtctctgtaatgggccagatagtaaatattttagacttttcaggcaatgtggtttctgttgcaattcttgacatctgctattgtagcatgatagcagtcacaaacaatctgcaaatgaatgaggattgatatgttccaatttttatagaaacaaatgtaaatttcctataaaatgtttgtttcaaaaatattgtttcttgtttgcatttgttcaatgtaagtacttttagctcacatactatacaaaaacaggtggcagggtggacttgtgcagggagtattttttattgatgcctaatataagacatccctgtccagtagaattttctgcaaagatgtgcgattgatttgtgcttttatgtcatatttaaagaatatttgtcagcacaagattccaaagactggctttcaactttcccagaatttttttgttttagctcttatatctagatcaatgacatatttcaaattaatttttatttcataatatgaagtaatagtggtcatgcttcaatgtctataaatttctacttattcaagtaacatttgttgaaataaatctgctttggtatcaataacattttaatatagtacttgtttataaatattcaagggaatatttttaaaaaacaaaattatagactatttatatgaaaatttagggggtagaatttttcctaacatttttattataaaattttttaaaataaataacattacacacacatatgtatatgtacatatggcagtgtgtatacatatctactctgatatctgtccatccatctatttacacctcaatacttcagtatgtatagcacaataacaatggttttctcctacataataatagcattcatactgtggagttattaatacaataatattatttactatacagcttttatttaaaatttcccaactttaaaataatattttaatcacttttttcttgcaattcactctccagtcaagaaataagcacatagtttcagtatcctgttactttccatctcctgtaatcaagaagagtccatttcctctgtttcctttcagtatgttgatctctgtgaagagttgagcaattagtcatttaaattttcctggggctcgttttgggtaattgttttctaaatattatattccagttatgactttggcaagaaaactacatagtattttgaatattctgctgaatcacagtggtgaggcaggggcacataatgtcacatatgccattattggttatgctaagatcctcacctaataagttggaatctgccagatctttccattgaaggggttctgctttttatgcgtgaatgatgaaaatctatggcatggtacttcaaggcagaacaccctgtttcccaagtcacacatccaatagttttatctttcattaatgatcctcatctgacctgatgatcttgacctgaatggttacaaataggtgatttttctaatttcatcattccttccgtatttttaagctaggattaatctgtaatgaatatctctcccatatctttaaatgaagacaaacaaactgcatggcaatgacaagaactcaatagttttatccttgccactacacttgttaccatcccagaagatgtcatttgaaattcaatcatatgtttattcacaaatgccctgtgaacagatactgtggccatttcccatgtcaacagagacttcaacttttagttatactctacacataaggttggtgaaaactgaagtgatggaatagagaagcaagtgtggacagccactagtttccaagcttgatgaaaaggaggacagattcagaaggttgcatccaagtatccaagtactcaggacttcaaatgtgattgcagggcactttagcaagattattgtcatgggccttaagttcatgactcttattacttggtctatccatctggaaatggtactgcccttctttggaacgggatttcctcatctgcacatcaaaagatttaactacatgattaccactgtttcttcaaccttcatggcttctttacagctcagttcatctatgtctcttgtttctagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggtaatataaatttatttccatttgtgtttcagggtacaagataacttttttgatccattggaacttacatgtgcctcctctgcagtggtacaattactctttgtacatgatcaagagcactgttctgaatgcctgtgtacaccctgctcatgatacatcctaattattgggccagattagtggactttggggagttaatccaattcttccaaattgagaaagctgaaatataggttggttgaattctgcctctaggtacaccagtgaggtacccaagaactcctcctggaagataaaactaattacattttcctcactagccatgaggaagttatctcactccagaacttcactgagtgtcttccacatggtgtccctcaccccctaggctgggcttgtaggataaaattatccacaaacacagaatagggtcttaaaaggctcacttctgagtttggaaagcagagtaaacagatcattgtagttcaataggactgaggctgtgatatggaaagaacaggctgttgggggttgggaggtagacggaaaagctgtctgcttcttgtactcttataccccaaagtgaggcataagtaatattttaatagcagtaaagacatttgagctacctcaaaggaggcagagaggatgaaaagaagagaagacagggctattaaaggagataatgagccacaggagcaggacattggctctaaataaaggatattagaacctttgccaaatgaccatggatgggatgagggggacattgggaatgtagcaggatactctgcagtgatgcagagcaccatgctgttcccctagtcatggccatgtatattggatgttggatctccatacttgaaatgtgtgtgctgagcatctggtgatagaatctccttcctttattctatgacctttaatgtctgctttatatctgccactgtagataccaagacaacaagaaaagaaaccttccttcaagcattcacatttagcacatgtattagtccactcttacattgccttaaagaactacctgagattgggtaatttatgaagaaaagaggtttaattcactcacagatccacaggctgtacaggaagcatggctgggagacctcaagaaacttgcaatcatggtgggaggcagagcggaagcaagcacatctttccatggcagagcagaagagagagaacaatgaggaaaggctacatacctttaaacaaccagatctcatgagaactcactcactatcatgagaacagaaagggggaaattatcccccatgattcaatcacctctcaccaggtatctcccccaacattgggaattacagtttgacatgagatttgagtaaggacacagagcccaaccatatcgcacactaataaataaataaataaatcagtaattattattctaggtgatccatgctgtctgtttcttctgccataacaaaatatccaagactaggcaattgataaataatggaaatttatttctcacagttctgaaggctgggagttccaagatcgatgtgtcagcaagttcagtgtctgatgtgggcctgttccttacagataatgccccctctgtatccttatatggcagaagggcaaaaaggcaaaaggggagaaatggctcccttgcatctcttgatgttattattttagcaaggacagagccctcctgacttattcacttcctaaaaggagccatctctttagtaatgttgcattgggattatgtgtcaacatatgaaattgggggaggcatattcagaccatagcacatttttcaatggaaatataatgttgaggaaacccagagaaggcaacattttcttgctcaaggagatgagaaagagggtaaaaaaggagataaaatttgacctatgtcctgactgtggtaatagaaaagttcatcttggctaaaaggagcagcatgatataaaatttgaaacctcatggtgtgttggagactgatgatgagtggctatgcctagagttgacagtatcggatttgaagagtgtaaggagtgatgtggatcatcagactggaaacagaatgtgagggtccagatcaatccattgggaccttatcctataggacatacagggaagccatttaaagttttaaagtgagaaggtgacatgtttagacatgtgctcctgaaagtacctagaggaaaaaaatctttggctgcatattgagccagaaatacaaagggaaatacagtatgttagcctcctcctctaagcccttctcagttcaacccactggacaagaaatgtatgtttctaaagaaagattgatgaagacatttaaagtctcttgaaagattttaataaagtgcttggcatgtagctggtactcaacaaatatttgttgaatacagggtgcctgttaagatctgatattaggtgaagagtaagtatgtccattcatttttcagttgcctatacatccatccattcatccatttatccatccactcatccatccattcattcatgcatgcacccatccacccatctatctcttcatctcttctacgattcactgaacagttattgcatattctgtttgtgccagttacagagacagtgtttgtcactgtcacagttacgcatgaggagtaactgctctctgtgtttgctattttcaggaaaacggatttgtgtgggagaagccctggccggcatggagctgtttttattcctgacctccattttacagaactttaacctgaaatctctggttgacccaaagaaccttgacaccactccagttgtcaatggatttgcctctgtgccgcccttctaccagctgtgcttcattcctgtctgaagaagagcagatggcctggctgctgctgtgcagtccctgcagctctctttcctctggggcattatccatctttcactatctgtaatgccttttctcacctgtcatctcacattttcccttccctgaagatctagtgaacattcgacctccattacggagagtttcctatgtttcactgtgcaaatatatctgctattctccatactctgtaacagttgcattgactgtcacataatgctcatacttatctaatgttgagttattaatatgttattattaaatagagaaatatgatttgtgtattataattcaaaggcatttcttttctgcatgttctaaataaaaagcattattatttgctgagtcagtttattagaccttccttcttttatgcataatgtaggtcagaaattaaagaaaatagagttccaggaggccatgctggttctcaaaatgataaggacagaaaggacaaagaggaagagggtagggaagctattttgggtgagtgttagagttacttgaggattggatttgaaagtgagaaactgtgtccaggggcagctctaacctctagggaaatattcagaggatcagtcaaagggtggaatggacattaaatgctagaattcttatatccacattggtgttcctttttttttgagacaaagtcttgctctgtcacccaggctggagtgcagtggtgtgatctcagctctctataacctccgcctcccaggttcaagtgattctcctgcctcagcctcctgagtagctgggattacaggtgcatgccaccacacctggctaattttttgtatttttagtacagacgggttttcaccgtgttagccaggatggtcttaatctcctgaccttgtgatctgcctgcctcagcctcccaaagtgctgggattacaggtgtgagccactgcgcctggcctggtgttactttgaagtgtcattactttatctctaaataaagaatcagattacttttattacttcatgtttccaacttagaatgatgtaatgaagtataaatacatgctttcatatcgctgctcatgtgttctgtcatgtttctctcttcaaacataaacaaaatttctttttggtttttgtttgtttgtttgtttgttttgagatgtagtctcgcttttgttgcccaggctggagtacaatggcatgatcttggctcactgcaatctccacctccagggttcaagtgattctcctgcttcagcctcccaagtagctgggattacaggtgccaacccccataccaggctaatttttgtatttttagtagagacagcatttcaccatgctggccagactagtcttgaactcctgacctcaagtgatccacccatctcggactcccaaagtgctgggattacaggcatgagctaccatgcttggctgggcaaaatttctaagaagaattacaaagatttaatctctctcagcttctcctacattattttacttttaacataagtgggatgataattttatgctatggtcctaaatataattagcctcatgtcatctccaaagaatagacaactaagtatcttatgttaaattatattcaccacttttcctgtcttctacttgaaatgtaagaaataagaagtaacataatttgttatgcttctcacagctcatctcccagaagaagttacttacattttggaatacgttttaaagataatatgtggatacaggtgtacatgaacatctatatatgtctgtgtacattatgtgtatttacccattttatatatatgcatatatatatatatatacacacacatatatgtaacttatgcacacatacatatagggttaaatgtttattacaatattgggctcatatcacacatcttgtattaaaacttgttattttcctatcaagtaatatggcagcaaaacctctaaggtgatagaaacatagggaaatgattgagagagataatagaagagaaagtggaaatgagtattacattaatgggaagatccaaatggaaattatacattatacctttcaaccttcttcattgggaaatgcaaatgtattaatgtagtgttagtagaggtgctggcaaacacccctaggtgagataaatcaagtagatgtcaagtctgttttctcctagagactgtagtgaataatctgttttcctgcctatttcacctcctaaaggctgcctgcattccttggctcatgaactcttccttctttcactccaaacacttgcttctgttgtcacatctcctactcctactactgactcttattctcacatctcccttacattagaaatgcaaaatgctttttccctggtgtcacaaa

SEQ ID NO: 11862 - DNA, 37304 bp, Human
  misc_feature (1)...(37304): n = A,T,C or G
ctaacctctcccagtgtggaacctctatctcatgagaaagctgggatgagggcaattatggcccggggtaggtattatttctgccttacaagtcagggctggatggaggaggatatccctagacctcttagccagtcttgcctagaatagagcttctgcaacatgacattctgggggctgggtataagaaatgctggcagtttttccatctcagggagatactgtagccttcatttgagagctagggaaagtgttcttggatttaactgtctagaatggggtttctgtcacgttgatctggggactaggagaaagagtgagttatggctcaaatgccacagactcttactgtgtttactagcatttagtagattcttcttaaataaaatttatttatttactgtatgcctttagaacaattttcagggacttaaattattttagttttataaataatttttagcaatcacaattttttactaggaagaggttctgtggggtttctcatgctgccattatggaagtcattcccctgcatcattctttaatgcaaaaaataaaaaggaaggagagatataacaaacctgacgtccactgatacgggaatgagcaaataaattgtggcatagtaatagaatactatccatctattaaattaagtgaattagagccacatatatcagtcaggataaatctcaaacacataatactgagttgtagaataattcgtgtaaaaatatcatatataaatattagaaatattgtatggatgcataacagctgtagtaaaacaggaaaatgtggactagaaggataaaagctaagctctgactagtatttctctctggaccttagaaagagaacaagagacttcaactctcatttcatttcttgctcacacctgtaatcctagcactttaggtggctgaggtgggcagatcacctatggtcaggagattgagaccagcctgaccaacacggcgaaaccccatctgtaccaaaaatacaaaaattagccgggcatggtggcatgtgcctgtagtcccagctacatgggaggctgaagcagaagaatcgcttgaacccgggaggtggaggttgcagtgagctgaactccagcctgggcgacagagcaagactctgtctcaaaaataaagaaataaaataaaatattgtaagcagaatatgtgactctatgttgagtacatgagtgtgtactatactattcctgagctatgtttcatgttttcagtctcaccatttgtgaaacccaagcaggcactcaccagatggtatgaaaggctggaacctggaggtcccacagtcttggggctttggagaggagcctaatagagcaaaccagcaaggatcggaactaagacattccttcaacaaatgttaattaagcacttattatggctgctgctcagtgctagcagctttggtgtagtgccttttaatcttccagacactttcaaatacaggacctcgtttagatgtgtttcagaagggtggatttatttgttcaccacatacttagtacttaacttttctgtttcctcaacagcaagatgagactaccgagagcttctccttcataattttgtcaaaatgaaataataatctatgtaaagaggcggatgtgctgcctggcatatagtaagagcccaagaaatgttaggtactgctgttgttatcgctgtttaccaggcacagttccaatcataggagagacggtgattgaaccgaacagaggctcaaatgtctgtggcgctctcagtaaacccatgagctttctaaatagaaaagaaactgctcctagcctggccttttctgagaccggtgcgtgtcctcccgggaatccagcgcctggcatcttcgcagggtgctgcgaaggggcgggctgggaggcggggcacggctgggagcgaggcggggcggggaccgtcgcctgctgggaccgccgcctgcttggaccgcagaagagcaggaggacgtctgagccatgctcgcggcgatgggctctctggcggctgccctctgggcagtggtccatcctcggactctcctactgggcactgtcgcctttctgctcgctgctgactttctcaaaagacggcgcccaaagaactacccgccggggccctggcgcctgcccttccttggcaacttcttccttgtggacttcgagcagtcgcacctggaggttcagctggtaggagtgggagaaggtgcctagcgtgtcctgaccctaactctgttctgcagcacaagggacgttccggcaacgtgggtggggtgggggatgaagggcaggaagaggtgtggctaacgctggtaacctggtaaaacccactttgagtttcatttcctaacccattaactggcatgattccacctgcactttctagggatggaatattattaaatgtttactatttgcatgttgtcatgttaaacattactggaacaccttacttgtaatgtgattaccttgccctcttttatatgattgtccttaaaaatgctatactttctttctgagaaacttcatttcccatacataaaatggtgataatactacctcaatcttgatcatttctcaactgagttattcccactacactaactgagccctccagcttcaacctccttcccttgcagtgcactctcactaagtaataattttaaaatgttcttcctctgcttaaatttttgccaaacggtgttcagactcctgactgaaccacctgggacccttcttgatgcagcttctttccgtctctatacaataatctcctatcagggctccccgactctggtgaccaagttctttcaagttctctcagacatcaaaccctatctcaagaaaccaatactggttttcctgccactcagcacaggtaacttgctgagagacaacagtgtgacaagtgattatgaagattagataaaatagtgaatggtcaatactgacatatagttggtacataacaaatagtagttcccctttccctgcacatgcctgcagtactttaaacacatggctgtatattgccctcaaatattgatagacaaagttttatcactttatgggagaaatacccaattggtaatactaagtgacagaattagccacagaatgttaaaactaagcccccaaacctgtgtccttatttaattaatatgttgtttaatttccaagtatgtggagattttcttgttatcatttctgttaattatttccagtttgactccattgtggtcaaacatcatactatgtacaatttcagttcttttaaatatgttaaggttgattaaatgacacaagatatagtctatcttgataaatgtgccatggaggctggaaaaaatatgtatttgactattgttgggtggaataattgatataaattattgttgggtgaagtaattgatatcaatatcaatttgattttactgggtaatgatattgtttggtttgcctatatccttgttgacttgttatctacttattctatcaattactgaaagaagaatgttgaagtttcaaaggacagttgagagtatctatttctccattcagttctagtagtttttccttcatgtatttagaaactctgttgttttgcacatacacatttaagattatcatgtcttcttagtgaattgatccttttatcctgtaatgtccctcttaattcttcataattttatttgcctaaactgtactttatctgatataatatagccacaactttttttctgattagtatgtgcatggtatatgcatttctattctttaacttttaaccttcttgtattattatacttgaaattagtttcttgaaggcagcatatacttgggtcttttttttcattctggcaatctctgtcttttaattggtgaatgtagactatttatatttaatgtaattattgacatattaagatttgtctaccattttattatttattttgtttttcctgttttttatgcctctgttttccttttcctatcttcctgtgaattacttgaacatattaaaaataattttattcttatttatctgaggtgttttttagcagctctgtttgtattatgttttacaagtgattgctctaaggattacgatatgcagatgtagctgattgcagtctattagtgtaaaaattttactacctcaagtgaaatatagatatcttgcaaccatttaggttcctttaccctctctacttcataattgttgtaagtgttatctctatatacattgagaactacatcagataatattataattttgcttttgaatgttaaatgcaattttgaaaactcaagagaataatagtctattgtatttactcatttatttacccttttcatttatcttttttcatttctgatgttacaagcttatcatatcctttcagatctgaagaactatctttagatattcttttagtgcaggtgtactggcaagaaattctcttagctttccttcatctaagaatgtatttatttcaccttcatttctgaagtatatttacactggacatagaattctaggttgacaattcctttcattcaacattttaaaagtttatgcttcttctttttggcctctgtggtttctgttaagaaatctactgtcatctgaattgttatcccccatatgtaatgaactttttctcactgccttccttcaagaaattttctttgtttttgtttttgtttaattttcagaggtttagttatgatagatcttggtgctactttctttgggtttatcctgtttgggtttctgaaaatatagatttctcttttgccagtttgagggagcttctgccactctttcttcaaatatttttcaactacacattctttttcctctctttcttggactcttggatactgatggcacaaatgttaggtctcttgttgtgccacgagttcttgaaactctgtttttgttgtttccaatgtagtttctctgtgttgtttagtttgaatatgttcttctgagctgtcttcaaattcacagattctgctatcattaccattctgctattgagctattttactgaattttaaaatttattctattgtattttcagttctaaaactttcacttggttcttctttatcttttatttctttgttaaaatgtcctaattttttgtttgttttgagactattcatagttattggaaaagctttataacagctgcttttaaatatttaattattctatatttctaacatctgtgtcatctcactgttggtgtcaactcactcaattgatgttctcttgattcttggtaaggtgagtaattatggactatatcctggacattttatatatttgttataagacttaccctggatactatacagatcttttattttagcatatagcctatttagattctgaatgctcacttttgtgggtggcagttcaaatatcaatgcaggttataaagcctctgcagtgctattctggtctactccacttttattacccactcccacaggagcccatctcacattctcatcagtgcaagctggggaaaaggaagatggaacagaagacagggatccctctggcatagtagcttatgctttactacggagggaagagagtcagagatctgcctatatctcctccaaggggaagtgcacctccttattactgtagaagaaggctggaaagcctaatttgccctctgactcctgcagggagtttctttacttcagcttaggaatagaagtcgcaattcagctcacagactcagcagagaagggtactacctcattattgcaaagtaggctgaaagacaaggtactatccatgtactccagtgctataggaccttttagagttgggaagggtcaaatgtttttcatggtatttgcctccacaacaaagaagtaaaaaggctaaatggtttctgtcctgttgggttttccttttcctggtcctttggctagagagagtagacttttcttaaagatatttttgtctgtgttaattggtgtcatgattaatagaagtaaaatggaatgctttttttcaaccttatctggaataagaagcttgatctgcacctttgttgtattcctaagataggtgttaaaagaggggttaaatgacttgcctaatgtcacaaaactagccagtgacaaaactgagactgggatctcatccttggccctgtgattttcttatcacactgtcatcatttatttttattttatataggtttgcatttttatgtttctgggtgtaaaacaaatggagttaaattatgaaatttagttataattaaatttacattcttgcaattgggaaacattaagtactaactaatagatcttacataagtatttttatgtcagttttcatttcatcttcatgatgggcacacaagttaggtatgatctggtggtgcttccattttaccatggagcaaaatgactgagaacgaacagtgaactgcccgggttattcagctaaataataacaaataaggatttgagcccgagactatttgatttgtatacctattgtgggatctggccagcagcctgcagtgcaacagggctctttctttgttcccaggtggatcggcaggtcgagaaataaaagatacacacaagatagtgaaagctgggtccaggggggtcacgaccttctggacctgcgatgccgccagtgcgctggatataccagcatttattattaagtttagtgaggatgggggtaggttagtgagggatttagggttgtttgattatgaggtgagatggtcacatggggatgaagtaattctttaacatcagtatgcagaagtacagtatacagagataagaatttacaatatagtgtgtgcatcagcaatttctaacagagnnnnnnnnnnnnnnnnnnnntgctcgtttgcaaccagcttttgctagacaaccggttagaccaaaaattctcagagggagtatgccttaaccctaaagagacctaggaagagccgtggcaagataagggcgtttataaccctatcttatccatgtgaacaggtgcccctcatgggtccatttataggctctccacaagggttgcattccattcccagagctatgatcatctgcttttctgggataggaatcttggtgatgtgaaacctccctgactgcatgtccatttataggctctctacagggggaagcacatcaggcactgttggctcattctggcagcccaacctggcattgtctttacacaatcctgcatgcaattttgcatttacaataatcaggagcatttcatcttttattccgtaacaatagtttcagggggtctccctacatatacccattatctactttatgttgcctgacttttcatgacatggttagaggacaattgatgtactcacatgtttattcactcaacagacatttattaagtgcttatcatatgccaggcaaaatacaaggctgtatatgactaaatgtatactgtacactcttggtaaccaaatgagatataaggagattggatcactgaatggaaaccctggggataaccttttgtagaatgttggaagaaattgggctaaattttaaaggaaattttgatttttggcaagtggctaaatggagtaaagggacagaagatttttaataggggaaaatggtctgagccataataattttattattaattttagtattatgattacttatcacaacaatactaaacatgggaactaataaagtctataaaatttggaaactaagacagagaaaagttaaataactttctcccaaatcacacagaaactaagaagcagaacctggattcaaacaagtttgtataatttcaaaatccaaactcttaagcactcccttacatcacctcccctactcaaacatcttagaattctgattgaaaaccaaacaagatccaaaatattatacctgatattaagactctcctcagcctagctcagattaccttgtcagccttgtctcccatctcccttatcaactgagaagatgcttttcccaggagccttcctcaaccctggtcctcttatgtggttcttaacttcctcccatcaaatattttattgtaaagaatgataataatgagaagtgattatttatctatatgctccattagattgttagcttcttgaagtgaaggacttgttgcactccccagcacctggcattgacctgccacatggtcagtgctctttaaataatgaaccctatgcttcagtcagacaaggtagctctcttgctcccaaacaccttctgcatttcccctttacatctgtatatggtgttctcaccatctagaatgcctttgatttcttactacatgttttttattatcattgtggtttgggggttgttggtttttgtttgtctgttttttggtggcatcctgactttcatttaagatctggctcagataccatctactctttaaaaagatatttttcttatatctgtggtggaaaatcatctcttcttgcgatagctttatgtccctctctatcagcataataacacatgtcatctgctgtgcattccattttttttctgcacagtcagtctctcccaagagactttgacactttaggaacacatcatatcatattgatctttgtattacctccatgtatgatatgccagtgccagaaggtgcctggcaactcttaagcatctcataaaagcctgttaaattgaacatgaatttaatctccacagcctgttctcagaaaccagcgcagccccaagaactacctgtgagaccattattcttggaaggagttcatgggccccagaggactggtaactcctgaaactgcatgcaaagctctttatgtgtatagctgtgtatgtgtttactagagatcaggtctatcatatacattatattttcaaaggattctataactcaaaaaagtaaagaaccactgttttaaagctttatttcccatttccttgtttatttttttttctttattggataaaaaagctttttgactgtaaaggcaacaatacatacacagtgagacaacatattaaaatacagtttaaggagagagagaatcttacctgtctttgtgcctatcctgccaccactgtgcatgcgtgcacacgtgcacatgtgcacacacacacatacactcagcggtacctctataggaccttggtggatatctttccagatttgtatgtaagtgaaaataaaattatatttccaactttttattagaaattccacgttatcaatgagaaaaaagttgaataccttgatacagaaatgtttgaaagacataaacatacgactttaaaaatacaacatccagattgagggacagatgttaaacctcagagaaatatagaaacagcatgcatttttgtgcctcttaggatctctctctctctctcgctgtcacacacactcacagaggcacagctcaggggaacagaccctctgacctactgctggtaggagtgtgaattagtacactctttttctgtttttcttttcctcttttcatgtctttgttctgttggttattaaatttaagaacttagattcagtggaatctctgtaaactttatatctcttggtagccatggttcaatagttcagtctcttctcccactaatcctttacttcttcctctttactgtaaacatttattttgttccacccttttttaaatgcttatgctacatttggaatttttattcctagcattacatttcctgtctcctattgcttttgtttgacttttatagattctgtttcagttcttttctttttctattttcatttctgattttaagactgtttttgcctttcaaaaggcatcttatttttatctccttttgttttattctgttaaggttttttttttttcgtggctcatttaatgatatacaattgaaaagtgtgccctgccttacaaagtcttctcagaggccctctgggtcatttaatctttctaaagaaatggataaaatgactgacagggtgcacgtaagaattgttagacatcgccatcctcatcccagggctcctaccccgtgtttaaacagttgataataccatacaagttttttatctagttctgtttaattcgaaatatgcagtggcagagagttggtagagataaaattcttaggaagtttatttcagtaaatagtaatggagttctgaatccctcccaagtacaagctaagattctaggctgtatactttgctagttagaagtcatttttaacctgagatttttcagctcttccaaaaacatccttatttaatgtcctaaattagtcaagaaatccttcttgtcaggcctaagaagttcatccaggaattcagcaagggtacattaaaaaaattgcttaatgtgtatggtcccattactgccatttcttagaagcaaagatgcttactttaggagcaaactgacttgagattgaatctcagctctgcttttcctagcaagacaggacatgctgtgtaggagataaggactgatggaggactctgggccaaaagaatacaaggactgagttcaggcttggactttaatgtgggagcaaggtggtgggataagactgaatccactgtatttgctccgatggggaccattaggaacaggactctaagaggaatatggtggagtgtaagtgcaaaggcatctggattgtggagaagaggccacaaacacctaaaggaaatgaagcccttcggattgttaccactgcctgcagctagacacaacccaggcagaaaaaaggcaggggcagggtctacctgggaccctctgttgaacagatacattaggaaggattttgattcgtgaccatacactgtcctccaacctacatttgcagatatttgcacacttgtgcacattcatgaacatacacatccccattctccctctctcccaccccaactctctcactctcactcattcttactttcactctgtcactcccactaaactctgtcactcaggttctggagccatcttgggctcacgtctttgtcctcaaatcttacataatgcctgggaaattccctgcaccactcaatagctttgtcacctttgctgtgttgtttcagctataattcattttctgtcttgaaagataagaactattactactgtaaggtggttgtgagattaatgagataaaatatgaaaggtgcttagcaatggctgcctatgaccatgagtgccttcttcccacacaccagtgggttcctgtcccctttgccaccataagaatgcatccacggccctctgcacacagagctctttcattcctcggagactcgctgggtggctgtgcgcctggaacaagaaaacaaagtgcctttcacattgctgctctcattcttcctcacagaaccttaagagagaggaataattttctcccttttatagctggggagttgaggctcaaaaaataaagcaacttccgcaagagccgaaaacgattgaactatacagcccagattgtcacataactccagagctcgagggctttcctccatgcctggcacctgccctaaaatgcacctcgtattatctagcatacgtttctattatctatgcccagtctaggaagggggcattctcatttggttaaacagatagttatgatttactaagaagtccatacttggtacaccagattaacactaatcatgtctcagccttcttaagtggctgagacatgattagtgttcaggtgagaattcagatgtgctgaattctctctattcactagactctaggatgcttggggttagaaatcttgtttactatgtctatatattgagacaggctttcactctgtcacccaagttggagtgccatggcacgatcatggctcattgcaggctcaaactctcaggctcaagtgaccttcccacctcagcctcctgagtagctgggtccacaggcatgtaccaccatacccagctaatttttatttttttgtaaagacagggtctcactatgttgcccagactggtctcgaactccttggctcaagcaatttgcctacctcggccccccaacgtgttgggattacaggcgtaagccactgcacatggccagaacttatttattttattacagttttatcctcatgccttgctctagggacacatgatagatgctcactcagttcatgttggttgaatacataaatagatatttataaagaaacattcacattctgaagtgaattgaatctgagccttgttgagagaaggagaaaaggaaataaaagcattcccatgagaccaatgtacactcactcacacacacacacacacacacgtacacacacagacacagacacacgcactcctctcaatatgatcccctccagctacacacatcctccatttctgaacacatggacatgtgcatattcaactgttacgatttaactatttttcagtttgtgaagaaatatgggaacctttttagcttggagcttggtgacatatctgcagttcttattactggcttgcccttaatcaaagaagcccttatccacatggaccaaaactttgggaaccgccccgtgacccctatgcgagaacatatctttaagaaaaatggtaagtttcttggccaacgaaaggtgagtgtttgatgttgatagtcctataatctgttaaaggcaccttggtgactgtaattttccaacactcctagaaaccagccccataataaacttcctgccactaaagaaagctggatattcacatttcctgattgaagtcactccctgagaagatttgataagatcatccctcactgggatttgggagaaaccacatgccctgcccaaacctactctggatgcttttataatgaagtaaccatgttacccatttatagcagaggaacgtgttctctctgttttcctcttccaaccctctctccttaggaaaatggatgtggatcttcctcctcctgctgctgcttcttcctgtctctatttccttattctctttcattaaggttgtgtcacacagaggatcttgagccttctggtctatgatagaacagattggcatgaacagattggcatgaacacttaaaattaccattaaatataatgaaacatttaaaaattgaaatgaaaatctcaaatctattattctattaaatcaccacttttaggtatgaagggggccagcccttccacacctatgggtatttctcctcaagtgggacaagagactgagaaaagaaataagacacagagacaaagtatagagaaagaaaagtgggcccaggggactggcgctcagcataccaaggacctgcactggcaccggtctctgacttccctcagtatttattaattactattttcagtatctcagcaggaggaatgcggcaggagagcagagtgatagtggggagaaggtcagcaagaaaacatgtgagcaaaggaatctgtgtcacaaataagttcaagggaaggtactatgcctggacatgcacgtaggccagatttatgcttttctccacccaaacatcccagtagagtaaagagtaacagagcagcgttgctgccaacatgtctcacctcctgccatagggtggtttttctcctatctcagcattgaacaaatgtacaatcgggttttataccgaaacattccattcccaagagtaggcaggagacagtggccttcctctatctcaactgcaagaggctttcctcttttattaatcctccccagcacagacccttcacgggtgtcaggctgggggtcggtcaggtctttctcatcccatgaggccatatttcagactatcacatggggagaaaccttggacaatacccggcttccaggggagaggtccctgcagcttttcacagtgcattgcgcccctggtttatcaagactagagaatggcaatgattttaccaagaatactgcttgtaaacattttgttaacaaggcacatcctgcacagccctagatcccttaaacattgattccatacaacatatgtttttgtgagctcaaagttggggcaaagagattggggcaaagaggttggggaaaagttacaaattaacagcatctcagggcaaagtgattgttcagggtacaggtcaaaatggaatttcttatgtcttccctttctacatagacacagtaacagtctgatctctctttctttaccctacaaggtgcttttcaattcttagaaatatttcatcagttaattctatatccattcactgtattatctgccttgtgaagcatggtactaggcatgagtgatggaacagtcagaagaatagataaaatccatatcctatgtagtttatattctatgcagaaagaaaaatagtatcagttaactataatagaagcctacagtgttatgaagtcaagttcaggatgtacttattaatgcagtcctgggatgcagaaaaagtaaataaatattcatttaataaactggtgaaacaatctggcagacagaatagaaaatgaaaagcccctgaaatgaaaaggacagggaacttgaagaaatgaaaggtggccaacatgacaagcatggggattaaaaggagataattaaagggagatgaagctactgagcttggctaggaatagttcatgcaggttcctgttaaggacactagttgttatcctaacattaatggaagctcttgaatggctttaagtagagaagggaattatatttacactgtatatttttaggttttatttaggctgccattcagagaatagaagaaaaggagcaagggacttttgtagcattttaggttacagacagtggtagctcaggctaggaaggtccaatagcagtagggaaataacagtaggttagtccaagatagtagcagtgaagacctggatttgagatatccaggaaggtacacctcttaagacatgatgatgtaggtgcagggagaaggaggtgttgaggtgacactcaaatgggtagatgatggaaagaaggaacacttagaagagtataaggtatttggtttagttgggcatgggtgaaaagtcatatggagaaaactgtgagttcaatcatggatatgccgaattcaaaatacctttaagtcagcaaagtgaggcaggcagcgttgtatatatgcttctggagctcagggacagaaatagatggtcactatcaatagatgttatttaaaattttaggagttgataagatttcccagaaatagagtatagggtgagaaaaagaagaggttttagatgaagaagaagttcctgaagaactccaccatttcaagatttaatagaagatgaaccagcaaaatatataggaagttgctggcagagaattaggacgaaaatctggagacagtggtatcctgagcaccactggaaggcagtatttcaagaaagaagtgtctactgctgctgcaagtaagacgaggtcaaaaggtatccggaccaattcagtgggtgagcaggccatagtcagatattaaaaggtgttgaggagtgctctggaattgaagaaattgaaaggagtatggcattacctgtgttataaaacaaatgatggtctgtcaaacacaccaaaatttttttttctttgcttgtactcttctttctgtatggaactttcactcctccttgatctcttgattccttacatcatcttttaatgtccaggttagataggacctctcctataaagcctttcttagccttagcctctttaagagtatgggcattgtcttaaccattagtgcattcctagtgtttagcataacataaatacttaactttacttatgtaactaataatcaaagcatgggctttggaataaggcagacctgaaattgaatacctgtttagttgcttacttactgtgagaccctgtaaaatgcattttatcctttatcccttgttcctcagttttttcattagtaaaatgtgtggggtggtaataattgtacctatcccagagagtttctatgagtactaaattatataatgcacaacaaaatgcatattaaagtgcctgccattgcaagcaatcagtaaatattagccattatatccattgctttgggattatttctctgggcagttttcaagtgccttaatgatcttctcctgtccttcatctgatacacattcccatatcatttgctggatattcatattatggaatcagaatactgtaatgttgactttctttttcccaggattgattatgtcaagtggccaggcatggaaggagcaaagaaggttcactctgacagcactaaggaactttggtttaggaaagaagagcttagaggaacgcattcaggaggaggcccaacacctcactgaagcaataaaagaggagaacggtgagcattgcatatgacagaggtgagagactgtggcccatttgttcattggacagatacttactaagtgagtaagtgcttgttctatgcccagcactgtgctaggaatggaagatagaacagtgaacaactctgtcctcaaagagttttagaagtaaatacacaaagatgggcactaaacacattactgaatttaagccctggtccgcagtttgacttccctggagttgactgaatacttgttgtatgtcagatgcagtgtaaggtcatgtggccagctcctcatatatggttctgcactaggtatgtcttatgccatgtaaagtagactctcagtaggaaatggagacaaatccatcagaaggatccatcttgcccttcctccaccttcaggacagccttttgaccctcatttcaagatcaacaatgcagtttccaatatcatttgctccatcaccttcggagaacgctttgagtaccaggatagttggtttcagcagctgctgaagttactagatgaagtcacatacttggaggcttcaaagacatgccaggtaaggcagctgtctctccatatctttgttcagtaaattggggccgatgtcagccacagatgggtttttccttttagttttttttgggtttttgaagttaaaatataacctttcaaaactaatttcaacacaaacttatttgaaataaatctattgactttagttttttaactaatatggaatatttatatgcaaaaaccatttctaacatgcatgtaaagtacaacatgttatatgacatacgcctatccacctatgttgttctttttaaaaagaaaaacaatattgctgttgcccttgagtctctcctctctgtgtccttccccaactcgtccatttccctcctccctcagaggttctcttctgtatcctctttcttcctcagcaagttgctttgagagtcatctgtgctggttgctcttttttaatgcagattagtatttcattgtatgaatgtgccactttttgtcaatctgttctgtactgacggacatttgtttccaagttttggatgctatgaataaagctgccatgaacattcttgtacaagtgttcttgtggttacatccactcatattttttatatctgtatctggagataaaagaagtttaaagattgccaagctcattgcattatttgcctgcccaccagcacttaatatcatcaatcttctaattccatagagtgtagccgtttggagttcaaactcacttctcccttggtgggccctgcaccacaatttttgtccctctaagcctttgagtctttgtcaaaaactctgctcggtttcttggttcctcagacactttttggaatttggaagacatttctgggagctggggggaggggggagaagttgaccccaagtattgagttcataccctgggctttcttcttcccctaagccttatcctggaaactacctcactaccttgatttgtatgtatgtgtgcttaaatgtttacacatgtatctttttcatcttttcttggtgttctcagtagaaagagtgcccttgaattacacagtatgccattatcaaaatttttaaaaatttccttggtttaagaaaatgactttatttttgaaaattacaaatgtgtataaaagaatacaatcatgaatcactgtgtatactcatcagtgagctctaacaattatcaacacatggccattttcactgtatctgcatctatgccctactaccacattcccactgtccctgaattattttggagcaaattacagacctcaattatttgatacataaatatttcagcatatatttctaaaaagacccattttaacaaaaataaaataccattgtgcctgaaaaatatgaacaatagttatttaatgccttcaaacactcaaccagtgctcagatgtccccagatgtctcataagtatttttttttggtggcaagctgttgcggtggtgagaaatggtccaaggctggatatatttttgacagagagctgaactgttttgctagagaggtgagagagaaaagaggggtcaaggataaccaaggtttaagtgtgagcaaataaaagagacggaaagagaagatggtttctgttgtcttaaaaagaaaaaaatggcaccatgttatctgcatgattgttttgtttttctcaattagctctacaatgtctttccatggataatgaaattcctgcctggaccccaccaaactctcttcagcaactggaaaaaactgaaattgtttgtttctcatatgattgacaaacacagaaaggattggaatcctgcagaaacaagagactttattgatgcttaccttaaagaaatgtcaaaggtgagaaaaccaaagtcattttgtattttgttcttagagcacaaatagaggtatattagtttccaactgctgctgtaaaatatgatcacaaacttggtgcctaaaatagcacagattgattctctcacagttctagatatcagaagtatgaaatcagcttcactgggttacagataaggttttggctaggctggatctctttggaggtgctggaggagaatctgtttctattactttcccagcttctaggagccgcctatgtcccttggcctgtggtcccctccttcatcttcaaagccagaagcacagcatcttctcttctctctggtatctgcttccatcctgacatactttctctctgactttgaccctcttatttacctctaataaagactattatgataacactgggcccactggaatgttccaggataatctgcccatctcaaaatccttaaccacatctgcaaagttcctttttccctataaagtaacatccctaggttccagacattaggatgtgaatggatatctttgcgggtcattactcagcctgctacaggagtaaaaataggggcaatatttcagaaaatgtagggtagcattaactcaggattgatgatgcaattagagataaagacaagggttaatagcatttggtttgaggtcctgtgaatgcccaaatacagccctttcatcccccatcccctaccctttactgttatttggaggtatacacaaagggggaacatagcagttaatcctcaaagctctgttctatcattagttgggcctagacccaatgacctaccattttcgcagccctcatagagaacacaagtaaagctgagttggatgccagagtttaaaggccaactttattaaggcctgagttggactttgccttcccttctgttttgtacctttcactttccaacattataggccagaggtgaggaagaaaccaaatgggatgcgtgacctttaacacagttacccctctggttaacacatatcactgcatcaatactgtcatctttacacatcaggaattgggtcctacttctggagtggaaagaatggtggatttctttccctcttatttcaccttattggtatgacatttatagaagtattgttttctcctcagaggaggagactcgctatatgttgtgcaggtaaggaagggatcattaacattaagagcaacattggacaaattgaagtttccagaagatgatggtaaagatgacagagtatcatgaggaatggttggtagaatcagtgagtttcaaattggaaagaaaaaggtgaatgaagagatatgagaattgttgttcataagagaaattccatttgccttttctgttatcagtacaaatgtttgttgagtatttgctctgcgtccttgcattcatataattcataatgccctcttaagaggtgtgcactcctatttccagtatataaaacaggaaactgaagaacagagaggttaagtgacttgccctaggtcacacagctgctaattgaagtggttaatattggaagccaaatctgtctcgttcacatcccattctcctttcactgtactaaaagcttccccaaaattataggcataagaaaataattgtcttgattttcatccatccaaaggtgtccagcacttggggcaggacagtgctaatgatattgctgtaataagagtctgccttctgaagaggccaaagggaaaattgtttcttttggggaccttttcttccaaatgtcctcctaggatgaagcccctttgtgttacggcaatcaggaatcctctgaataaaccaataaataacatcaaacattgtgttttctagcacacaggcaatcctacttcaagtttccatgaagaaaacctcatctgcagcaccctggacctcttctttgccggaaccgagacaacttccacaactctgcgatgggctctgctttatatggccctctacccagaaatccaaggtgagcatgtcagtgagtaagcctgaaccaggacagaatagtgcctcctgggatgtgctgcctgaagtcggggccagaagatagcattgtaggatgaaaagagaggcagaacagtcatgagtgatgaggacttggaaactgcacattcttcatattttctgtctgaattgtgatgggcccaggtaatacaaatgtaagagagaatccttgtcctcaagaagctcagaggcaagagggaaatcaacgaagtcagtcgacattgagatagttccaggaaacagttaactttctgatgtgaaagtctagttgtgtccttcccttcttttaagtgatgccttccaatttcctccagaataatgttcaagcactttagtctggtatatgttaacctccgatatgccccttctgcctgtctagccttggccgcacctaccctccatggtggcctcactaagtgacacgtcactttctttgcagtctatatttatgcctctatgtcgtgatagatgcttttccctctacttgcccagttttcctacatagtaaactcctagctcttcttgaagaatctgttcaagtactacctctctaagatgtttctgtgctcccctaggaaattattagcattttctccctccagagatgatgtaatgtgcctttattactaggcttatcatgtattatctatatatagcttccccacagactatagtccactcaagaatgatgttctcattatttttcttcctccagcttccagaaaagtttgaacatatgggggtgggaactcttaacaatacagtttttcaaattgtgggtaactgtttattaatgaggcataaaatcaatttagtgaatcaagaccaacatttttttcttaagataaaaatagaaaagatcagagtgcttcccatgtactaaggtaagtttgtttacagaactttatttttttcatctgtagttgcataatgtatgctttatatgtatatttaggtatatgcatccaggttcatgctcagttaaaaaggctagtaacaaacagataagcactgtatgattccacttacatgagttatcaagaatagtgaaattcctagagacacaaagtagaatggtggtggccagaggctgagggaggggatatagagcctcagttctgcaagatgaaaaagttctggagagtgattgcctaacaatgtgaatatatttaatactactgaactgttcatttaaaaatgctaacatagtaaattttatgttatgggtattttacccccaaataagatgttttacaaaaatgataatttatttcgctttcaggtaaaaaaaaaaaaatccaaactaggctttgcaaagccattagggttcccagctccttccaacttgttgctctgttgtgattagaatgatgcccttgttagcactctgtaagacggctcaccaataggctttccaccagtaggaagcaaaagggggaaggaagtgcatatcctttctttaggaacctgttccaaggattaaacatcacttctgcttacattctattagccagaattgagtaatatggtcacacttagttacaataggacctggaaaatatattcttttttctcgctctgtcacccaggctggagtgcagtggcaccatctcggctcactgcaagctctgcctcctgggttcatgccattctcctgcctcagcctcccgagtagctgggactacaggcgcccgccaccacgcccggctaattttttgtatttttagtagagatgggatttcaccgtgttagccaggatggtctcgatctcctgacctcgtgatccgcctgcgttggcctcccaaagtgctgggattacaagcgtgaggaaaatatattctttagctgggcagtcaggtctccagctaaaatctctattactctagagaaagagaaaagagataaggctgctacagtttctctctttggctaggtgagcactcaaccaatgaaagaaactgggagcagtcctatctggtcacacaaatctcaaaacatcagttcatgtgaatgtcaaaacatccttaagatgaaggtagatttatcctcactaatcaaataaggaactgaggtttaaagagtgtaagtaacttgcagcatcaatgttgtagagcaagagtttgcaacctgatgggtcttacctcagggcccactttccactcttacatatctacctgagaaattagagtctgtagatctgctatgggttgaatacttgggcccaccccagcccaaatttatatgttgaaaccttattaccagtgtgatgatattaggaggtggggcctttgggaggtaattagccttcaggaatgggagtagtactgttataaaagagactccagagagctgcctcactccttctactatgtaaggacacactgagaaagtgccatttgtataccagaaagtgggtcttcaccagacaccaagtccgctggggtctgatgtaatgaagtttagccatattaatcctggtcattccatcccatagcctaaccaggctcaaggagatttacagaggtggtagttttctgaataagcctttcaaaaggttaagaaccattttatttcttgcaacctggtcactaattgaaatacaacagatgacatcttggagaccactcatacctctttataataaagcataaaagtttaaaaaataatagaacccttccctctttaccagaaaaagtacaagctgagattgacagagtgattggccaggggcagcagccgagcacagccgcccgggagtccatgccctacaccaatgctgtcatccatgaggtgcagagaatgggcaacatcatccccctgaacgttcccagggaagtgacagttgataccactttggctgggtaccacctgcccaaggtaattaagcagatcttcaagcccatcttttaggggggtagaaacttgaacttgagaagtgacatttattcttgtcctaaggaatcatttaaatggaagaaaaagatatcttatacctgatataatactagattttctccatgtgtagtcttcaactagataaataggtattgtggggaggggagcaggaaggattcctacgttaaatatgtttagataaagactggcttttctttcctgtggggcctctcagtgtttttactatgctaatgtgcattgtgagtctgtgggcacgtggcaggcagcagttctaggtcagactttatcacagaacacttttctttgttttggtagaacatctcaccagactagggatctgccaaactttgggaaattctgcttcatgaacctggggttctagaatgctaaaatgtgaaaggacatttaagaccacctgggacaacatcatattaatgctggtgtttttaacataatatccccacaggtatttttccagttatttcttatagtcccgtgatgtataatttattaattaatgtatgtatttatttatttgagatggagtctcgctctgttgcttccaagtagctgggactacaagcatgcgccactatgcccagctaatttttgtatttttagtagagacggggtttcaccatgttggttggccaggatggtctggatctcttgacctcgtgatccacccacctcggcctcccaaagtgctgggattacaggtgtgagccactgcttctgacagatgtataatttattatcttataaggaagccaatctaagcgtgtgcaatattcattattgggaagggaaagaaaggagtgaacatgtattaagcaatgattatgggttgtggacaatgtggtctctttcaaaatgtcttattcaattctcagagtaagtttactcagaagaagcttgttatttccatgttatggattgcgaagtcaaggctcagaaaaattaggtttgcatgagatctctcaactatgaagagttgggatctggaagcagatctgttctgtttctttgtgagacaccatgctcccttcacaggacttgctttacattgattttaaaggcatctccctattattttttcaattggtctaagttaaattccctgtactcacaagtggaactctttctttttctttcaacttttgttttagattcagggagtacatgtgtaggctcgttacaagggtatattgcacgatgctgaagtttggagtatgattgaaccattacccaggtgactggcatagtatccaattagtagtttttcaacccttgccccactctctcctccagtaatccccagtgtctattgttcctatctttatgtcgatgtctatccgatgtttacctcccattataagtaagaacatgcagtatttcattttctgtttctgcgacaaacagaattctgatgtcactccattcgccactcttaggatctctgcagacaactatcctgtgccctctagtgccctctccccacattgcacattttcagttcctttccttgctttctaaccactttggtcagcctccgtggatcgattccagtctgtctaagtacctctgagtgtgtcatacctggggaaaatctcgagaagtagaatcagaagagcttacccattgggcactacttggttactatccctgcagagccaggaaaagcagctgttacatttactatttccttactgattgaccatttagtggataaaggctgaggtctaaattccccaggtgctgtttgcatttttctagcaatttatttaactcaaggaaaccagcttgacttctgctgctgctgatttttgtcagctttaaaaatcatcttgggaactgacaagttgaaataattgtgtgttacacagtctacgagctatgactttgacgtcaaatagacctaattcaaatcatggctctgcctcctcccactctctgactctgggcccattattttacctctcaaagcttcaatttcttcatctgaaaaatgcatttaaacctacttaacaagatccacatggaggtaaaatgagatcatgcatgtagggcatttaacccagtacttagtacagaaagtgcttaaaatagcaattattggccgggcatggtggctcacacccgtaatctcagcactttgggaggctgaggcgggtggatcacctgaggtcaggagttcgagatcagcctggccaacatggtgaaaaccgtctctactaaaaatataaaaactagccaggcgtggtggtgggcacctgtaatcctagctacttgggaggctgaggcaggagaattgcttgaacccaggagatggaggttgcagtgagccgacacactgcactccagcctcagtgacagagtgagagtctgtattaaaaaaaaaagttattactaatattggcaatcattgatattaattccttgaagtaatattatattaatatgttaatatttgaatgaattcaacaaacactacatacctgaaatgctcaggtctggcaaaacaaccctgagaaaagtaatcatgcaagtacatatttagaaacgtgataactgcccaaaggaaaaaactcactgtggtctgtaaaaacagactagcaggagtggtcagggaaggcttccaaaaggaagtgatgtttgagctgaggattagcttcaagagttagcttgatgacaaagtggggaggaggaacattcctggcaaggcaaatagcatttaaaaaggatgctgaattaagtaggaaaatggcatgtttgagaaactgaaagaagagccctgtagtgggagtgcaggcagagggggagagtagtgcagaccaggaccaggtgaagagtctttgccctgagagcaatgggtaactattgaagtgtgtcaagtcctaggtatgagcagtgggggctgtggaggtggggaatgacatgactaaatcatgctagaagctcactctcttccagagtgtgaagcagattgaaaggggtgacaggatttggggcacagttaggaaactataacagtggtccaggcaagccaggaagaagtctggactaagtgagcattggtggacatggaatggaggtgaaagtaaaattgaccagtctcactgatgggttggataacgacagagtaaaggaaaagctccctctgggaactcctgtgtttcttagcatgtacctggatggacaggggctccttgcatgggtctacctgattctattactaaacctaccatggggagtggggtgccatgtactagacattggaggaaagagaatggtgaaaccaagatgaatgagatgtcttttacctttgtagagctgccatcgttatagcttcactgagcagctgggctggttttggtacagtgcagactgactgttggattattctctcatcagtgcattcatgccccctccttccaagccctactgaaactgacctgtccctgtaaggaagctcgatcctgcagtcaagagtagccagacatccttgttaaaattcccagcagggaaatccaatctaatttgaaagctgtcccagacaaagagaagggtcctgggttgggggacacaggagactgtgtaccacaattggggagggtggggcagtatgttcaggcccccggcaaggaagccggaggatgaccacccctctgcataggtgtgctttttcatgggtcaagccttgcctgagtctctgctgctttctctagggtaccatgatcctgaccaatttgacggcgctgcacagggaccccacagagtgggccacccctgacacattcaatccggaccattttctggagaatggacagtttaagaaaagggaagcctttatgcctttctcaataggtaagttgtagtaaacaggtgtgtgggagtccagggcccctctcccagccctcccctgctctctcctgttttcccttgttttcattggaatgtctccagacagcctggccagtgcgactcactccatcttgctgtagggggcagccctgggatttccaaggctgggcattgcttcagcctgcccttacttcctaagccctccattcattgcctctgctagagatttcagctttcctgtgttctgtcctctggaaaactggtgacagagatccagactccaccaccagctcacaaagaggattaggtgcttccattttttttctttttttgatacgaagtttcactcttattgcacaaggctggaatgcaatgccatgatctcagctcactgcaacctccacctcccaggttcaagcgattctcctgcctcagcctccctagtagctgggattacaggcatgcaccaccatgccaggctaattttttgtatgtttagtagagacgaggtttcaccatgttggccaggctggtctcgaactcctgacctcaggtgatccacccgcctcggcctcccaaagccaaagtgctgggatacaggtgtgagccaccacacccggtcgggtgctgccatccttactaaatgttaaaatgtcctcagttctttttaagggctgcccactcacacagaaatagagctgatttataatgagatagagagggacaaggggaaggagaaacttatttgccacatgggcatcagtcagtggcttaacttgattggattctactctctaagtactcccttgaaaaggttctttggcctttgtaaattttaattcattttttaaaatctaattaatacatttatataatatgtaacttgaaaattaagaaagaagaggcagtgaaaactctctttttttctcttgtttttaagatagccaggtccaaaaatatatttttaactcacgacattgaacaatcaataacaaaacttcttaatatgttccaggttttgagttagatatgttgcatagattatttcaaataatttcacaattctttaattccatcaatatttattgagcatctattatgtgtcaagcattcagccctggtgatatgacaatgaatgagtgaaacagaaaccaaaacaaaacaaaactgctcccatggtgcatatgttctagtgtaatcatataaagtttatattactataaccactttagtgatgaggaaactgaggcttaaccaagtatagaaactaaagtcataaaactcatctggcagaggtaggatcaatgtcaaccagattaatcaaaaactaaagtgggtgttcttgctaacactatctactgaaaataactaaatactacacagacccacactgtggaatgcacgatagtttgcttattgttaatttaaaatatgtattgatgttccgagacaagatcattttgctgagaatgacactgaggctcagaaagggcagaaacggaatgacccatgttggtgtgactccaaagcccatgctctccccctgtgctgtgttgccttaggtgtctctgggctgattctgatgatcgatgctgtctttgtctttcttcatctaattctgtcacctccgctcacactggacaattcacttagaatatgaaagctgatataagacataggactatcttccagtcttcctgtctacaagagtttgaaattttgtattatagcacaaagtttcggctgttatgttccagttattataattaattattcctgttctttggctcttgcacaacatccatgtggaaatgctagaaatgtgacctctgcattccacaaaaaatgcttcacctaatgccagctgcaaccgtgatgagaggaatcttattagaagtccgtggttttaaaaggaaaagggatcctctgggctaagtgatgcctggataccttttcttcacatcacagaagcctctttctcatagttccttcatgtctcctgttttaaaaaaattatcttatctgaattagcagtagtctttttaaaaactatacatggtgactcactgctgctttgctattgagaggtgtattgcaccctcttagagacttcatttgcaagaaaattgtctaatttaatcattacaacagcccagttattaatagttaggcaggaaatggataggtatctccttttaatttaagataactaaaaataagagagagttctttcttatccaagatcatatgctcaaggaatttgcagaactggtcctaagactcaagattttatacttctagtctagtgttctctctagtacgactagaatgtagcttacttccccatttaaaggcctaagattcactaatttcataacatatgcatcagttagcatattgctacataacaaacagtccaaaactctgcagcttaaaacagtaagcatgaattattgctcacaagtctataagtcagatatgtggctgtgcccatcttggctcggccccctggatatctctgatcttggccagtggtcaacaggctgatggctgatataggatatcttcacctgggacagtggggcccttctcacattatccctcatcctccagcaagctgtcctggcttagtcacatggtggtgataaggtcaaaagagggagaatggaagcacacaggcctcttaaggtccagactgggaactgacacaccatcacttccattgcattatgttttccaacaccaatcataaggccagccccagtttaaggggaggggatattactacaatttttgatgggaagagctatgacatcgcattgcaaatgatgtggatccaaggagaggggaaaattgaggctgctttgttcttaccatctctctttctgactgagaagaatgaaattcatagaaggcaaaaaatttatctgggatgtcccaaagcagatgtgataggatgaggaccatttaaatggatcaggagatagaaatctgaagaatccaaagggttgacaaaacatcaacacaactgtctgtttttttcatcacatgcccatcttttggcatgcagttgcttttccttgctgttcctttactcttggtaaagagtcttctagaggactcttccgaagtcctcactttagaagatgtaacagcttctaaagtgtgcataatcaagacaggtttcaaagtttttattgcaaatttatatttacttttcctcatttaaattcttcctgtttgatccatcaaagcagcaagcagctttatgaaatacatgagcccagttcctctctttccagttaaaatcattagattctaggagatagggctggaaagaactttgccaaaattgtaagtcagttctctcattttactactgaggtaactggcctggttggttagtgatagtcagtttgtggaagcaccagggaggggagccaagtatcctttcttccaggccaaagctttgacacctaacagtcctagtttccatgcttttaaaagcaaattcatatctgccattgcattgggatccttgcctagccgtgtaacatggttaggagagaagttatttcatgtatgtgacaaatgagataagtttagttttgcgagaatgaatggtttattaatagtcacacagttggttactgatgaagccagttctttaaccctggttcctgacttgctaggtccagtttgtcatgatatatggattcttttaggataatcttgggtatttacaataaactgacttggtatcattttagcatgttgctaattgtactatttgtgatggataaagagataaaggtgaggggaaccgagatgaattagacacacactgttgggaaaacaggcacaaataatataacgacataaccatgaagcatgtttgcctttactaagcatttttgcatatatgatctaactttatttccttaacaacctgttacagacaaaggacaaaacttaggcatgcatacatttccacgaatattaaattacatgggaaaatataaagcagtaaaagcagcaaatagaattgactatagggaataatatctgttatgatgtacagataatctccacaaggacaatgaggaaatatgttaaaatgttgacaatggttttgtctagattatgggattacaaacattttatggttttgtctttataactttctttttcatgctttttaaaattattgctgtgaataggtactacttagggagaaagtaagctactaaaaatacacacaatagagatggtggtagtgacttgtgtggggtaatgtagcccaggtggggtgaggaggacattcacataggggagggggtggtggaagctgagtgctggcctcagagcacaaatggtatgaggtggagtctgcacagggtggctgtggcagtgatgagaggtaagttatatacaagggatactgatccaataagtaaatatattgaggataatgagaggaagttgcaaataaagaaagggagaaaatcgaactttgtggtgttggattggaatctgatgtaatctacaatgaactcagattttcaataggtgaatcaataaatgtagaaatgtagatgtaaatatgggtatatatatttggtgtatatatatatatatacttggtgtgtatatatatatatattttatatatgtacacacacacacttttggacatatacccacattatatacatacatatatttcttagctctgcccactgatataagctaggggcaacaacatctggagagcaatgagcatgcctaatgcccagatcttgatttctacatattattatccactaaaagaaaccaggacttttggaaaaaaatggctgattccagggctggggaagggaaagtattataaacctggaatagattgttgtgcccaaagtcaggaaatatcagcttgattgggcatctaatggtcaaatctggaatattttgagcatcagaacaagtaatgatagtaacagattataaccctttgaataaaaacaggaatcccatgcatttaactgatatcaataaatgagtgaataaataaatggggaggggagcaagcatttcccttagtaaagtgttaactaataaatgtggaagaaatgacagaattttaaaaatcgcgatttggtagccatcagcaattaataatatggtcaagagatatacctaatgctagatgacgagttagtgggtgcagcgcaccagcatggcacatgtatacatatgtaactaacctgcacattgtgcacatgtaccctaaaacttaaagtataataataataaataaaaataaaaataaatcaaaaaaatatatatggtcaagaaatagcaatggaaaagaatggatcacagcttaatgagaatggtttgttgacatagtctcaaagtacttattagttacagagaaaaagaataattttacaagagaacttggtagacaccaccttaatcaagtgattaccaataatgtaacacatcacaattgtatagcacttgatagtataaaatgagaagaatacagtatcactttggtgatattcctacccaaaatggaaaactccacagcctgaatccaatcatgaggaagcatgagaggcatttacaaaacaactggtctgtaatctttaaaaaggccaaagccgtgaaagttgtataaagagtgaggacttattccagactgaagaactaaggcgacatgacagctaaatgcaatccatgatcatgtactggctgtactggacccttttctaatgaaggactttgggacaactggtaaccctgaatgggacctcgggaagatgttggtcatgcatcagtgttaatttcctggcttggatggttgcattttgactatgttggagaatgtctttctttttagaaaatacatactgaagatttcatgggtaatgtagacaatttacttccaaacaacttagaagagccaagttctttgtctatctctgcaagttttttgtacatttgaaattatttcagaataaaaggcttgttatggaaagtatcacagtaaagaattgtaatatacagaaagctgtttgagtaatgctaccacccaaaagattttctttagaggtcatcttttaaattgtattctcctgttttttgagaattaaccagatcaagttaataataagcaattgtacagttatgtttattattacctaggtgacattttaaaatactttgttttgaggtataaattattaaattatttagcttatttggattcagcatgtagctcacacaatatataaagttctcatcttaaacacatattcgttttcactaatatgcacaatgtacattttcactgattcctagagaggttgtttaatttgccccaatcacgtggttaggaggtgggagaagctgaattgaatctctgcccttctgccttcagttcacccacacataacagggagtgggacaaggtcagggcaatgctaggtgtcagctgtggagaccaggacccagccttgggccacacttcagaagaaatgcctgcaaagggaaagggccactgtgcataagaagaaccactgaaggaggaaggccaaagcagtcgcaatacagagggccacccatgccagtaggtcccccatgattaaggaggaaaagtggcacagggaaaagatgacttataccttaggaactctgctctgacatttatttccttatattttcaacaatttttttaaggattaaaaaagtgaacatatttggttgtttttgttgtctttttttgtcacgtttgttaaatgatttttttaaagctcttaggctaaacatcccctttctagctcagcccacgccttccgcttctatggtcctacaccctgcaacttcattctggaagctcgcctgccggacccctgatggcatttgacttcgtgttcctggacttctgctttctatgcattgatgaacccaagtggttatcagacttaaataagctgctggccataacaccctggggcctacaggcccttcctctgctccatttttttggggatatgattgaggatagcaatctctgctaggcacaaatgccacctgagaagataacccgtcttttgattttgtcttacaggaaagcgggcatgcctcggagaacagttggccaggactgagctgtttattttcttcacttcccttatgcaaaaatttaccttcaggcccccaaacaatgagaagctgagcctgaagtttagaatgggtatcaccatttccccagtcagtcaccgcctctgcgctgttcctcaggtgtaatattgttaagaaagaaaggggcaaggaaagtaagaagacatggcacgtgttctgaaaccactggtgtctgctcagatgtgttgggacaaaatgaaagtgactttcaagaaagatcagaggaatttgactcagagaaaactagatccaaatcccagctctactgtctcgtccgaattagccttgggaaaatcatttatatgctaaataatttacctttttatctaggagatgaaaagaggataatgtttccttccataaagaaagttcttgtaagaatcaaaagaaatggtgagctttaagtggtttgtaaaccataaaacacatcataaaagttctatctatagtgtgcctccttcctgcttcctttgtgagatatgtgtttgcttctgacctgttgagaagctcaagtcaaagtggtgcaaaatagttgataagagttaaaagtgggccctaggagcagccacagaagtgagctatgaagactccccagtttggtagcactgtgcatgcgttatcttgtttctgtctcagactgatcctctgagaagtcagcagggcaggttttattcctcatttagagacagggaaagcaggtgtcattgaaacagtttctgtagtttacataagcacacacctaaggccaagtggaatgtgaccacaattaaccaacctgggaaacaggtttcaggaacaaatgtggaaatatttttcatccttaacaataccttcttgcctttaatcctccatcagacacttattcccatgttgtttcacactggctttaacgatggtgggtgtgatcttttcttgcaactagactgtaagctttttgtggctattaccagcctaaactccctgggccctgttttttgttttttttttttgtttttttgttttttttttttgaggtagtgtcttgctccgttgcccaggctggagtgcagtggtgtgatccacttcctgggttccagtgattcacctgcctcagcttccctagtagctgggattataggcacatgccaccatacctcgctaatttttgtatttttagtagagatggggtttcaccattttggccaggctggtctagaactccagactcaggtgatccacccacctcggcctccataagtgctgggattacaggcatgagccactgtgcctggccgaccttggtattttatagcaggaaaacagaaatgccaaaatcctgctcactcactctaggtgtggctgctgaaggaagataaggattatgaaatagaaggccaggtaacactgatagtacacgaagttttgaccccaataccaatgcaaacaaatgaactcccagggaacctgggctaagccttataaaaagatcctttttcctaaggtggtgtcttagtctgttttctgttgctgtaatagaatacctgagactgggtatttataaagaaaaggagtttatttgtctcacatttctgtaggctgggatgtccaagggcatggtggcagcttctggtgagggcttccatactgtgtcatcacatggcagaaaagcagaaggacaagcaggtgcatgcaaaagacagaaagcaggaggtgccaggctcactttatatcagcccactgtcacaacaatgaacccactgccataacaatgccatccatccattcacgagggccatgccctcacaacccaatcacctttcattaggccccatgttccaacactgcaacattggggaccaagtttcaaaataagttttggagaggacaaacacccaaaccatagaaagcagttagacctaaataatttaaatagcttaaaacaaaatgggccatgaaatcacggggctctttcttcctgctgtttgggattcagagaaaagccaattcaattgacgctgtgagaaagggaaacagaaaaggatgggaggaatgtttgactgctgctaatctagctggggagccaagaaaagagtatgtctggaaggcatggttgggtttttaatgtgtgggaggaggttttgtttcttccctagtaaaagaaagaatagaagtgagagccccacctatgcccatttttttttttttttttggtaacccaccagaaatttgcatctctagaaaacaggccatgtggtattctgagaataaaaccaatcaaatcaggccctgaacttgaacttctcaaacatccaggacttccatttttccccaatcagatcacccaagtaggagactcaaatggacactggccaaaatacatcatgtgtctcagtttcctcatttgtaaaatgaaggactttgttgaagtcatctctgagttccatttctactctgctgtgcattttctgt

SEQ ID NO: 11863 - DNA, 35803 bp, Human
aacaaaaaacaaaaaaacaaaaaacaaaactgaaatctgagacctcaaacgatgaaactgctacaagaaaacattgtggaaactcttcaggatattggtctgggcaaaactttctgaagaactaccccacaagcacaggcaaccaaagcaaaaatggacaaatggatcagatcaagttaaaaagcttctgtaccacaaagaaagcaatcaacaaagtgaagacacaaaccacagaatgggagaaaatattttcaaagtcacactctgacaacagattaatagccagaatacatgaagcgctcaaacaactctgtaaggaaaaatctaataatccaatcaaaaaatgggcaaaatttgaatagacatttttcaaaagaagacatacaaatgccacataggcatatgataaggtgctcaacatcactggtcattagagaaatgcaaatcaaaaccacaatgagatatcatcttaccccagctaaaatggtttttatccaaaagacaggcaacaacaaatgccagcgagaatgtggagaaaagggaacccttgtacactgttggtgtaaattagtgcaaccactatagagaacaatttggaggttcctcaaaacattaaaattaacattaaatagagctaccacaatatccagaaatccccatgctgggtatatacctggaagaaaggaaatcatatattgaagagataacatcactccaatattcacaatagccactattcacaaatgccaagatttggaagcaacctaagtgtccatcaacagatgaatggataaagaaagtactccaattatacacaatggagcacaattcagccatgaaaaaagcatgagatcctgttatctgtaataatatggatggaactggaggtcatcatgttaagtgaaataagccaggcacagaaacacagatattgcaagttctcacatacttgtgggatctacaaatcaaaacaactgagctaatgtctgggccttagtcagtgttgtacccaagtactgggagcacagcttttaaaatacatcatgaatgctttaatacaggaatgaatagatgagaggcacaaactggttgggtgttcttctgatacacagtatcttccttgacagattcagtacaactctcaacaggtaagtctcttcatgttatgttaccttatgaggaattaagtggcagaacatgatttctattattttcctttgcagaacaagaccaactttattagttgggacacagtgtggctgcatttgagtcccaagcaaccattagtctattgctatcaccacagagtcagaggggatgagacgcccagcaatctcacccaagacaactccaccaacattcctggttacccaccatgtgtacagtaccctgctaggaaccagggtcatgaaagtaaataataccagactgtgcccttgaggagctcacctctgctaagggaaacaggcatagaaacttacaatggtggtagagagaaaagaggacaataggactgtgtgagggggataggaggcacccagaggaggaaatggttacatttgtgtgaggaggttggtaaggaaaaattttagcagaaggggtctgtctggctgggcttggaaggatacgtaggagtcatctagagggcacaggtacactccaggcagagggaatttcgtgggtaaagatgtgtaggtgtggcttgtgaggatggatttcaattattctagaatgaaggcagccatggaggggcaggtgagaggagggttaatagatttcatgccaatggctccacttgagtttctgataagaacccagaacccttggactccccgataacactgattaagcttttcatgattcctcatagaacatgaactcaaaagaggtcagcaaaggggtgtgtgcgattctttgctattggctgcagctatagccctgcctccttctccagcacataaatctttcagcagcttggctgaagactgctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctgtgagtaactgtccaaactcctctctttgtttccttggacttggggtgctaatcgggccccttttcccttatctgttttgaagatcaaaagagatgttcaaggagaagtagctgaagtgttggacgctacaaacgcatagaagttattattatcttatgcagatctatgaatgaataaataagcatttctcccatccaccttctaattttggtgactaggagggtttagggacagcatttggtagtgggaatgatttgattagcttagatctgacgaagactaatcaatgaaaacatggcagcggcagattacaaactgctgatcatgatggacagtgtgatcctcatccccttcccaggctctggggattctgggtacaggaaggagtggcttgcatttttgtctcattaattcgctttctgggttctgtgtctgctggaagggatgtgtagctgtattgcccctgtagacctggttcctgctcccccgccttccaacccaggatatcatttacataacgcaccaggggacaccaagacttcatgggaagctgtcccctggctcttccctctttcctgtgccatgcccctgaaaatcccctccctcctatgagtcactcctccaccctgtcatacacaggatggtttatcttgcaatgattaacctctagagcaaaggagacctggaggaagtttcgaggatttattctttgctttaatctttttcctcccgtctctgggaggctaggattaatatagagctttgtttctcacctaatgggaatctactagcagcctgaaaaggcaggagccatgaaagccaatttggattttacatatttttcccctttatgttacagtacaggagggcaaaccctctcactggtgggattcctggcatcctagagcaggtggagagaagagttactttccactgtgggtagtggaggctccacctgtcccattaacttctacctcaatttgacttttattaagagcagggaaccacaatgacatgaaaatagacactataaacctcattttaattctttcacagaaagcttaggaattcagtgagttgtggcaacatggtttccattgtctaacatttttaaatgaattgatatggtttaaattcattcatttttaaaccagaattttttggagatagactatttccagcatgttccttctggatggtaaaacagggctgttagttcagtatttgtgacaataagtgtgtgtaaaataatgtcacctttcctgaatgtcaggaatatgagtctaatgcacaaatgtatacctctaagacaagactgcacgtcttttcaaatatacctgtccggccatttattttaataactccttttcgaatatacctgcttagcagattgtcttaaactctcaggacaggggagtaagcaagactgtgagccagtgacgatagcaaaggcttccaggtaggatccatatgaagtgagaaaatattcctcagctctcagggtagaactccaaagagatattcatgggtcctggccccaccgtggaggtcactcaaagggcaaacaggttggcatctcatctgcttcaagcctggacacaggggcaccatctgtgtcactctgtgtgtggtctgccatgttgtgggccggtcactacagactcgggcagccaggcagacaatgccttagccttagacaatgctggtgcagcccaggagtcagaaaatgcagtgtagaccaggccctccttaggccaacacaattacatgcaatagatgactggcttttctgttagtctcttcactggacccaaaggctgcattactctaccagaggggagctggaaagaaactaaagagttcgcccagcacagcatctgccttgacatggtaccatgtgaatctagacactcaccaagatctttccttgggggccaatgctgctgacacattaactcaatagcttgtcctcacctgagaggtcaggtaatgtgtttaaagttcaggagcagagattagtgtcattgatttgacatggctgtgacaacaaaggagggaactgaagtgggaatacccaaggccaccctggctttggcaggtggtgcacgcacttccactaactgttctggggcagggaaccaaatgtatgactgggcctgctcatgctgcccctgctgagtcctccaaaccctgcccttcatgtaatttctcagttttattttatcacattttataagtcactggatgtttacaaaatgtttggaacctatactgccttgaaggctaacctctaaagaggagtaaacaaggtcttaatacaactctccgggacgttttatcattacttatcttatatgccatactgcaccatttgctatcaacaggaaagtacctggactttggaaggtccctctgtgtcttttagctgaaagtacatatgaggcatgtggattcttttatgcacatcatctttttcagccacatttttgtagtttgcctctctggagccaactgtgtggggctagcagcttcacagctgaatcagtgtctggcaacctcttccttcagcctctcttcttcctccagttttccatccctcagtcacaccggagggggaaggtctgcaaggatccagaaccatcagttggaggagtttgcacatgactcatgaaagatgagttccaggcaggcctgccatagtgaacaccaggcttaatgggtttttcctcagagatacttcacgtacagaggcagtgaactgactgctttctggttgaccaccttgaaaaagatgagtgtgcctggcactgtgcttctcaggtgagtatgacctgagaagtattagttgctggttcttctgcacacaatcattcaaggacatatggatcaaccatcctcctcaacagctcaaatcaaccagatcatctgaccacagagactgaggtgtacctgaaagctgcccacatttctataaggccaatagaagccatgaacacagttgtcaatctgtagaaataaggactccatgactcctccaaggcctctctgtgaatgaacgtttaagaagggctagatcctaaaacagggtcagagcttagagggaagaaaaagcataaacatttctgagcaaattgtaagggcagtgtcaccataggctcccagtgaccctctgtgattgagtgcatacagtgatgcaaaatctcatcatcagtgcaaaagacaaaaaaaatcttactctttctacctaggatgagagtccccaaatcagcgaagagtccacttactaaacagacataaggaaatgaagtgtcctggaagaattcctgcctgaacctctcaggagcatttgaggacatttatcaagtattcactccaggattgggactatgaagacttcagctgctttcagctaatcattgagacttttcaggggtctcagaatagtcaggaaaggacctgatgagtgaatgcaattactgatgttggagttgctgttattatttatcgtgtacatattacctccctctcttgaccattccagttcctgagtaactcaccagccctctgatctataaagtcacaatccctgtgacctgatttctgtttcactttgtagatatgggacccgtacacatggactttttaagagactgggaattccagggcccacacctctgcctttgttgggaaatgttttgtcctatcgtcaggtgagttgcttgagcttcctcttttgcttcttatggttgcaaacatcagcttagttccatcagtaaaaatgcccctccttgggagggagttctgaggtttcacattttcagaaatggtgggactgggtgcagtggatcatgcctgtaatctcagcctctgtgaggccaagactggcaaattgcttgagcccaggagtttgagaacagcctgggcaacacagtgagacacctgtctctagaaagaaaaaattacctgtgcatgatatggtagcccatgcctgtagtcccagctactctgaatgttaaggtgggaggattgtatgaacccaggaagtcaaggctgtattgagctgtgatcgcaccactgcactccagcttggtcaacagaacaagacagaaaggaagaaagaaagagagagagagaaagaaagagagaggaaggagaggggaggggaggggaggggatggggaggagaggagaggagaggagagaaaaggagaggagagaggagaggagaggaaaaggtgtgtaggctccacccaaagcatggccaggtttacccctggagggaaagtcacaagctcatgtccagaaggccagtagcagcaagctgctctccagcccagatttcctatcctgtgtacctggagcttgtttctcagattctaactctcacaactgaagcctctgttgtctgattactatctgagaattctacacaattttaccctcgataaaagcagtaatttcttcttcatctttcccagatcaactcttgtagtagatcaacatttctgggaccttcttttgcatggttaaaacatcacagctgaatcttagcaacaggaaggtttgtttttatgtttcagaagtgaaagctcagagcacgcattgtaatttgctgggtgtgatgtgtagaggtggcatttctccatcttttctgtgttaagctagaaaactggaaaggaagtctactttctcattcactcactcactttctcactcaacaacatgccttagacttatctaaatctgcaagactaaaagaggttcctggtttctttaactttctaattctgctagagttctagagagagcacatgagataaatgaaaaggatactgatggaggagattaaaaaattgtgcattccctgcagacactcacttttcctcacctcagtttcacccctgcccttgcaggtgatcattcacggggttaggagactttagagagaataaaagaaaaagcaaaaatacatcagaaagacaaggaattacttactggtcatagacaagggtgagtccttcagtacttagagaaaattcaagagtgactttaaattccccacttcaaatatattctctgttttcttgtctttcccttaagacatctctgaatagcttccttcaactgccagtgaaagatagcaggcctgatttcattggacgcaactgttttcagccccaattagaggtagggtttattctatttaaaataataatcaacttgtattttgtttcctctcccagggtctctggaaatttgacacagagtgctataaaaagtatggaaaaatgtgggggtgagtattctgaaaacctccattggatagacctgctactgtgaggaggttaccccactgcaggatagtctctgcccaggtcttcatgggatgaagctcttgtcaacctaaatacaaacagagagaggttctctgaaagaagaggataattacttgggagtagaatattgcaatgggaatctgcttgccgttataaactatgtgcaaattcagggaggtaaacaagacaaagatgctccatagaaaatatgagaagaatctcataactgttttgagataattattgttagctacaaagatcaataacaagggtgatgccacaccaaggttggacaggcagttgctggacaggtgtccttgcagaaatatttttgtgtaaagttgaaatagcctttgtgcaaagttgtggtttttgtagacacttttgtaatagttttgtttccaggaacacaagcataagaatcctctcttcatagccttcttgggatttatttgtcagggttaaaaaacaattagtgacatcactttggttctgataaagttcacactcgctattgtaaaacttttcgaggcttgtcctaccaaggatcccatgtgtcaccaggtatcgaggtcttcagtctgaactaggctaggagcattgtggttaccacttttctgcaggttttggtggcccagggactcccagcatcgccttctgtccagtgtctgcctattcccctcttctttttttcttccttaggtgcccttttatcacatgcattgtctcagacccttctaatatgtgctcataaatgcatggcatcatctccttcccacattgattcactttcaattaaaagccaaaactccttcatttagactgaatttaacatgtgcttttgaaagaagggttgagagataatagagaaacagattgggaaaccacttatgctccacttttttaaactttctctgcaagtatggaattttttgttctgctttgttgtttaaatttaagccaaaacttcttaatagaaggatatacaaatatttattggtttataccattgcacttactttgaagaagagatgctgaatattattaaaccattgtgttccctggtgggctgatggactgtgattttataaggtggtctcagccaattgcagcagctgttccctgtcagaggggctagaggtttggtgagagcagtggatgaggtgcagtggtgtgtttgttcactagaagcaagtgggagaaagctttgcctctttgtacttcttcatcttctcccctcaagtcctcagaatccacagcgctgactgtggagtgctgtggagctggcatggcccatacaggcaacatgacttagtagacagatgacacagctctagatgtccatgggccccacaccaactgcccttgcagcatttagtccttgtgagcacttgatgatttacctgccttcaatttttcactgacctaatattctttttgataatgaagtattttaaacatataaaacattatggagagtggcataggagatacccacgtatgtaccacccagcttaacgaatgctctactgtcatttctaaccataatctctttaaagagctcttttgtctttcagtatctcttccctgtttggaccacattacccttcatcatatgaagccttgggtggctcctgtgtgagactcttgctgtgtgtcacaccctaatgaactagaacctaaggttgctgtgtgtcgtacaactaggggtatggattacataacataatgatcaaagtctggcttcctgggtgtggctccagctgcagaatcgggctagtgaagtttaatcagctccgttgtccccacacagaacgtatgaaggtcaactccctgtgctggccatcacagatcccgacgtgatcagaacagtgctagtgaaagaatgttattctgtcttcacaaatcgaagggtaagcatccattttttgaaatttaaataatgattgatccactgattaaatttttattttgaaaaaaacatatattcacagaaggttacctaaaaaatgtacaggaaggttccatgtactcttcatcctgtcccgcccagtggtaacatcttgcaatcttgtatattgcaatatatatctagtatattcatattatcaggttggcacaaaagttaaaatggcaaactacaggctgggcataatggctcatgcctgtaatcccagcactttgggaggccgaggcaggtggatcacgaggtcaggagttcgagatcagcctgaccaacatggtgaaaccccatctctactaaaaatacaaaaattagctgcgtgtggtggcatgcgcctgtagtcccagctactcagtagtctgagacaggagaatcgcttgaacctgggaggcggaggttgcagtgagccgagatcacgccattatactccagtctgggcaacccaatgagactccatctcaaacaacaacaacaacaacaacaacaaaaaccggcaaactgcaataacttttgcaccaacctaatactatagtacaggaaattgactttgatatagtttacagagcttttcagatttcaccagttttacatgcccttgtttgtgtgtgtttatgtgtgtgggtagttctaagcaatttttcacattcgtagatttgtgcaacgaccagcaccatcaagatgcagacccattccgtcaccatgtggctccctcctgctgtcctacagtcacaacatggagtttgtctttttctctgacaggttctatatcagagcaaacttttatttatttgaggaggccaatgtattaatatttccttttatggattgttcttttggtgttaagtctgaaaatcctttgcttagccctccttcctacattgctttttctaagagttatatagtttaacactttacaaaatgtaactctattacccattttgtgttaatatttgcataagttatgagatttagatcaaggttcattttctgtggactatggctgtccaaatgttccaacaccattttggaaaggtaggcatattgtcaaaactcagctgagtatattttgtgaatctatttcttattgtttactcctccactaataccacactgtggtgactctagtagctgtacagtaactcttaacatcatatagggcaattctttccactttattgatttatattttcagaatggctttagcttttcttgtcccttgcctttccataaaaattcagaataagcttgtaagtgtctacaaacaaacctgccataattttgataagaattaaagcagaggtgtccaatcttttggcttccctgggccacagtggaagaagaagtgtcgtgggccacacataaaatacacacacacacacacacacacacacacacacacacacacacacacaaatggtctgtgtatagttttcattatatatctaccaccacagataagcaaaaatgtccttgcataataatcctaattatgcactgccccattcagagggtctttcaaaatcattgaacaggttccaagtttgcaatcactgatacagaaaatgtacatatctagctaaacttcactacttttttgatattttttattataaaagaaaagagaacaacataaaactagtggggtacttgacattgtttttgagaaactaatccatcagtatctggcttgatggaagtagttgcaattctcagtgagttctcaaggtgctcatcagatattttggttctaattttactcttcgtgttcttcatccttgaaaatagtagctcacaaatgtaagtgctgccaaaaagcaatgacatgaacaaggtgtgattgtgaagcaagggatatttgtcattgggaagacaggtcttacaaaagtccagtaaagaggcaaaatcaaatttttctataagttgaacatcagattgcagctctaggcattccatttcaaaattgccaggtaacatatatatgtcgactgaaaatggagttgcaaatataccaaaatattgatgattttttcagaaatcttgaaatacctgttttcaaattcctgtatcaaattgaaaagcaaggctgcgtatttttggctgttcacaggaccatgtttagccaacatgtcgaaatgcataaaattgtttgccttaatttgagcttgccataatttcagtttcatatggaatgctgttatggtttgaaacattgtattgttaagttggttttcaacttgaagacacaggtttaactcacttaaatgggccgtcaaacccactaaaaatgctaaatctgtaagccagttttcattgtcaagttctggcaccaattttgtttgataccataaacagcttgatttcacatcacaaagcataaaatctttacattttgccttgacttaaccatcttacttctaaaaagtgaatgacttgctagagtcagcatccatacttttaaggaattcctgaaactagcgatgattcaattcctgggcccttgtgaaatttacagccttgatgacaatttgcatgacgttatctacttttaaagcttgtgcacatggattttcttgatgtattatgcaataatacttcatcaaatgtgagttttgtgtggcaactgcatcatctattaattgtacaagtccctctcttttacctaccatcgccagggcagcatctgtagctatatcacatatgtttacaaaggacaaagaaaattgctttaacatatttttcactgcttcatataaatctcttgatttagttgtgtcttttaatagcatggtgacatttcgatttcttcagtgacattatattcatcatcaatacctctaataaaaatagcaagttgtgccgtatctgtagtgtcagtgccttcatccatcaccaaagcataaaattttaaattagcagttttactctccaaacgtctttcaatagatttcccaatttctccaattctcctggctatagtctggtgagacaaactgattttagaaatatcagtttctcaaggcaaataatatctaccacatcttccagacattgcttaataaactcaccatcagtaaatggttttgatttttttgctattaaatttgctaccacataactaggttttaccttacgattgagtccgagttgtaactttttaaaaaatcttttttgttgaaaagacagactttttttcagttctgctattttgtccttacaacacatacacaccaaatttgtcagcacgtttttgcatataatgcctcttcaaattgtagtctttgaaaactggcacaaattccgtggaaattaagcagagtgcttcgctatttgcctcaacaagaaaaagtcatttgtccacttttcattgaacaatcttccttcatccataatttttgttttttagggttttctttttaagacattgtggaagccattctggaattaaaagcattataatagataagcaactatatttacttttattatggaaattaacagataggaaaatagaacagaaagcaaggtttaataatcaaataagaatacttacatgtcttctaaataatattaaacacctatcatctacaaaggtaggttgaaatattattgataattgctgggttttacttgccaaattgccacaaacacacctaatacctgacagtgtcaattcaactgtccgtgattagaagataacacactggaagtcgcacaccaccataaaactgaagccacacatgcgtacaaatggcgacagtgtctggtgtacagcagcgctctgccttgtccagaatacacacttgaattctttgtcacaattcacttcacgtggcactgcaatagcgtcctctcgctctttgttagttaattttaatggcttttaatttcttcttgctgaactgtttgcaattataatgcaaattatggatactagtccattatttgtggatgtgacatactctgattacccctttccattccattgttgtctacgaagttcacacttgagaatcacatagtcaaattacaaaattacaaaaaaaattgcaaaaaaactcaaaatgttttaagaaagtttccacatttgtattgggatacattcaaagccatcctggactgcatgaggcctgcaggccacaagttggacaagcttgaattaaaccaatagaacaatttgggtataatctatatctttactatgttcagcctttcatcccgtgaatatagtatgcctctccatttctttagcttttattactttcctcaacattttatagttttcagcatagaggtcctgtacatcttttgttagatttacaccagaaatatttcatttttgttggagtaactgtaaatgatactgtttttcttgtattttcagatattgattattgttacatagaaatgtgaataattttgtttgttgatcttgtatcctatagccttgcagaacttacctattcgttctagaaatttttttgtatattccttgacattttatacattgacaattatgtcacctgaaaatagagacaattctattatttcctttccaatctgtatgccttttatttctttttcttgtctagtgtattaagacatcaggtatgctctttagtaagaatgttgagagtgggcattttttagttcttcttgatcttggaaaaaccattcagtccttcatcattaaatgtgatttaactgaatgatttttttacagattgtctttatcaaatgaaggaactgtctctctcttcctagtttattgagattttatcatgacagctggaagtacacattttaaaacaaaacatagttgtggaagataagagaaagttccaagcatgctggcttgatagtccagccccaagttgggaaaagtaattatccctttctttttccttctatttatggaataaaaaattaagagaaaagaattttcaaggaaattgcattattccttcaaaacaggtttctagtctttaagtattacctacttttcaaaaaaaaatcaccacatcatggcatccctttttcaagttgcccatgctgtaggtgtattaaagacagagctggtctgaggcaacatacagtctgcccatctgtcaccaatccttttctactctgcacactcctggggaagggctaggtcttgttcctgtctattccactggaagaacagttccctaccacgtggagcatttgcaattaaaaggagactgagatatagaggcaggagaccacaccagatggctgggtctccccactcccacccccgccccacatacactcagaagaggctaggcatctaggatctccattgagcatcttgaatatggcttgccataatatcatatacagtcaataaatatttgttaaataaggatgcctcttcaatatattttgtgcaaccatgaagatcaccacaactaatgtgagaaaaaatgtttctgttgaactctagtctttaggcccagtgggatttatgaaaagtgccatctctttagctgaggatgaagaatggaagagaatacggtcattgctgtctccaaccttcaccagcggaaaactcaaggaggtatgaaaataagatgagtcttaattagaaatgtaaagaatgaatctggggacaggtagaaagtaagatcacagtccgtttccaaggggtagtccactgagttcgagcttcctaaaaatggtcttttatctttatgtacagaaaagacatcacaaaattcattacaaaatgtcacttactgctccatgctggagaaagccatatccttctgggacttgagtctgcacatttaactacaggtactgatctgttttgtgcttagatgttccccatcattgcccagtatggagatgtattggtgagaaacttgaggcgggaagcagagaaaggcaagcctgtcaccttgaaagagtaagtaggagcacagccatggggttctgagctgtcatgagcccttccagctgcctgccatggagtcgacagtcgcactgttgggttactccagtgaccagacaaaagcagggcagcgctgcaactccaaagagccacctaagagggagtggctcccatgaggcggcaagtcagcaagggaaaagggccttctctcctgtgcacaggagccaggatttacttatctgttaacttgtcaccataaatattctgggagattaaatacatactttagaaattaaaaaaacatgattgtatcaaagttttgagtgtagtggatatggaactgtgggtaagcaagcatttggtacttgttgccttgcattgggtaagatgggaaagttacaatggggaacttggaacaatttcaatcccttcatggtttttctgagaatatcagcaaactatgaactattaaaccttcccactacttccttttcctccaatctcaaaaaagaaagggtgctagaaatgctatgtgtagagcaagcctattatttgctgtctacaatggtatgtgcttcaattatgcaggaacgacaggtgtaatctgagcctgtcctgttcagacttgggacatgtggtcactcagttttgggttctccaaatcaatgttggagagatctattttttttaaccagaacattcttgattgtcacatcttacaaaaatgactctgctctcagcgcaacttcaggtcagaggagctggggatagtggggttttccagagcattagcagggagtgtagagaataaaggatgatatttctaggaactcagaacagggtgttactgttttgtaaagtgttgaagaggaattggctctgggcatagagtctgtagtcagacaacgccacctttcttgaatccactaggaagagttaattattctactcttgttctgctgaagcacagagcttacatatcttatatcatccacactcaacacatgctactgtagttgtctgataatgggtctctgtcttcctatgactgggctccttgacctcagaggtgagtctaactcagcttggtgtctccatcacccccagcatagggccagctccatcactggcaccagataaccaccttctgagggagtagatggaagatgattcagcagatagttctgaaagtctgtggctctttatgtgtcttgactggatatgtgggtttcttgctgcatgtatagtggaaggacggtaagaggtgctgattttaattttccatatctttctccactcagcatctttggggcctacagcatggatgtgattactggcacatcatttggagtgaacatcgactctctcaacaatccacaagacccctttgtggagagcactaagaagttcctaaaatttggtttcttagatccattatttctctcaataagtatgtgggctattatttctttctctctttttaaaaataactgctttcttgacatataattcacatatcgtataattcatccacttaaaaggtacaattccattgtttttaagataatcaaaaatatgtatgaccattactattgtaaactaaaatgtttttgtcaatctagagccctcacacactttagctgtcaacaccccaccacaaaccccattgccctaagcatccaataatcaactttctgcctctatagatttgcctattctggacacttcatagaaataatatcattgatttttctctgttgttttttattctctatttcatgagtttattttagtctgttattttctttcttttgctggctttaggtttcatttgctcttcttcttttagtgttttgtggtgtaaataattataatcaatttgagatattttcttcttttaaatttagatattacagctataaatttccctctgagcactggtttggctacatcctgtgttttggtacatcatgccttctttttgttcatctcaaaacaatttcttgttgcccttttgatttctgctttgactcactggtcacttaaaactgtattgtttaacttccacaaatgtatgagtttcccaaatttctttcccttattgatttctagttttattccatggaagttgatgtacatatgctgtgttaattctatcttgactatcatttcctgaacagcatgattaagttaagcagcagattatggtctacattaatccaaaaactctagtccaatagataaaggctaagaggtcagggaatttaattctattactttggtcactccaaagactcagaaggtgccattgatctcactgctgtagtggtgtttcctatgtatagacctgcccttgctcagtcgccggcctgaaagaagggcaaacatgataaaaggaatgggttccagttgagaatcatgatgttcttattcttattactggtagagaaaattataattgctccaggtaaagtttgcattttcaatgatttccttttgtttgttttgtttttcccacagtactctttccattccttaccccagtttttgaagcattaaatgtctctctgtttccaaaagataccataaattttttaagtaaatctgtaaacagaatgaagaaaagtcgcctcaacgacaaacaaaaggtaaaatctgatggtggttaaatgacgatgtttaggttttgataaatttagattttatacacatgatagagcatgtatctgtatttttaaaaataaagacagagaacttatgtttagaacaagagaagccatttggtagaaataaagaaggagattggggaaggagatgagaatgagtcagagagatagcatttaaaacttgaaatcaggcacaacaattagtatgtcatgatataaacagtattgagataaaattttaccacttctcttccctttaataaattgtcaaaggataaagtttcctgtttgaaaatatattttactggtattgtgctttcctcatatcacagattggtaaagaatcattttaagtccaagactcttattttacatattctgcaattaaaggtcctatgaggctacctgccgactgctgacatgtagtgtgtggtaaatgtgagtgtttcacagcctggagtgaacaggggtcttctctgagaattgaggttgcaaggctggctaactcagctttgccttcacgagccctagaggccagccgaaggatgtctgcaggtcagggagacaggaccaggtaacccagctgtcactgaagattatatagagtttgagaatgttggaatatttgaaaatgctcccccaaaaaagctgctgatgagttctggaaatgtcaggagattaatctatacggacactgctgaagaaaaaggtagaagaataaaagatccagtacttcttcctgggtaagcagttatgaccagagatggaaccggcaactctttggccagaaagctgtatccaaaagacagagaagatgagaaacagggagggcaaaggcgaaaaagcaattggacatgatagctagatttgtttcaggaaaacatcctgctttccaaggatttagatgaatgtttttgttcactggtgactcaggtaacacgtcttcaagaagccatagggaggttgagggagggaagtcaagaagggaggttgaggactgcacttttgatttacttctgacttcacgagtcactttctgccaaagaaatctctccttttgcttctagcaccgactagatttccttcagctgatgattgactcccagaattcgaaagaaactgagtcccacaaaggtaaccaaggagtgcttctgagggctactggcggggacactaagagggagggccttgttctgaaaatgtgcaggaagtattccaggaagatgagaatttttgccacatagcagaacaacacacatttagatgttataaatggtagctggaggcactttccagaagcccacaggtatagccatgttccaggctgaaagggcaaccctaagcaaacctagaatgcttggaggacagtcagtggtttgtggatcacctacatgagatcaaatgccagttctcagcctcctccagatccaccaagtgagaacctctacttggaaatttatatcaaacataccgatcaggaagcacactatcccagtaagggtgattttaactggcagtacttgaaagtgtgttcgcaaggttaatctactgcaaagttttatttttccctttgaaatgcataagtaactaatgggggacacctctgataccatgtaaatctacttcaatcttcagtcttgtatctactagttttatgacccatggatggttttaaccaaaaccattattactaagacagtggcaaaatgataaccatggtcaatttcaagctaccaagatttggcaaccatctcacaaaatttttgaatatttaacaattggttctagagagcaggactcagcagactccagtataccactttaaacatgtccatgtctacatctacttctgtctgtctatctatctgtcaatcatctatctgcctataatttatcaattaatcatctatctatctcaacaaaacttgctgtgataaagaaaatagtctatcatttcactgtttcatatagaaatcactagacacatatggctattgagtactggacatgtggccaatgccactgaagaacaatttttaagagtatttatttttaattgaataaaatttgaatttaaatagccacatgtggatagtggctaccagattggacagcagagctcccaactttaaaattacagttcaatttcaactcagtataatggggttcaatgtaactgagtaaaataattggatggttgaatttacccacagcagcatacagaaatattcactgataaatcagaactctgtagacctttctcacactcattttatattgtgtttggttgtgagttacatgattgctgcaggcaccatatttatttctgtgctccaggtctctaaaggtcctaatccagtcctgaccaaacagactagtgatggaccatcgtgagcttctctcaggagaaatatcaagagggaggccaacctgtaatcataagaacttctgctattttaatgccattcatcagactacagtcaatcaccatgcttctggctttttgtctatctctgctgtcttgtacatcctgagatagtccattctgagaactgtaccctagatcttgtattgcctgatgcctgtcaaagatgtaatccatgctgcttaagtgaggttgtgcacacaaatcaccatatctcctgcaagtttggattttgattcagtagttcgatggtggggtttgagattctgcatttctaataagctcccagatgtggctggtgctgctggtccatgaaacacactttgagtagcaagaggtgatctgtagctcagtattggtcctttaagttccctcaaacatatatagagaaaaggtcctaaatattgcaaattctctcaaagtttgtcaagctatattggaattctctcaaagtctgtcaagctctattgtagaaaatcaaatttttattgggaaaaagcctaccccatatttacttacagataaagtacttttaggatcattcaaggcacacacccataacactgagtatgtaagacagaaatgctctctctggaaattacagcagtgctggtgctgggatgccatgatgaggagtgtgtggcccacaatcatgtagaccttgggaaaacctggattaaaatgattttgcgtcatcctggccctgtataagatacatatcagaatgaaaaccactcccagtgtgactttgaattgcttttccattttttcttcttgggattagagagcttcacttagatttcatctaagctgtgatgttgtacgttgacctgatttacctaaaatgtctttcctctcctttcagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggtgaggggatgacccctggagatgaagggaagaggtgaagccttagcaaaaatgcctcctcaccactccccaggagaatttttataaaaagcataatcactgattccttcactgacataatgtaggaagcctctgaggagaaaaacaaagggagaaacatagagaacggttgctactggcagaagcataagatctttgtacaatattgctggccctggttcacctgtttactgttatcacaataatgctaagtaaaaaaaaaaaaaaaaaaaaaaaaaaaaaaaggagtgtggcgagaagatggccaaacaggaacagctccagtctacagctcccagcgtgagcaacacagaagacgaatgatttctgcatttccaactgaggtaccgggtgcatctcaatggggattgttggagagtgggtgcaggacagtgggtgcagtgcacccagcctgagccaaagcagggcgaggcatcacctcacctgggaagtgcaaggggtcagggaattccctttcctaggggtgacggacagcacctggaaaatcaggtcactcccaccctaatactgcgcttttctgatggtcttagcaaacggcacaccaggagattatatcccgcgcatggctcggagggtcctacgcccatggagcctcgctcattgctagcacagcagtctgagatcgaactgcaaggcagcagcaaggctgggggaggggcgcccgccattgctaaggcttgagtaggtaaacaaagctgccaggaagctcaaactgggtgaagcccaccgcagctcaaggaggtctgcctgcctctgtagactccacctctaggggcagagcatagccaaccaaaaggcagcagaaacctctgcagacttaaatgtccctgtctgacagctttgaagagagtagtggttctcccagcacacagctggagatctgagaacagacagactgcctcctcaagtgggtccctgacccccgagcagcctaactgggaggcaccccccagtaggggcagactgacacctcacacggccgggtactcctctgagacaaaacttccagaggaatgatcaggcagcagcatttgcgggtcaccaataccgctgttctgcagcctccactcctgatacccaggcaaacagggtctggagtggacctccggcaaactccaacagacctgcagctgaggatcctgactgtcagaaggaaaactaacaaacagaaaggacatccacaccaaaacccatctgtacatcaccatcatcaaagatcaaaggtagataaaaacacaaagatgggggaaaaacagcagaaaaactgaaaaatctaaaaatcagagcacctctcctcctccaaaggaacgcagctccgcaccagcaacggaaagctggatggagaatgactttgacgagttgagagaagaaggcttcagacgatcaaactactccgagctaaaggaggaagttcgaacccatggcaaagaagttaaaaaccttgaaaaaagattagacaaatggctaactagaataatcaatgcagagaagtccttaaaggacctgatggagctgaagaccatggcacgagaactacgtgatgaatgcacaagcctcagtagccaattcaatcaactggaagaaagggtatcagtgatggaagatcaaatgaatgaaatgaagaaagaagagaagtttagaagaaaaagaataaaaagaaaggaacaaagcctccaagaaatatgggactatgtgaaaagaccaaatctacgtctgattggtgtacctgaaagtgacggggagaatagaacgaagttggaaaacactctgcaggatattatccaggagaacttccccaatctagcaaggcaggccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccacaaacacaaacccatcagactaacagtggatctctcggcagaaactctacaagccagtagagagtgggggccaatattcaacattcttaaagaaaagaattttcaacccagaatttcatttccagccaaactaagcttcataagtgaaggagaaataaaatactttacagacaagcaaatgctgagagattttgtcaccaccaggcctgccctaaaagagctcttgaaggaagcactaaacatggaaaggaacaactggtaccagccactgcaaaaacatgccaaattgtaaagaccatcgaggctaaggagaaactgcatcaactaacgagcaaaataatcagctaacatcataatgacaggatcaaattcacatataaaaatattaaccttaaatgtaaacgggctaaatgctccaattaaaagacacagactggcaaactggatagagtcaagacccatcggtgtgctgtattcaggaaacccatctcacgtgcaaagtaacacataggctcaaaataaagggatggaggaagatctaccaagcaaatggacaacaaaaaaaggcaggggttgcaatcctactctctgataaaacaggctttaaaccaacaaagatcaaaagagacaaagaaggccattacataatggtaaagggatcaattcaacaagaagagctaactatcctaaatatatatgcacccaatacaggagcacccagattcatgaagcaagtctttagagacttacaaagagagttagactcccacacaataataatggaagactttaacaccacactgtcaacactagacagatcaacaggacagaaagttaagaaggatatccaggaattgaactcagctctgcacaaagtggacataatagacatctacagaactctccaccccaaatcaacagaatatacattcttttcagcaccacaccacacctattccaaaattaaccacatagttggaagtaaagcactcctcagcaaatgtaaaagaacagacattataacaaactgtctctcagaccacagtgcaatcaaactagaactcaggattcagaaactcactcaaaaccgctcaactacatggaaactgaacaacctgctcctgaatgactactgggtacataacgaaatgaaggcagaaataaagatgttctttgaaaccaacaagaacaaagacacaacataccagaatctctgggccacattcaaagcaatgtgtagagggaaatttatagcactaaatgcctacaagagaaagcaggaaagatctaacattgacaccctaacatcacaatgaaaagaactagagaagcaggagcaaacacattcaaaagatagcagaaggcaagaaataactaagatcagagcagaactgaaggaaacagagacacaaaaaaacccttcaaaaaaatcaatgaatccaggagctggttttttgaaaagatcaacaaaattgatagaatgctagcaagactaataaagaagaaaagagagaagaatcaaatagatgcaataaaaatgataaaggggatatcaccacccatcccacagaaatacaaactaccatcagagaatactataaacacctctatgcaaataaactagaaaatctagaagaaatggataaattcctcgacacatacactctcccaagactaaaccaggaagaagttgaaactctgaatagaccaataacaggttctgaaattgaggcaataattaatagcttaccaaccaaaaaaagtccaggaccagatggattcaccgccgaattctaccagaggtacaaggaggacctggtaccattctttctgaaactattccaatcaatagaaaaagagggaatcctccctaactcattttatgaggccagcatcatcctgataccaaagcctggcagagacacaaccaaaaaagagaattttagaccaatatccctgatgaacagtgatacaaaaatcctcaataaaatactggcaaaccgaatccagcagcacatcaaaaagcttatccaccatgatcaagtgggcttcatccctgggatgcaaggctggttcaacatacgcaaatcaataaacataatccagcatataaacagaaccaacgacaaaacccacatgattatctcaatagatgcagaaaaggcctttaacaaaattcaacagcccttcatgctaaaaactctgaataaattaggtattgatggaacctatctcaaaataataagagcaaatttatgacaaacccacagccaatatcatactgaatggacaaaaactggaatcattccctttgaaaactggcacaagacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatctagaaaaccccatcgtctcagcccaaaatctccttaagctgataaacaacttcagcaaagtatcaggatacaaaatcaatgtgcaaaaatcacaaatattcttatacaccaataacagacaaacagagagccaaatcatgagtgaactcccattcacaattgcttcaaagacaataaaatacctaggaattcaacttacaagggatgtgaaggacctcttcaaggagaattacaaaccactgctcaatgaaataaaagaagatacaaacaaatggaacaacattccatgctcatgggtaggaagaatcaatatcatgaaaatggccatactgcccaaggtaatttatagattcagtgccatcgccatcaagctaccaatgactttcttcacagaactggaaaaaactactttaaagttcatatggaaccaaaaaagagcccgcattgccaagtcaatcctaagccaaaagaacaaagccggaggcatcatgctacctgacttcaaactatactacaaggctacagtaaccaaaacagcatggtactggtaccaaaacagagatattgatcaatggagcagaacagagccctgagaaagaatgccacatatctacaaccatctgatctttgacaaacctgacaaaaacaagcagtggggaaaggattccctatttaataaatggtgctgggaaaactggctagccatatatagaaagctgaaactggatcccttccttacaccttatacaaaaattaattcaagatggattaaagacttacatgttagacctaaaaccataaaaaccctagaagaaaacctaggcaatatcattcaatacagaggcatgggcaaggacttcatgtctaaaacaccaaaagcaatggcaacaaaagccaaaattgacaaatgggatctaatgaaactaaagagcttctgcacagcaaaagaaactaccatcagagtgaacaggcaaccgacagaatgggagaaaatttttgcaacctactcatctgacaaagggctaatatccagaatctacaatgatctcaaacaaatttacaagaaaaaaacacaaccccatcaacaagtgggggaaggatatgaacagacacttctcaaaagacatttatgcagccaatagacacatgaaaaaatgttcatcatcactggccatcaaagaaatgcaaatcaaaaccacaatgagataccatctcacgccagttagaatggcgatcattaaaaagtcaggaaacaacaggtgctggagaggatgtggagaaaacaggaacacttttacactgttggtgggactgtaaactagttcaaccattgtggaagtcagtgtggtgattcctcagggatctagaactagaaataccatttgacccagccatcccattactgggtatatacccaaaggattataaatcatcctgctataaacacacatgcacacttatgtttattgcagcactattcacaatagcaaagacttggaaccaacccaaatgtccaataatgatagactggattaagaaaatgtggcacatatacaccatggaatgctatgcagccataaaaaatgatgagttcatgtcctttgtagagacatggatgaagctggaaaccatcattctcagcaaactatggcaaggacaaaaaaccaaacactgtatgttctcactcgtaggtgggaattgaacaatgagaacacatggacacaggaaggggaatatcacacactggggcctgttttggggtgggaggagtggggagggatagcattaggagatataccgaatgttaaatgacgagttaatgggtgcagcacaccaacatggcataggtatacatatgtaacaaacctgcacgttgtgtacatgtaccctaaaacttaaagtataaaaaaaaaaattcaaaaacctcagtggcatctaatgagaagcatttattgctcacaagactggatagtgagttctgctgatactgactggactcactctggtctggctatggtctgaggtagcctggccctgggggcgcgatggaggctgactcagctctccccacacctgtctcatgttccagtcaggtagccactggccaagaagccaagctaggaaccagggtatctgactcctgagctaaactctaaccctctacaatactgcctcccaaatataacaccaagtgctaggtacatatcatccacagttttcagacttctgcccaaactgggattctttttagtgtgaagagacctggcctgtggggctgaccctggtgtggctgtgaggcagacacaaagggacatttacatccagtcctgaagattacagtccagccctgaagcaacaactaggaaactattccaaaaggaggggatggggctgagtgtggggttctattctcttcataactttaactagaactcaaattgtgtaccttggtagcatccaatcataaatttattttgtcgtatttgtgatagaaaggaacaagtttatccacaaatttatttatttatttatttatttatttatttatttatttatttgagacagggtctgactctacgacccaagctggagggcagtggtgcaatctcagctcactgcaaactctgcctcccaggctcaagccatcctcccgcctctgtctcctgagtagctggaactacaggcacacgccaccacacccagctagtttttgtattttttgtagagatgggttttcaccatgtttcccaagctggtctcaaactcctcaaaagagttaccaagcaggactctgcaaccaataatccttgtgtgaagaggatatttgctcttttccctgtttttctttcttggtacagatgtgtgacctctttttgaaaggtgatagtgactttggtgtattttatttggtggtaatggtcatagccccattaatcacatttcttcccatgagaaagaaaaaccactacatggtcatgctaaggatttcagtccctggggtgaggatggtcttgaatatctcctacattcataactcctccacacatctcagtaggtcactgagcacatcaatggacatgccagttattaaaatacttcacgaatactatgatcatttaccagtatgagttattctctggagcttctaatacttcaatagtactgcatggactcagttgagagttaattcaaaatctcagattatccaattctgtttctttccttccaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggtacaagtctccagggaaatggagctcaccctgacccaggctggttcaagcatattctgcctctcttaatctacatgacaatcgtgtggttgtacaatcatttgcttgtaagtctttttatcacaaaaaagtgataattatcaaactttacaaaccacagactagaaaaaacgaaactacatccatccacagtcccagcacaagacaaagataatcaattatgtccctgtgggcatttttctacgcctatatagatttttaaaaattagaatggtatcactttttatttggtttgaattgctgcttacttgatttaacaggaaactatccactgacctatattactataaatatacatatatatgtatatatataaatatatatatatgtatatattgcatatgccataaaccatttaaccatgatgttatttcaggtgtataggctttttattcctttctgttttttctatgctgtgccctttagctctctgaatttaacagaaactttaaaacatgcttccacattccatttgctttcaacgttacttgctatttcctctgtagtaattataagagtgcaggctgaggtcctgagaagtcctcatccctaatggtttaagccacttcactgaagacacaagacagcacaggtcctcctggtcctatctgtggctgcagtcctgtgccagctcccttatactctcagtagacatctcacacactcctccttggaggtgtcttgagcatgctcttctgggaattcagggacaaggtcaggccttaggcacagttcgcactctggatatagttggtgttttcccattactgtattattaagcaaaatttagaatgaaatttttagggtactggctggtgattcaggatgcttgggatctagactttcattagcccctacctgcaagtttgctgatgggaggaaccttgtcttgttggtcatggtgtccctagtgctagcatggagtctgcacataatacttgttcacagagtaagtcagagctgaccaagttctctgttttctggagtagaggacttctatgtttcctgcaagctcagcacttccacctcctgtggctgcactaatacgaaatcagagaccactcgctgtacttcactttgaatcactcagtcaccaaaaagatagtgcttgccatgtgtcaggaacttggctaggcagggagaaattcatatgatttatataaatccataaatccatatgatttacataaatccataaattcatgtgatatatacgtatatgtgtgtgtatatatatattagagaatgtttgacatatacacaagtacatgttaccgacaccagcctatagaatagttttcgtgcatctccatatatctatcactggttccaacagccatcaatccatgttagctgccccatccaaatgccaccatcaccctcctcctgactatcatgttattttgaagcaatagcctgtaaatatttcagaatgctctccaaaatataaagactcctgtaaaaacatatgacaacaatgccattattactttctttgaatcaacattttttccttaatataatcaaatatttagaaatcaaatttgaataaaacatgggtcaatcttcaaagaatttatagcttaatggaacagatcaaggaaagcagggatgacactacagtagggtagcatcatatgcccatgtaacttatgtgacttaaactatcctgtaagggtgtgggggagaaagagaggaagagatggagagaagaaaaaggaagagaaggaggaggagaaggaggcagaggagaaggtggacggggaaggtagagaggaggaggaggggaattagaaaaaaagagatgacaggagaaggaaagggaaaaataacaacttgaaatagcacaagacgttttctccttctcctttctcaatgagcatgtgaccaacacaagtgtgagttgaggcaggaatccacttttccatccatcagtcttatcatttatgtgccttttatagtgtgaacacatcaccaccctgaatataattttagtgtttagagataaatattatttgcaacaatattcatctcatctcaagaaacgctcctatagggtatggagaatttaaaggacctgtaggttatgatgattataacgaaataaccaaagcaggatttcaatgaccagcccacaaaagtatcctgtgtactactggttgggaggtggagggggggttgttcttaagtaagaacccctaacatgtaactctgtggtttttatgtttcattaactatttaatctaccaatatggaactaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacaggtcagtacactttctgtatgttttattaagaatttttttaactgaagggtatatattttttaaaagaatatgcatgtttatcttttaataattcattctatgggccaaagaacctacttggatccatctttgatcattaaggatgcttcagttctggacttcaaaacctgtagcattaagaacatcatgtaaagtccacacagattagcatgacatgattatgtgtagtctctttgaacctgagtaagtttaaattcagtttcaagtcaattggaaagaagtgttttgcacaatcatgaagtgcaatgattacctggctgtgacttaaatggtgttctccatcaccagaacctgcagaagctctctcatgacagtggttctcaaccactagctgtatattggaatcaccagggagcttcaaaaattcatgatgcctgtgacatctcagaaattctaaactaattaacccagagcgtgactaggttctgtcatgctgtcgggtgaacccctgattagttctcacgtgaagccaaggtggagaatgactaatttcaggcatttctggtggatatgaaggactaccatagagcagggctatccttactccttgaccttatgttccaggtgatacatttaaagaaagatttagaatcttttctctgaagaagttaaagaacagatgtcattgattcatattaagcaatagcctataagtcttatttccaggaccggtgtatttaatatgcaactctaccccttaagtacactttgtgcttgggagaggaggaggatggagatggttgccatcttatctatggcttcagggcagctgtgtagctttcctatgtgtgtattcaggcagggggctcagccctgagagaaagtgggcctctggcacacctgggacagggaagatattccctggcaagctctcaggcatctcaggctggcacttctttgtatccatggcaatttgctttcccctcactgaactgagatcagaatgttactctgttggtggctcccccaacagtgaaggggtgactcagtgacaatagtgctagaagtatgagtcaaaacactgtacaacttgagaaattccccgtttgcactacgcttggaagccaagaggagatgttaaaaagaaaagaataattctttctgaagacatttcccatcattgcacttgatgggttcaactgggaagggttactagactctggaagttgaaaactgcccacataattaaactgtacaacagctactcaggattaccttgcaagttttaacctataaaaatttaactttatatagcacttccaaaatagtttgccataatacctactaatctggatttaatttttaaaactcatccttttaacttaagatttaaataaaaaaaaaaaaacacgagtccacaagaatttgtctcaggcctggcacagagtcagtgctccataaatattttgttaaacgatggatggtgagtgcttttactatccagtatttacccagcttatagattaagtatgaagagttcaagatacatggtgttaagagtcgtttttatatgcttgcaaagcatttttgtcatattttttctactttgcttccatcttttcttctttcacttcatttattaattctccatatgcttgtttaactattgtagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgtactgcatgagtagttggtgattttgtacattcattgagctctcccagagtctgtgtagagtgttgtgcattatgtagtataaaggaggtgaccaggtaagtgacagataggtagactcagcttctctgcttctcataggactacctctacccacctctagttagcattatcaactcctcctgagctctcatcagagaataaatatttctcaacaatttgatccataacttttaagaaaaataagaattatcatgatgactctaatagtgacatttatatcacgttttatttgtaatattctataagttttatattaagcgaagtgataaaatcccctttacaaaaatattatctgatgccatcctgcacactaaagagaaatctatagaactgaatgactgaaaaccagcaaataaacattttttatcattgtaatcactgttggtgtggggcctttgtcagaattccaatttgattattaacataggtgagagttaatctgctgtgactttgcccattgtttggagaaaatattcatagtttcattctgccttctttgaagaacatattttttgtaacactcaacgaagcacttatcatattattagttatgatttattatttttaccacatctcccctgacatttctggaacacaggaaacatgttttcttatacgtcttgcattccatcttcacctcccaattgtcttaatgcaatgaacactgaataaaaaattgtcaattcgtcagttgattgggcagcatgtctaaaagcactattcattttccttttttattctttcattttccctccttttctgaatactaaagccattaggtgggttgcagccatgtggtagccacacattaaggtggacaagagagtcatggtggctccaagtcagattccaagtgtgctggggaaggcatccacatggaggggcagcctgacctggaagcgggagcccaagcaatcagagaaggggtccacacagaggtgtggccttcaagagcagccagagcctaaatagggcctggagaacccacgtgaggtgaggagggtatccctgagtgggaagggatgggtgagagttggctacatagaagggattgatcacataagtaaataaagtatactggaagctaggtgtgtcacttttgcagaaaagagtcatagattcagaaagggagaaagctagcattaatcctatggtgttagattggaatggatgtatcagtgtacattcatacttttctagatagatagatggatagatagacagatgatagatagataatagatagttgatagataattagatgtaaatatatgtgtttgtatgtgtgagcatgcatgtgtgtgtgtgtgtgtgtgtgtgtgtgtgtgtgtgtgtgtgtataaaacatatattccctacttcactgatagggctagataacaatgacatttcaatagcaatgagtatacttagtgcctagatcttggcttatgaatatcattttccactgaagggaaccagagctcgttagagaaatagctgatgccagggctaggactaaaaatgttcaagatgagcccaggacactttttgtgccaggaagtaagaaaacactcaaatggtttctaaatggtatttggaaatgatttctaaatgatatttccatatgacttccaaatgatattttaaaaacctaaagactccaccaaagaactattagaactgataaacaaattcagtaaatttgcaggatacaaaatcaacgtacaaaattggtagcacttctatatgccagcaaggaacaatctgaaataaaatcaatagccacaaataaaattaaatacctaggaattaacttaatcaaagaagtgaaagatctctacaatgaaaactataaaacaccgatgaaagaaattgaagaggacacaaaaacatagaaagatattccatgtttatatatttcaagaatcaatattgttaaaaatgcccacaatacccaaa

SEQ ID NO: 11864 - DNA, 24519 bp, Human
agtgctgggattacaggcgtgagccactacactcagccagagctattctttttcaccaccgtcagcacataaaacgtttgcctcacactgccccacacatactgacatggtaggcattctgatcccccccactttcctcttggtgataattctcatttaagaaatacttccaatattctgagacactctggtttaagaaaaagtgacataacatagcatgatgtatatgggtgtactatttagggcccagcctagaatcagaaaatattgggtctgaatcccacctgagccaatggtaacgtctgtgacattgggcaaattacttagctctgtaagagtcaagggtttttttgtttgtctttgatttttttttgttttttattttatttcattttattgacattgggctgagatgagaactaaacggaaaaaatgatgtaaaatgtctagctcagtgcctgacttatcataagccctagaaagctttcatgagaatattatataacatatggaatctacatactgtatgcaatctatactatattatgtatatttagtgtgtattgcatataacataatctatagtgtatgctgtaacatatataccatacaatgtatatataaatatgtacaagattcataaagtttagtatatatcaatagctattatttttattaacataaacagtcattagcccctccagacaaatcagaaatgatggtgttaaagcttaagttggactgcaaaagatttttaagaaacaaactagaggcttacaaaagaatttaccagggaaggatttgccaacacttggggcaaaaatgactgagacacgtaattgaaaagcagggcgaggaaacagaatgtccctcccctcctccctggctggtggtagttttgtattggatcaggttgaaaggattcgagccactttaaaacaatcaacaaaaatctccaacttccgttcctgaattagcaaagcgagttctactcttgccagccgcggtaactctagaaattgtgtatgtttgtcactggacctgcctaggacgcaccttgggggagagggggagtactgggggcggtggtttcaagctctgtgtgcccctcctttgcacaaggtagtcggtgtagaagaacagaggcgggcagtggacataggggaggtggcccagcctgaattcaagcatcgttggtgcaagccacgctctcaaggcgcatttcctaacttcctaaagaagtaacaacagcaactaacttttattgactgttgactatagacaaggcttcgttgttgccgctttacgtgcattaattcatttaatctgcaaaacaaccaaacatgaaacagcaggaaggaaattctacaaactccccttcttgctcaagttaagaaagtctcctcttctggtgcatttcagtaagactcaaatcctccccaccctgggaggcgcagaaagccaaacttcctccaaaaaaaaaaaggcaaaaaaaaaaaaaaaatcacttcagtccaggctgggggtatctggctccccgggaggcgcccgggctccccggggccctggcagacgccggcagcttttctgggcccgcactcggggacctcgcccgcccggcatcgcgattgtgcaagcgccgggcggcaaccacggccgccgctgccggctcctgcccgccgggggagggcggggaggcgcgttcgaagcacacccggtgaactccgggcttcgcatgccttcctgggggttatctccggggtggagtctgccgcccccaccccacctcccgcgcccagcgaacatagccccggtcaccccaggcccggacgccctcgctcacctcgctgactccatcctccttccaccccccctcccctgggtcccgcgtccctcggagtctggccagccgggggccactccgccctcctctgcgtgctcattggccacccagggcatgctctgtctccataaatgcatggtccctgggcataggaacatggagagggacaggaggaaacgcagcgccagcagcatctcatctaccctccttgacacctccccgtggctccagccagaccctagaggtcagccttgcggaccaacaggaggactcccagctttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtaaaccccttttcgcgcccctgactctctcctccctcttccgccctcccagtggcgctccaaaccctccccgacatgcgcgcctcgggcgcatggtgcgcttcggcgtctgggcagggagggtccccggtcccctaggaggaaggaggcgggaggagggaaagcgcttcgggcacggcggaggatgcgcgctgacaccgcgctgtgcccggccggctgcaggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctgtgagtccaatccgagggacctgggcatgcggccagacctgatgagcctgacggcgcctggaaattgtgaagaggcggagttagagttccctggggttggaagcttcttacgtagggcggataccaaagcccctctcccgtgccatcgcaaccctgagctcttgtacagattagagtcggtccacggaaaagccgtgctgtgcacccagcacctgcgttctctctggcaacagggcagggccacaccctcccatcaaagaaacgccaaaacagggttgtaccaactgtggtgttcagactcttgggcaggatgaggttctgaagtcagcgtaccaggcaaacatcttatacaaacaaaattatcccttaaaactccctgaaacaccttgtaagctcaaaagcgaggagttagcctctttggctttttacagtgacattttctgcagaggattgggggacatgccttatttctacttgtaaaggtggaataaggagggatatcaaagttgtgttttaggtcgataaatgctactatgggatgtgattcttctgctttttagttgttagcatttaacaagttagcacctttatttacccccaaactgtaatgcctaatcgttatattttccaggatataatgactggaattaaaaaccctattaattcacggtgcttcacaggctgtatggtctgctatggggcaggtgcctacaagtgcacgatcgcaaaaggctttttattactccagtgactctctgactgtatgttattatttggaggcgatggcaaaattctaaatctgagatattttgtaaatatgaagcccacaccaatgagttgaaagaagacaagattcttccctcaaacagatctgagttgctggtgatggggtgttcacatgcccccttttaccgctaggaattgtccccaggcctcccagccccactccctgcaaggacacctcaaaatccctgaacccaaattatctggacttcaactttttggtgcaatctttgactaggaggaaaggtgctttttcatcctattgtcaaactattgtcaaaagatgatcactattttatcccaaatattctgatgctaatattctctggctatttcttggcatgattctcagtgtttgtttgattttatggttcctgaagttgcagctggagtatttctgcatctccttcttttcttttcagtgtgctctaaatgtattcctgcttctctcacagggaaggggaagactggcagcgggtccggagtgcctttcaaaagaaactaatgaaaccaggggaagtgatgaagctggacaacaaaatcaatgaggtctgcaggctggggccagctttcctggggctcgtggggacatagggatattggtggagcttcaagtcacagctacaaagaacaaaggaaaaaagaatgcaattcgggtgattcaaagtgggggtcttctctttctctccattccttcctacagcctcctccccaccaaacccttatttctccctcctccaccctcttttaaagtcatatcacaatgagggagcaatggagagtgtggactttggtattctacagccctggatttgaaccccagctttccactccctggctatgagacctggctatataccacttaccttccctaagcctcagtttccccatctacaaaatgggagtaacagttcccaccccacgggtttgctgtgagaattaaatgagataacattgtaaagttcttaagtagtgatatttgagctgggttttgcaggaggagtctgaaagcagagaaagtgggggaaggcattaaggcagacagagtagccttctgaaaacagggaggcatgaaatgacgtggtgtgttcagagaatcggtcatttagtgtagctgatgtgaggctttctctgaaatgatactggataggtcttaacaatatttttgtattatactaaggtatttggacattatcccttagccagcacggagtcaaagggagttttaagcataaagtaatctctttttacttctgttcactttggatgtttattttgaactggatgcgtccccagatgggatcatataggtgaaggattgcaaactcagaagcttccagggctcacatgactaatataaaataataaggcagacccagtaaaaatttcaggaaacgtgatagtgcatgcccctcccaggagggacagcagccccagttccagcaaacgaatgccatgtcagaatgcagacctcatgtcaccaagtctcataattattatttacatttttaaactagtagtggtaaatccatatgttcatatgaaacctcttgttttttttaatggtaacaaattcaaagaacttttaaatgcgctatgcgggcaaattaaacttgcaaactaaatccacacatgtgggctgtatggccacaccagctcacggcagggtccaggatggcaacttatcagctctgtgtgcataagtgagtgacttggcctctttaagcctcagctttctcatctactacatgggaaatgagtagagacggtacctactactacttggttgtcagaggatcaaccaatacacttcgtacagtgtttggtaccatatggacctcattaaatgtgaggcattagttattgaaaactctggtttatgaaactggcatccaaaggtcttatgtgactatcccaaggtcatagactacttagggaaggagctgtgtccagaattggtagatcttctggttccaagttcaacatgcttaacataaccaccaaccaataaagagacgtttgcttgcccagatgtggaagggcacacctcaggatagctgctgcaacacaatccttgagatgctgggccaacagggacagttagctgattcctttgtggttttattcccccattctgattagaaaaaaaaaatgttttccttttcttaaattgccagaattatttttagatcaaaagctgaaacttaagcttcagggtggcttcaggaaaagctcaggaaataacccaggacgaggtcattaggggataaggtgggttcccagggagaatatataattagtgtgacttcaggatgaataacattatggccagtgaatatgcgatgtagcaagacctgaagttagctcagtgagctttaaagttttgttttccttcaacggctttaaaatgtgtcttttgcggttgttttctttgaaggtcttggccgattttatgggcagaatagatgagctctgtgatgaaagaggccacgttgaagacttgtacagcgaactgaacaaatggtcgtttgaaagtaagttgtcgtcacagacttgctcactgattttgcaggtgattttgcggataaaacatggctcttttgacaactcttttgtaaacaggcattattgctgcctagggaaaggccagagcagcccttttaatgcttcttttaggtgcttaagttatgccttgaactatggattgttaatgagtcatacaacaaacatttgttgaatacttgctgtgtgtctggcactgtgctaggtactagggatatgacaatgaatgaaacgcataacccctgtacccttggggagcttatatgctagacaaggtgacagtcaacaagtaaacacattttaaaatatactcttccaaggagtaaaggaaaagagaaagggagttaagaaagaacatgaaaggcaggcatggtggcacatgcctataatcccaggactttgggaggctgaggtgggcagatcgcttgaggccagcccaggaatctgagaacagcttgggcaacacagcaaaaccttgtctctacaaaaaatacaaaaattagtcagggttggtggcacatgcctgtagtcccatctacttgggaggctgaggtgggaggattgcttgaccccgggacgctgaagctaaagtgagccgtgattgtaccactgcattgcagtctgggtgacagtgtgagaccccgtctcaagaaagagagagagacagagaaaggaaggaaggaaggaaggaaggaaggaaggaaggaaggaaggaagaagggagggagggagggaaggaaggaaggagggagggagggagggagggaaggcagaagggagggagggaaggaaggaaggagggagagaaggaaggaaggaaggagggaaggaaaagaaaaagagaaaggaaagaaaaaagaaaagaaataaagaagaaaagagagagagagaaagaaataacatgaaagaatgaaagaggggcaagtcttttttagtaagaagacatttgaggtaagtcctaaaggaagggaaggagcaaatcatgagggtacctgtggaggattgttccaggcagcagagaagaaagtgcaaatgccaggaggtggaagcatgagcgccgagtttgaggaacttcaagctgctggtgtgagtggatcacgatgaacaagctgggaggaaggggagcctgtgaaaggagatgaggtcaaaaagaaggcaggtgtccaacagggcacagctcataggtcctggcaagactttacctctcatctgactcagatggggcaagtaagggagggaggacatgaccgctttcttcaaagattactctggaaataaagggcagagctcactgcccatgggggtgcaagaggagagcaggcagctgtgatcaggtgggacagcgcctggctgaggacattcagggctgtgggagaatctgagagggccacctaagccggacatggccaggggtcgcttcacagagatggtgcccctcagctaagtcctgatggttgagtaggagttcaccaggtgaaaagggaggaaggagagtgtccctgcagaagaagtgcggaatgacaagcatatcctgtaacagaggctggcagagggccagcagccagctcatggagggctgtatgagcgggagtttgaattttagcctgtaagtaaccgggagctgcgggaatgtattcagcagcagtgtgatatatgggcagatttactgggaggatcactgtggctgctgatgggagggatagaaggaaaacctataacacttccataaattcaaggtcagaaatattgccataaatagataaatataagtaactttttttaattacttatttgagacagactctcactctgccccaggctggagtgcagcggcgtgatctcggctcactgcaacctccacctcctgggttcaagcgattctcctgcctcagcatcctgagcagctgggactacaggtgcacaccaccatgcctggctgatttttgtgttttttagtacagatggggtttcaccatgttgcccaggctggtctcgaactgctgacctcaggtgatccacttacctcagcctcccaaagtgctggtattgcaggcgtgcgataccacgcctgactaacttttgtgttttttaagtagagatggggttttgccaccggttggtctcaaactcctgacctcagatgatgctcccacctccacctctgagagtgctgggattacaagcatgagccattgtgcccagcagagtaactaattatttttaaagttcatgtaccatccagagctatctcacatattcccagtggtgtacctgccaaccactgtggaacacaaatacggggaaaccttgaaaggctgggaagaaataagtagagtttggaaaacatggaggtagttggaaaagctgtgggtgggtgctgactaagctaattgactctcactcctcaggtttatgattttaggccatttgtttacctttttaatgctagtctcctactttataagtcaagagccaattatccaccactaaaaagttggttgcagtaatcctgtataattttttttttccagactgtgtcactcaggctagggtgcagtggccagtggtatgatctcggcccactgcaacctcggcctcctgggcccaagagatcttcccacctcagcctccagagtagctggaactacaggcacatgtagccatgcctgaataatttttttatttttatttttttgtagagacagcgttttgccatgttgcccaggctattctcgaactcctgggctcaagcagtctgcctgcccgagcctcctgaagtgttgggattacaggtgtgaaccaccacgctcggccctgtgtcctttttttaaaaaaaaaaggttacaagagataatttttaggacaatggggaacattttaaaatgggacacagtagattttttatggaatggtcgctaaggttcttagggatgttaatgacattgtggttatgttggagaatgctttattcttaggacattactgctaaagtatttaacggtgaagtgacctgagagctcaaaattattttcagatgcttcagcacacacaaccacgtatacacttgtatgcatacatacacacaaagagaaagaaatggcagcaagatgttgatgagttcgggggattcaggtattcattttaccattccttcaacttttctctaggtaaaaagttttgaaatgaagagttgagaattttatttgtaaaaaggttccttctaaataaaatgatgaaatggaaggaaaaaaaaccctatatgaagtgctagcccagtacctggcgtgtaatgggtgtttagaacataattattcccttcccttctcttcctctggtgaatggcttccaattcattatgtcaggagatagaatccaataagtgactctaaaaacacagctgggttagaggcagagtgcagacccgaccctgcagcacctttgctagggcccctggatctcctgtgtgacttgatcaggacagtggatctctgatcatgacactctgaggtgatgagtcattggacctggagataatttctagaaaaagaaagtgatggtgtcccctttctctcagactctgcttttcctcaatattcttggactgttgccttttctcagaaaatcccacacttttaagaggcatagaattgagtctttaataaccagctaaacatagactccaactccagcattgctgtttgtgtaaagtgatgattattttaaatgacaggtatctgcctcgtgttgtatgagaagagatttgggcttctccagaagaatgcaggggatgaagctgtgaacttcatcatggccatcaaaacagtaagcagcctctttaagaaagcagttttcttgattgatgttttacagatcgatttttacagaacttcacagtgattcccaaaaaatggcatacacacatattttatttcaatagttaagtgttcattttaatgtgcattatatattttagtatatttatgtgcatatatgcggctgtctccaacctttttggcaccagggaccagtttcgtggaagacaatttttccatggacagggcagggtggtggggcaggggagggaggatcatttaagtgcattacgtttactgtgcactttatttctgttattattatatactcaccataatgtagaatcagtgggagccctgagcttgttttcgtgcaacacgaaagtcccatctgggggtgatgggagacagtgacagatcatcaggcattagattctcataaggagtgtggaacatagattcctcgcataggcaattcacaatagggttcacactcctgtaagaatctaatgcagccattgatctgagaggaggcagagctcaggtggtaacacctgctggcccgctgatcacctcctgctgcgcggccccgttcctaacaggccactgaccagtactggttcacggcctgggggttggggacccctggatatatgcacgtaacataaagaagcacattaaatccattatttctttgtttaggcaaggttaaaatagctattttaattaaagatcagttgattaaaaatactttttaaaaagagcccaaaatttttcagattttatctttttgaatagtttgggtggcgtgtagataggataaacgctgtgaaattggtttggaaatcactgaagtttggaaattattagaaattgaagtgaatatgaaagttatcgtttttcctctttttttttttttttttacaattaggtcataagattacaatttttatcaaacacatccagtggaaaatcatcccccacattaccttcaatattgaaaggaggtggaggtggggtacgggcattgctcccaggaccggtgcagagagagccgggggtgtccttgtaattccagccttttaaaaagtgcagggtgctgcggtttagaatgttcctcttccagaacgaacattgtctttgagagaaggagaattcagaataaaaaggcatttgcatttctctcagatgatgagcacgtttgggaggatgatggtcactccagtcgagctgcacaagagcctcaacaccaaggtctggcaggaccacactctggcctgggacaccattttcaaatcaggtaaagggccgcccttcacaaccagccagaaccagcccagcacccccgtgtctggagcttcagagaggaggtctggagtgatctcctgagcctcatcaccacatttaggttttgcaaacacaggtgttttggggattgccccagcatacacaaattctaagtaacaagctttctgtagtcttctttgggaattaagagtggttaaaagtaaaatctggccaggtgcagtggctcacccctgtaatcccagcactttgggtggcccaggcgagcagatcacttgaggccaggagtttgagatcagcccggtcaacacggtgaaacccagtctctactacaaatacaaaaattagctgggcgtggtggtgggcacctgtaatcccagctactcaggaggctgaggcaggagaattgcttgaacctgggaggcggaggttgcagtgagccaagactgagccactgcactccatcttgggaggcagagtgagactccatctcaaaataaaaaagtaaaatttatagagtcagggactcctgagttcaagttcagctctgtcactggttgtggtggcttggccaaatgtgcaatcaccttttcatcctcagttgccttgtctctaaaatggactaataattaataataataataagagaacctacctcaatgtaactgtttctgggtctactacagattacagttaacataaaaacctggcatatcacagtatctccgtggactagatctatttctgccacatgacgaaggggaatatttgatgctaggcattgttcacttacacatttagttaatcctcacaacacacctataaggtaggtccttttattagccctgagaggggtacctgagacacatagaagttagccaacgttcccaagattgcatgctaggtgatggcaaagccaaggtttgaagccagacaaggagcttccaggactcgaactctaactgctgtgccatatgtgatcagcatgattattaccatataatgagcctggtggttgtttgcttaatagtgagggaggtacacgcctagattttatgttataaatattagaaatttttaccattattgtcaacatggatggacactctacttgtgcgtatgtatgtggggtatgtgtgcttagtaatatctgggtccaagttggattctgaaagtgaacccaaatcctaccttcttttacacttttttctcccaagatctaaactcttactactcaaaactatgacctgcagcccagtggcatcagcatcacctagaagcttattaggaatgcagagttccaggcctacccaagccctgattcagattctgcattttgagaagatgcctaggtgactcctatccacattaaagtttgagaagccttgctcatgtcggtattgaaaaatccttgccgacttgacaagaaggcaataatataattagtgtgtgtagcaaattgtcagtgttcctgaaaagactatttagatattgcaagaaggagtttggactgaggttttcttctgtgattttcctcatcccaattttcagctgacttcctctctttcttctctgctctaatagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacggtaagggtgggctggatttgagtttgctaaatgaacggtctgtaccatttttagatgacagattttaaatagtaattcatctcattcatttcactgggattcactagcatcaactccacaaaaatgaaaagtctcatactagatgccacggtgcctccgcgcacagcatctatgccacggtgcctcagcgcacggcctcataccagacgccacggtgcctccatgcacgggcttctgtgcttaaactctgggtaggaggagacttcatgtgccccagtgacaaaaagccagagtaggatgtgatgagtgccatgatgtccatgcaaactgctacgggagttcaggagcagtaaagttctctgccctggcaagatacagaatccagatttttcaaaattggaagtattttgttcagttgcacatgttaccccaaagtgcctaactgtggctgttacttactgtaaaaaaaaaaaaaaaaaaggcatactctctttcaagccaataatatttttatctgcttagaattgtaaacaaagtcccaaagagtctgggacaagtggattttaactgaagcaaaacagctcattgtaaagaccaaaattctgtctctgatgtggccgatactccctaggagatagcagatactaagtgagaccaaccccaaacaaatcctgccataggcattcaggtaggtttaattgacttggatactagttcgagctgtgatgggagtggcgcacgctaacctcctcctaagtccaacatttcatgcaccttaaagtctctaagcaaaatgtaaagcagttgtttattttccatgtgcttccccttctgtgctgtttcttgcctgaagtaaaggtagggttttctctatcaggagatagcgaggttctcatttctcctcctgctccacaaggcggttgaaagtgggaatccatcctcgctcactttcctgttgaactgcttaccctgggtggctccttccagtgatcaaagtacagtgtcacccattattcttttattttttcaactggaacgtgacctctctgagggcaatggcttagagttgtccactgctgtgtttccaggacatagaacagtacttggcatctagtagcggctgatagatacttgttgaataaatgaaggaattcaggaactattgagtgcctactgtatgcctgggactgttccaggttcttgagagaccaccatgaaccagagacaagggttcccactctcatggaacttgtatgcaagtggggaagacagacagtagccatgtaaacaaacaaatgtggtcactttagatagtggtgtggattgtggaggacgccatcaggatggtgtaatatagagagatggagatgattaaagggaagccctctctgagaaagcagtactggagctgactctggaataatgagaagagccagccacagaaagacctcgtggaagagcgctgcaggtagaggaaacggcccatgcaaaggccctggggcagaaagagggatggagctacagaactagtaaatgtggtcagagctgagactggagaattggatgggccatgttagccagagccttgtgagcccagcctgggtaaggcattagatttgattgcacctgtgatgggaagctcttgcagcattttaagcaagggaatcacctgatcatttatgtttttaaaagtgggctctggctggtggatggagaatagacttagccaagagagtgggtacagcaggccagtcaatgagcttggtctgttccatggaggtcaatcaaggatagtttgtgcccctgaggttttccaggccacttcccctcaaatcagctgctgcagcttagcccctgcagttttccctacaggctcagactgccttacgtggctttggtaaaagctacagtcatctgccctttggaaactctatttggtacttgcggtgagggactcactgatatggttaaatctgtttcttttttggtcctggctattctgaaagtcacatttggaaaatcagaaccatttgaaagtgtatctaatttgatggctacaccctcttcctgttttgtaaattagactcttataataatggcatctacagtttatttgcagccgaggctgccagtcctctgacatgaagaagactgccttggaggcatcttcttccaaaaataataaaataaccatcatctctgaatggtcttgcacttggtgctcatttgtgtgagtggcacatggcacttagcaacagcgtcttcatgtctgcggaggtggacacaatgatcattttcaggaaatatttggcttaaattagcaaagtacggcctaaaaaataaatacatatgactactagtggtgaatattatgtagcttaaagctacattggctgtttccaccaatattttttctctagtcattgcctgtgcagaggaaataaaagatgccacttaaaagggtgtgggcctttgtcagaaactgtagctggagtactcagctcaatgtttgaatttcttatttttggtgttggcaccctcgtatgagggctgtttacatgtggttgtaaccctcagtgtaggtagtgcctgtttatttttgtggtgactttttagggtgtggccaaaggaacttttaaatttcagaaatgccatttattgtccatttccactataacattctcttaaagcctctcattagcaacaccctgaggatcaccatccctctctgtttactccatttttatatgaatgttttttatatcaagcaacttttaattaaatgtttattttgagatcattgtagattcacattcagttctaagaaaaaatagaaagggatcccttgcatccgttacccagttttccactaatagtaatgtcctgtctaacgagaaaacgttgtcacaatctgaaaattggcattgatttaacccactaatattctcatttcaccaattttacatgtactcatttgtgttcgaacaattattgcgtcaaactgtattttaggtcaggcacagttggctcatgcctgtaatcccagcacttttggaggcaggcagatcacctgaggtcaagagtctaagaccagcctagccaacatggtgaaaccccatctctactaaaaatacaaaaattagccaggcatggtggtggatgcctgtagtcccagctactcaggaggctgaggcaggagaatcgcttgaacccaggaggtggaggttgcagtgagccgagatagtgccactgcactccagtctgggtgacagagtgagactccatctcaaaaaaaaaaaaaaactgtatttaaatgttctaaagcagctgattaaaggattatactttgattccctcagtaaataatttaaaatatatccttaattgatatgttttatgaaataagtctgcttttttatatattggatttgtctaaaggcgtagctataaggacgcgtgaaagagcttcactgatacatttgcagaataaggtggtgggcatcacctttttttcagctaatagtggtttaatgcagttatttacaaaaactcaagtttatgtccatttggcttgcagacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggtaagagcctatctctgagccaatataaatgtgttagaacactgttctcgtaaacacaaaacaagtggtcccctactcatgggcggcttcccctagctaattagaaacaattatcacactgcaaaaaaatctttggagccatatttcttttctggcactcatttcctaaatcatttgggcaaattctattaaatcttggaaagccagtgccctcccctttaattcaataatcttgctactctaatgaacgctgtaagcactaattaagataggggcatgattgaaggttatgagatggaggctcacaaaagagctatattattatataataggacacagagaaagctttgcttttgagcctctggtataaaacattttttggaaattctttttacatccttttgggaaaacaaaactcacaacattttaggattagaaggatactgtcaactttgtgaagagtagattggagaaacatagaacaaacatcacgcttcaagggctagcacggaaacatacacattttagtctggaatgaagggggaaaaccaacgttaacagtttactaaacagccttgcactggggttttaactaactcaagaagatgagaggaacaagagatacaattattgagaagaaaaaaacaacttctttaggaagatctgtgatcatgctgcctctttgagtatgcacttgggcagcatttatttaatccaatctgcattcccattgacacttcagagagaacttagactgtgctcacctttacatctttgattttatcttttcaggcttacgccgagtgtaccatttacaactcggactcttgacaaggcaacagttctgggtgaatatgctttacccaaaggagtaagtagaatttgtatattctataccttacaaaaccttggaagatacactttgcaaatattcaccagatctccctagactttgtactggaaaatattcattttgggaatgcagagatggtagagaatagttgacatgttgcatagtatagaattagaattcacggctatggagacagagacctgcattcagtttcatcttttatctgtgttgtcttgagtgagttacataatctctgtgagcctcaacttcgtctgtaaaaggggtttaataacagaatctgctgcgcagggtggttgtgagtatggtgcacaattctaaagccctttacctatttattacctggcacattttaagcactcagcgcatgttggcaaccatcattattataaatttgtggatttggcttttgatttgtaaggtgacaacttgtgtcaattttgccattcaaaggtctcttctggttattttaaatactatgtgtctctgcatgtgtttagacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttgggtaaaacctttaccggtttctgcaattatgttctgtgctgtttcacaaggcagaagaagagaggggtaattctgtttttgtgtgcgtgtgcattacagattgtccgcaaatacgacatccaggccacagacaatgagcctgttgagatgctacactcaggcaccctggtgcccagccgggaactccccatcgcgttttgccagcgataatacgcctcaggtgagcatctaggcggttcattatcctctgcaaggtagtgagaatgacgagggatgagctatgctgggaagtcagccagactggggtttgaatcccagctcacctctaacttgctgggtgaccttgagcagttccctaaactctctacttcctttttttttttcatttgtaaaatgatgacccaaagagagtgtatcacaaaaatttaatatgaataccaagtagttattcctgagcctggcatcaattaagtgttcagtaaatgctagcagctgttcatggtttttgcatgtgaatagtaagggttggcaaactttttccgtaaagggccagttggcaaatattttaggttttatggaccatacagtctttgtcacatcctcttaatactaccttggaacatgaaagcagccacaggcaatttgtaaactaatgagtgagctgatgtcctagctttctattgctgccaccgcaaattactaaaacttagtgagttacacgacacacatctattatcttacagttctataggtcagaagtctgatgaggctcttccaggctaaaattatcgtgttgtcggggctctttctggaggttctagaggaggatctattctcttgctagtttggttgttggcagaatttagttcttcatggttacaggactgaagtctttatttttttgctgctgtcagctgaaggcgatcctcaactttgagagatttcccatattccttggctcatgaaaccttccccaactgaaagccagtaacaatggttggttgagtccctctcacactttgaatctctctttcttcttacattgcttctgtctgacaagatattatccaggatcatgtctcccatctccaagttcataaatttaatttcatctggaaagccctttttttcatataaggtagtatattcacgtgttccagggattagggcattcacattttaggagatctgttattctgcctacaaaggctgtgttctgataaattttataaaaaacaagcggtggactgtatttagccctagggtctaggtttgtgttatgcaaccacatgtaatataaatgtatatatttatcagcctgtattgaacacaatagaatattttttctgcagtatgccattcaatactttttctgacaatagaggagttctcatgttccctccacaacttttgccatgtccatataccaaccaggtgctatttatttcaatactactgagttatttcctttaaataacataagccaaatagcatatgttggcctcgtcctgagtaataatttccttaatgaaattaagagttagtaagtctagttatgttctcctaatagacattacaatgaattcaaaactattgaagtgatcaaaagttagcctaagaaggccctaattttttttttttttttttttttgagacagtgtctcacactgtcacctgggctggagtgcaatggtgcaatctcagctcactgcaacctccgcctcctgggttcatgcgattcttctgcctcagcctcccgagtagctgggattacaggcaggtgcacaccaccacacccagctaattttttgtatttttagtagagatggggtttcattatgttggccagactggtcttgaactcctgacctcgtgatccacccgcctcggcctcccaaagtgctgggattgcaagtgtgagccaccacccctggtggtggaaataagacatttgtaacatatggctttataggctgacatgtcggtgtttaaacccggattctatcattgtgttcttttagcagcaccttctaggattttcctagaaaaaaatgctgtttgccaatggcaagttaaggagcatttgcttattggtagattatttagagaaacatgcaattacagatgaaatttctgaacaaggcccaaatgaatacattattattcctccaccaagtgtctgatgctattatgaaatttgtcaaattctgagcatcccaaccaacagaactgaatcaagtagggtaaggaaagtattctagctgcattgtgacaccccagccttcagcaaagagcatgcatgtttatcacagtaagccacaccttttaagttttagcattttttctttggctaataatttgtcttgtttaaatacacttctttgatatacaattagggtatacctttttttttttttttttttttttttttttttttttttttttttaccaagaccaaaacagccatttcaacttttctgcaagaatggtgcttatggcttctacgttaccggaaagcaaacttcaaacaccacaccatacaacagcttataaagaatatttaggcccaggtgttgatactttttcttctgcaaaattgttccagaagctgtactgtctttctagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatatttgagagacttcccctctttattgcctttgttacaacaaaataaaaacaaattcaaactttattttactggtagaaaattttctcatatggcctacaagccctatatcacaaaatttacccttagataaatctagactttaatagcagttttactgaaagtttattcttgtaattgcaaaataactttccattttgttgctgcttaaatatttcccaagtccagttacttctatctctaccccctttccaatcacacaatcagtcacacactggttgtgtgattgaaaggggggtagaacggcctgggagcctgttctctcttgtatctttcatgacatgaaagggaggctggcacttggcagtcaggtagaggttacgaaccatttcagcccctgcctaccacattcactgtttgaatacttaattcccaagaataagtttacatttcacaatgaaagacctacaacagccaaattttccgtggctgggagcaatactgacaatctcttgcctggaccactaatatctctagtctctgcaggagctcccagctgatctcagtcctctcttgcttccttcccctctgttctttgcacacttgccttactggtcttttcaaacccaaacctgatcatgcctcatcctgcctctggggcttcccattgctcttacgtaaagatccgattctgcaatccacacttccaggccctatcaactgaggtcccactgatcccccaggcctcagcccacatcatccacccccagaggcctctggaaccaggccacagtggcttctgccagtttctgctgttccttaaatgctagcaagagggttcttcccaccgtctccctcccggcatgctctttctctgcctgttcttctcctacgcaccatctacgtccacccagctttcatttcctgaaggaaatcttccttgatgacttagatcccacaggggctgtccccagcaccgggattcattagggttgtgattcccaaggagacctgtgcgactgtggggacagcaggatgaggaagggaaagaagccaaacaagcgtgtggttttgagtgaagttccagcctcagcctgatctctgggagctctggagtgtacattgcagctcagtttgttctccttgtgcccagggagcagggcttccacactccttcagttcaggctgcaccttggggtataaactctaagatacttctagactttacatgtccaggcaaaatggctatagtagccagaaggtagtctttgaagaaggctgcaggtgccagccatgaggagcaaagcatgaaaaacctgggcgaagggcacaaagaccggcaaatgggtgtgaggagcacagggtggagcaagggccacgtctgctgcccctcacctccctgagcaggttgcctggagccgacactgacatggccaatgtggtcatgatgataataatatttattgactgatcttgctgccccagtctctcctctgtgcacttgctacatatgaattcacaaatccttgtcactgccctgtaagtagatgtgatcattcttcccatttcacacctggggaaactgaggcacagaggtgctcagtaatctccttagaatcacagttagtatgtagggaagccaggattccaacaaagatagattggttcccggacctgtgggatgcacgtcatgtactgctcatctctactaaaaatacaaaaaattagctgggcgtggtggcacgcgcctgtagtcccagctacttgggaggagaaaggcagattctcctgaggcaggagaattgcttgaacccaggaggcggaggttgcagtgagccgagatcatgccactgcactccagcctggcgacagagcaggactctgtctcaaaaaataaattaattaaataaaagtatacaaaattgatgggattagaaaaatcactatttggcaactagatttgaaccaaaccaaatgtatcaaatttaatctgtggatttgtagt

SEQ ID NO: 11865 - DNA, 8766 bp, Human
gaaagttctacgtaatggagggaagaatttcccagccatcttccgaagaatacaagatcccgtcctccaggcagtgacctcccaaaccagcctgcctggtcactgactgcttactctaccttagctggacctcgtctcccagggattagagaaaagagcaggagtcctgggtcttcccagttgagactgctggagctgagacacagtactctcttaaagaaggtggggagctgcccagggcagaacccactggtgttcatgactacccctggctcctctcaccttgtccctccactgccaacagaaaacaaagcagctgactgagatggtcaaaggactttggaccataggggatctttggaaggctgtggggtcttgctcttccttagcactcctttctccttgtgagatctctcctcagctggaatgaggaatgtagtccatctaaactgcttgctaggctcaattaccacttctgtttgctttgtggatcctgggataacatgtatatgtgtacacatgcctattctgccatttctcaggaaagggtggagtatgtatcatatgccttctaccatcctcctgtcctctccctgcgtaagacttgacctggggaatctgtgttccctaagtgttgtctctggagagtccttgggaaggtgtgggggtggagaccctctcctttttcacattgaccttcaattccagaacttcagagctagctgactggcacagagcctgatagagttgcagtggggaatgagggagtaaggagcagagaggtaaactgtgggagattcttttattttaattttttttagagacaggccctctctctgttgcctaggctggagtgcagtggtacaatcataactcactgcagccttgacctcccgggctcatgtaatccacctcagcctctcaaggcactacaggcatacgccaccatgcctggctaatttttgtattttttgtagagacagttccactatgttgcccaggctggtctcagactcctgagctcaagcagtctgcccaccttagcctcccaaagtgttgggattacagtcatgagctgccgtgcccagcctaatttttaaacttcttctgtagagacagtcttgctatgttgctcaagcttgtctcaacctcctggcctcatgccatcctcctgcctcagcctcccaaagtgctgggattataggcatgagccaccacaggattctgaggctaaaagtagaaaggagctgctaaccagaaagccccccagaggagaccgagtcagctggggaattagaacatccacatccatttagctcctctaacaccccacagacaatctctgaacttaactaatgtacaaaaagtttcatttctgcttctcaagccccaaattcccatgtctggaaggagggggcttgtatacccaagagacccccttatcctcaagaaagaaagatggaggttctaggagccattttagcccattaacccacctgccatctgcccagtatatgttaggtacaggaggagggggaggtgtggctagtgcaggaaaataatgcagagaagatacaacccactaagccaagaatgtggggacagttacagctgtgcctcccctgcttcccttcctggaggagctgaaagatggggaattcctgaggatgggcctaaaggggctgggctcactggtagaagtgggaatatcagagactgactagtgtagcttggtcacctagtccctactaaaaagccttatagcctttcctaggatgagactttgaggctcctagacaaaggcactctcccaggaggaaaatcttaggccctccctcccatgagggtcattgcaacatgagacccaagggagttgtgaagtcagccccagccccgcctactgttcctgggtgctaatccccagcacagaccactcaggaggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtaggaagggacgcctttcccgagacagagtgctggggaaactggttttgacagcgtcagaaaggactgactagtgcagagcaaatgtgggacagccagagagaacggatgcccatgaaataaggaaaaggcgagttgaggctgggggcggtgtggctacactcgggcagagcccgtcccgactcttagcagagggcgctgcgaaagcgccttctcgctgtcctgaggtgtggagatcctgcagataaagtacaagtgcgcgggagggggaggccggagtgggcagtaccctccgcctgcttgcggcttaaagctacatgggttccttttcattcactgaggactcgtcctgagatggacagtccagacatggaacttttagagatttctcctcgaccgagatgatcagagaggtcctgaatgtctgccttgcacaaagttccggttttgcccatcacactcaaactttctagggatgggaaatgagagaggaggagtttgcagtatcaaaggcatacactagttgggcacccgagaaagagcagaagctccctattcccaagcccagtcaacgcccttggcgtgggcacaggtcaagctgaaagtccccgcccaggtatccaagtgtccgctgtgtccgctcccccaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcgtgagtcttctctgcccccagaagcccagacgccctgcagcggccctctcctgctgcgggtcccgaaactatcaatctgggggcatggtgggaggtcggctgtcccactctaccattgggcatcttggggttcccatcccagtctgcttcacccacactcaggttgagccccaacctcactccccgcctacctccttatcctttgaggcccgaatcctgggaactgggggaaccggaggaattgggctagggtacaaggatctggatggaatgaatgtaaggttctgtgactcaagttacccgggaaccccggcccctgagggcaggaaatgagtaaagaggaagggggctggaagacaggcgcaggccggtgcaggtttccgtaccccaagggggcagacgcaatccctctcctggccaccgcagccgaacgcgctccttcactgcagccagtcccgtcgagccgtccccaccttcccgatgcgcactctctcctcaaccctgcagggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggtgagtcccaggacagagctgggcaggcgtcgggggcgccctaccagagcctcccggaaccctgacggcgccccctcccgacaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttggtaaggcacaggtcgaggtggaaatgggggaatgtaaagctgtccaggggtagcgaggtattcacgtgccttctacccacgcagctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgaggttctccctccgtgctgtgagccggttccagggcttagcctccgcagactccggctccatttttctgttgcaggggatccattatggccacgtagaccagcttggcttagcaccctgtagccccagactcttccataatctgcaccctctgctgggttctcacacccaacacctctcttgctttcacatgtttttcaggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaaggtgagggggaaggagaggaggaacaagaggaaatgccaaggaagggctggggaagcaactagtggatggaagcagggagatagcagagaaaaatggccctctactcctggccaaaaagggtttggaagttggaaacaatgagaagggggctgcagcccctagcctcatcttgttgtctccattttgtgctttgcaacctagactgtaccctgtggtacctggaaattctcgtgtcccagacaaagacattcatgtgggtgactatattatccccaaaaatgtgagtaaagcctatgcaccctttctactgagccattcctcactatcttgggccccaaccctgttctcaaacactctcctaaaagcccttcaaacactccccttgacccctctctaggatatgcctttctaggatgtaatggaacagtggggagatccttccaaaagtagccccagaaaacttccccatcacccaccaggacctgcctttgtccctgtctgaatatcctcttcttcatgcctgccctattctgagcccaaactgacaagtttgttttcctttgcaccagacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccaggtgagtgctctagattttataccttccccagactggagagaccctaaccctctaaagttgtgagctctttcccctgacaagcataggaaatcatataagacctggtagaatgaatcttctgaaatatgataagcccattataggcctggagtgtaagtgagggtattcaaactattttttccctaccataatccctcacccttattaaccaagaagtcccctactggccacaggtgccacccaatcattgaccattctaacactaataatgcatgccctttaccaattggattaccaatgaatccccccattatagatatctttcatagtaatgctcaccttcttccctttccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattcttgattttgacttatttctctcatattcccacttcctacaagacctggaggcaagactctaaccctcccatctcccaccttggtttctcaggtcctgggggtgacccccataacaatgggaggtctggacgcctggaagagtagtttgtaacacaaacccagacatgtttctgtctgtagtgggaacatccaagtctagtctggcttcctgtaagagattaagggggtggggggtgaaaagtaacggcaggggctaagctgtaaaatgggcccggagctagggatttgcagacatgggcagaggttgctgactctggtaaggaaagtgcttttggactgccaggattgaaggaagtcctagattggtcactttgccctctctggaaaagttgttccaagataatttccttcagaggaagggatacaagcagagaagtggaatcagacagacagaatgaaagctgagtgtgggggtggccagaagccctggggcactgaggcaggataagggcggtgggcagagggagactgtttccctaagtcagcattctctggccccccagaggctgggcacagctctcctcttgtgatgtatacagattaactcatcttccatccaaataaatctctcagcacactgcacagttccttctgcatcccagattacccttcccatgtcaggacttgccccccttcccctaccgctcaccctattccaattagctgggtgtagatggagatttcacttcacacttcttcctcctccacaccttggcctcctggcctagacatggctccctgaccgcagaaactccagtagccaccaggccttttgcaggggcatctaattatgcaagatctacagaggggcagggcagacccaaagcctcgtacaaagatcaaggtttctgtgcattttctgcccttctcaactccttccctactgtatactcagtctccacccctattcctctatcactgaactcaatttgaacctaaatgaccaaattttcagcagatttgatctttgagggagaataaagcccagcttgtcagaccctttaccctggaatcagtgatgagaattctgcccatccgtactccctattttccactgggcaagtaggaatgcccacttgaagagggcagcagttcccatgaccctttcctggacaatgatctttttaagttggaaaaaggaagaagaggagaccatactgattgctggccccaactcccataccaagacttccattagtgctgaaggagaggggaaagtgtcccacttggcctcattttaggacccagagtgtaaatggatacagtgtgtttgtgtgtgagtatgtctattttctttggtatgtctaaccttccctgcagagccatcacagaggacagctcaggcttggcacaggaagctccacatgtgtcctatctacctgagccctatctgctggtatagatattagtagtcactctgatttgcaatcccccatttggtccccaccagctcttctgagaatggcaaatcagtaaagtctggcctttctgtctcccaagatgggggatatagagggttctctctctggggaaacagtttcctactgagcagacggagggttcagtctcagttccctatccactctactccctcaaaaattggaagttatatacttccacactttgaaattacttgaaccgcagtccagcttttgttcctacatcccaaggctggtctggatgccagcaccatggacagcaaccaagaccccctttgggagaggggaggggacaaggtttcctgggcaaggatgtgtgtgggcctttgcaagggaagcattttctccaaaacatccccagggaggaaggaggcaaagcagaaccttccctgatagaaggatcaataataagaaaggcctccagatctgactttagccgtgaatgaaggaattatttaattgctgttgaatggtttacttaaaaacagcatcattcatataat

SEQ ID NO: 11866 - DNA, 20901 bp, Human
cagttccactgaattggaagctgtaactaccacttaggcatttttggcttctcataccactgcaccagcaggtaaagaaaagagtgccggctgggcgcggtggctcatgcctgtaatcccagcactttcggaggccaaggtgggcggatcacctgaggtcaggaattcgagaccaacctggccaacatggcaaaacccatctctactgaaaacacaaaaattagctgggcatggtggcacacgcctgtaatcccagctacttgggaggctgaggcaggagaattgcttgaacctgggaggcggaggttgcagtgagccgagattgtgccactacactccagcctggacaacagagcgaggctctgtctcaaaaataaataaataaagagtgacacatggtggggaaaatcagccctgattactttaagaagttgggggctgggcatggtggctcattcccataatcccagcattttgagagatcaaggaaggaggattgtttgaggtcaagagttcaagaccagcctgggcaacataaggagaagctataacagtcacaaaatttgccgggtttgggtggcactcctgtagtcctaactactctggctgaggtgagaggatggcttgagcccaggagtttgaggctgcagtgagctatgatcacaccactgccctccagcctggtgacagaggaaggaaaccccgtctcaattatttaaaaaaaaaaaggtcttgggtgtattttaaaacacttcccaactctgagctctatgattcttctttcagtttctccaatgagccatgctgtctctggcttctgggcctttggccatgtggttccttccaccaggacactatccccactttagccagctgactgcttgccgtctttctggtttcagcatagaaatcacttcctcagtgaagtcctcttgacttctctaaccagaattagcttccccttctccctgctctcgtagcccacgcacaccctccgcctctggacttcatttaggaaatggtagttttttgtttacttgtctattccccgcactagaccatgacttccttgagagaagagggtgttttatttgtcactctatgcccagtgctaaggggagttgcaggccccaggttttgttagaaatggtcccagttctgtctctgccctgggaggtttgagatccatatcccctggggagggctctgactacagaaatagtcaaccaccagctagaagccatgattgggggccgggtgcggtggctcgagcctgtaatcccagcacttttggaggccaaggcgggtgggtcatctgaggtcaggagttcaagaccagcctgaccaacacggtgaaaccctgtctctactaaaaatacaaaaattagccaggcgtggtggcaggcgcctgtaatcccagctactcaggaggttgaggcaggataactgcttgaacctgggaggcagaggttgcagtgagccaagatcgtgccactgcactccagcctgggcgacagagcgagactccatctccagcaacaacaacaaaaaaccatggatgtttgttgggaaaacaaagatctttgttgggaaaaacatctttcattagtaaaagaagagtttgtgtataaagaataactaatagccaaatctactgacttgtgagagagcatctaacaggttctctttaagtgtggtctttttaagtacttgttttttaaaaaattaatcagagggagaatttaagatgtggaatctaccaatccaagaatctctcaaaagctcaggcaaagaattggaaatgataatgattaaaacagacctttgtgcacctggttaggaattttctatctcatgacagaaaggcaaacatcttctgacctgactccttcccctgacccggggttggctgctcctaccctgcaccttcattcagctccgcccagtgttgcctggctgcagcctctctgcccatagaactcagagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtcaggaggctgccacacacttgaggggtgcttgaaatagcagtggtagagggggatgaagagatgggttggaaagtcctgaattctcctactacttttgctgctccttttggaccttcttgtcctcttcctgcttcctgaaactagaacttcttgtggattgtttctctaagtaacatcaccaccttcccaggcactcaaatcacaaaccatccagtctggcatttcagcccctggaacactgctcttactgtacaggctgatctgcctgggctgctctttgcccacctctctgcctggttaactcttgttcaatcttcagactgttgctcaatgacgcttctttcgagaagccaagcccaactctcccatactaggctaccctctctcatctgcctgcttaacatcctaaacttttctttattacacctgtcgcggtttgtaattatgtacggctggctaggattcatgtctgcttccctcactagtctgcaaactcaatgcaggtcgagaccattgctctcacccactattacacccatgcctgatggtggcacatggtagctgctcagtaaatacttgttaaagagctctcggctgggcgtgatggttcacgcctgtaatcccggcactttgggagattgaggctggcagatcacgaggtcaggagttcgagaccatcctggccaacatgatgaaaccccgtctctactaaaaatacaaaaattagccaggcgtggtggtgtgcacctgtaatcccagctactcgggaggctgaggcagaagaatctcttgaaccccggtggcggagattgcagtgagtcaagattgtgccactgcattccagcctgggcaacagagtgagacgctgtcacaaattaaaaaaagtctcagttttctctctctaactccatccactccccagtccaggaaaaccagtttcgtcgacttgagttcttgaccgttccagttttctcttttttgtcctcccagcttctcttcctgccagaacttccttctccccgacttgcccactcagccagcccagcttgtgaatggctgccagattgctcttctctgagtacataccagctcaaccactttcagcagctcccctctgcatttaggatgaagcccaggctcagccttggattccaggtcctccctggtcaggctccagcttttcttctcaattctacctctgagctccccgccacactcatttctttcggacaaactgttgggccttgtacatctcttgtactttcccttgtctttgcctttgctgacatcggctggtcaagaatgcccttcccctctccatcgtcgtctatatccccctcattcatgtgggtccagctctcctgacaccttgtcctccatgaagccacctcagcttcctacagctaggcatgtgctctctcccttcggctcatggctctctgtctgcacctctccttggacactgctgcttcctgctcagcacctggtacctaagcacaagtcttatttccctgcccagtggagagcctcaggagagggtgtgtgtctgatttatctctggattcctcagcatgctcggcccagggcctagatgcagcaggtagagaaggcacctgaggcagttggtttattccgtgtttttcttgtttttctttttctctttttttttttttttttttttttttgagacagagtctcactctactgcccacgctggagtgtaggggtatgatcacgactcactgcatcctcgatttaccaggctcaagccatcctcccaccttagcctccttagtacctgggacaacaagtgcacaccacaatgctcggctaatttttgcattttttgtagaggtggggtttcaccatgttgcccaggctggtctcgaactcctggactcaagtgatccacccacttcggccttccaaaatgctgggattacaggcatgagccactgtgcctggcctatcctgtgtttttgaaagaatgttctttagaacctaagttccacagatatgctttactatgtagtgttgcctggtcaaagtagttgggaaaccctgaatactatatccccctcctatgcaatttcatgtgcaatttcatgtgcacatgagtgtatgcacatgaggagtttacagttccatagaacagatggaggtaataaacaaatccttacagtcctatgaaatgggggaggctataaaaaaatagaacttttgcctggaggacttggaagttttcctggaggaggtggctctggaactaggtcttgaagaatgagtcagatttttgtagcctgacaaggaaaaagggaagagtgttttagaggggaaggcaggagcttcttttgttttgctgttcattcataattttaaaccacagtgcacaaatgacctcagtttattcaacaaatgttcactaattccattggtagtaagagcaatggtaataactaacttaccacatgcccatgtgccaagcactgtaacagaaccaggccaatttgctgaatgccagtcatctgcagttcagttccctgaaagccagcttgcctcatggccaattcatggaatgtacttgcatcatgtaactgtccactttcagtgaggcagtttacattttaaagactgttgaatttggtctgagccccgtggctcacgcctttaattccagcactttgggaggctgaggcgggcagatcacttgaggtcagaagttcgagaccagcctggccaacatgatgaaacctcgtctctactaaaaatacaaaaatcagccaggcatggtggcatgcacctataatcccagctactcagaaggctgaggcatgagaatcacttgaacccaggaggcagaggttgcagtgagccgagatcgcaccactgcactccagcctgggtgacacagcgagactctgtcttaaaataaaataaaataaaatataaaataaaataaaaactgttcagtttgtctctgctccctgctgctgcagctgagactgaaaattggtaggagtgaccagttgcagtggcccatgcctgtaatcccagcactgtgagcggctgagtgggaggattgcttgaacccaggagttcaagaacagcctgtgcaacagagtggaaccctgtctctacaaaatatttaaaaattagtgggatgaggtggtgtgagcctgtagtcccagctactcaggaggctgagttgggggggtcacttaagcccaggaggtcgaggcttcagtgagccatgttcatgctagtgcactccagcctaggtaacagagttaagaccttgtctcaaaaataaataagtaaataaaattaaaaatttttaatggtaagaggaggggactgaagcaaaagaaaaatctatttgcaaaatagagtttactttcagcacattaacccaaagtcccctgaaatcataggtactaacaatacggaaataaacaccatgggcctctgccctggaaggcctcataactcagagtgagagatggtgtcgtgacagggaagcagagggcactgggggcaggaaccctgttaagagtagggtaaggaggtggccaagggaaagcttcctggaggagaggatggtgtgctgattgtctagggacagtgaaaccttggggtgggtgaggaagaggggaatggaaagcagggcagggcacagaggaggagcagcagaggtctgagatgtggagaagcaacattcagtttggcacaagtggggtcccagaggcaggaaggggtgaaggatgaggctgaaggcatcatcaggaaccagagcttacggggccttgtgtgtcgtagctgcaggttgactttatcctgagagtactggtgagttctggaagggtttccaagcgagaagtaaacatgatcagttctgcttattagaaagacattggccgagcatggtggctcacacctgtaatcccagcactttgggaggccgaggccagcgggtcacttgatgtcaggagttcgagaccagcctggccaacctgatgaaatcctgtctctactaaaaatacaaaaattagccgggcatcgtggcatgcgcctgtaatcccagctccttgggaggctgaggcaggagaattgcttgaacccgggaggtggagtttgtagtgagctgagattgcgccactgcactccagcctgggcaacaaagcgagactctgtctcaaaaaaaaaaaaaaaaaaaagagacatgttgtaactactttggaaacccaccaggccaccaaaaagctctgttgtatgctttgggtataaactctgaactcagagccagagacagagagacgtgaagaatctttactgataatctaaagcaaccgcttcgtttttgagatgcaaaagtccagagaggtgaatgactcgcttagagtcacacagtgagttcttagaagagccagaactagacttctgactctcagctcgtgcacttgctgctactggatacgacagcaggagctcagggaaactctcagccacctccagccctctgtgcgtccacacacgcacacacacacaatatacacacactcttggacacacacagaacaaaacatcgagtaactggcatggtgtggcagaaggcaagttctggatgatttactttctggatacctgagagttaatctgaaattggcttcatttcagcccctgtttaaaatcttctaacgtctttccagctgtacttacaagtgttgtccaataactataaataggatttctctgctgacagatcctgacatgggggttaatttactggtctgggctgttttcccatttatacaaaggagttggacttgatagtcttcactggattctcgaaatggtgttctctgcactgtggtctgtggacatgggcagggtgccagcccccatgcacccatcctttacctctctgctgctgaggaaagcagagagcttagtttaaactttgccctcaatactgaccactgtacccaaccacactataaataattaaacaaatggctctgtctcttccagggtctgaatcagtggatgttgagtttttttcccaattaaaaacaaaatttcatacagctgatacttagagttgatcatgaccataagtcttttgggttctttattttttatttttattgagatggggtctcatgctgttgcccaggctggagtgcaatggcacgatcgtagctcacagcagcctcattcctgggctcaagcagtcttgctgcctcagcctcccaagtagctgggactagacatgtgtcaccacgcctggataatttttttttaagagacagggtcctgctatgttgcccaggctttttgggttcctacctaaagagtgacagagtgactctctggggtcattggaggccagtgaccagccacttggccacaattgacctctgagctgccctcctgaagcctgggcctccttgtcacatgggtgagaaatcatagtgcagtcaaccagcagagactgaggccactcaatgcctcctcaggccttttaagaaaaagtctgacccaaggacaaggagaggggcttcgtatgtccagtgaaactagtctgctttcctctcatatgctaaaaattgagaatataagccaattttgtttcttcttttacttggccaccaggaagctcagagtcaaaatatagctcagttataacaaatgcatgggacctatggcctgtgtgtattccgttttcccctcctgttctacacctcccagaggggcatgattaaaaaaaattctggccaggcgcagtggctcacgcctgtaatcccagcactttgggaggccaaggccggtgaatcgcttgaggtcaggagttcaagaccatcctggccaacatggagaaaccctgtctctactaaaaatacaaaaattagccaggcatggtggtgcacgcttgtaatcccagctacttaggaggctgaggcaggagaattccttgaacttgggaggcggaggttgcagtgagctgagatcacgtttttgcactacagcctgggtgacagaggaaaactccatctcaaaaataaaaaataaaaaaattccatttaatgtgttagtataggtgtaaggagctttaaattctttgcagaacacagagggggtatagttaaccaaataaaccacatgtaagttaagatgccctctactccccatctatctgcaaaccctgtcaattctgccttctccccagctccactgccccacactagctagcccaggcgcccattttctctctttttctcttatagagacagggtctcattctgtggcccaggctgaagggcaatggcacaatcacagctgactacagcctcaacctcttaggcttaatggacgctccggcctcagcctcttgagtagctgggactacaggcacaccctaccagggccagctaactttttttttttttttttttttttttttttcagagataaggtctcactgtgttgcccagggtggtcttgaactcatgggctcaagcgatcctcctgcctcagcctcccaaaatgctgggattacaggtgtgagctactgcatccagacccattgtctttcatgtagacttctccagtgccccctaactgcttatccctcactttcattttcactcttagtcctttctccacagagcagccagagtgatcttcaagtgtaaatctggttattacatggccctactgtagcagtcaggttctggcttgtaagcaacagaagctccctctggttttcttggtcacacacacatatgtacataaaggaacatactggaaaggtgttgagtgctttccagaaacaatatcagctggtcttgattggactgtcttttagcatcaatagttgggcctggatcctgctgtcattgtggttgccatgggaacccatcaccatcccttacaggagcaccacaactgggctgtggatgaattctgccgtctcaatgactcccagaatcaaagatctatgtggaagggtataattagcccagctggggtcactgcctgagccctggctgccaggggcagagtgcgaacctggcccttctgtcttccaaagagcaaggctgggcacactgtttcataaatagaatacaaaatagggaattctaagtaggaaggagagttaggagttgggcagccaaaactgcaacaaacaagtcagatatagtcaagtgcacctatagttccagctactcagaaggctgaggcaggaggatcacttgagcccagaagttcaaggctgtagtgtattatgatggcacctgtgaatagccactgcattccagtctgggcaacataacaagatctcatctctcaaaaaaaaaaaaaaatgaaaaagaaaatatgcaataatattcaccacccttgctttatattcctatgatagcccacatacctaggataaaatccagattctttacaaaggcttatgggagcctgcctgctctggtccatccctaacactccaacccttctcttgttgctctctatgccgggttcctgccagtggttttgtggggccttgaacacaccaagttctctccctccttggggactctgtgtgagtctctttggctagaatccctttctcccttttcccatggctggttctctcctgtttttcatttctcaggttaaatggcagctcctcaaaggccttccctgccccgcctgtctaaaataggtaactcctttatagcctctctcgtaacactgatcacaatttgaaacttcttcatttacgcatttacttacttttttttgcctgtctccccactaagcagacttcaaactgcacacagccagagagctgctggtctcattctctgccgaatccccagtgtgtggcaggggagacttgcatattttaagtgctgaataaatatttgtagataggatgagagtatactacattctggagattcgaggatgaatgaggaacaggccctgccctcaggggacaatgagtaggggggtttgggggtatgtggacacttaaacaggccatgtcacagtgcaagactagccatgctccaataaatgtatggtaagggctcaacaatgtcagctctggccgtaagaaaccacaggaggccagctgctccccagagttgtccttggtctaggatggggagttacagaaggcttccacccagggctggcttcatggacatgggaccagtgaatcacacagggacctacactcaaaagggccttgtccttgggatttaatgttctgcagcagctgtcttgaatttttgttgctgttgttgtttttagcacaccagagttgtaaagtatgtcttgaaattcttcataattttatctttgaatctgcattttgtaagtgaaaccctacgggacaatggagcatgccctgaggacttggagcctctgcttgcacaggctcctgccttccacagcctccctgccctccacagcctccctgcccctccaggacatgttctctaaggcccactctcccatccccaggtgctccttcctgcttccacccagtgactgctgccatctcctgaccccagagtgggcctggatacagacatgaggaaggtgggggtcaggtgtcacgtcccccagtgttgcatggcagctgtccccatcccgggctcgcagtgccatagtgcaattcgccaagtgactgagggtgggggaagcctcttgcccaccctttcccccatcaaggtacctagtatgttccttacagaggttgcaataccctgtgggttggggtggtgggcaggtgggaaggggccatgtctggctcaacttctgtgatgctgggcggggcatggcatgttggtctggtggctggagggaaagggaaatgcacacacactcggtctctggggtgctgggtagctgtgaggatctgctctcactctatgaataccccaggggagtatgacatcaaatagcaactaaaagacacgatgccaggtcaagagagggactacagaagattagaaatgtctttgtatttcaggctgggcacggtggctcaggcctgtaatcgcagcactttgggaggccgaggccggcggatcacttgaggtcaggagtctgagaccagcctggccaacatagtgaaaccccgtctctactaaaaatacaaaaattagccaggtgtggtggtgtgcacctggagtcccagctactcaggaggctgaggcaggagaatcgcttgaaccccggaggcggagtttgcagtgagctgagatcacaccactgcactccagcctgggtgagactccatctcaaaaaaataaaaaagaaacgtctttatattttaataaatttaatggcactttcccccactttttgaacaaggaaccctgcattttcatttggcggcaggcccagcaaattatgcagctggtcctgctcctagcattcactctctttgtggagctgccttcggtgcctccctacttcatagctcagggaggagatacaagctcatagcaacagcttacatttatgaagcacctactatgggccagtaaccagtttaagcccttatctctattaatttatttaatcctcctaacagtgctacaaaggattattatgccccccttgtggatgaggaaactgaagtgctatgaatagaaagagcactgaattgagagttcagaaaccagaatgttcattttaactcctcactgacctgctgtgtgacctggagcaaatgtgtaaaactcagtttctttgtctataaaatggggggaaaaaatgaccaaccttgcagtattactaatcccatcgcatgacagaatggatgcatacctgccttataaactgcatgaaagggactcctcttatatttaaactgctatgcggcaactgcaggtggtccactgagaccacctaaaaaaacctctcattttagagaggagtaaaccagctccagcccctgctaagtcatgctctctaggtgtcggaccccagtgcctaggacccatcctggggtggggggtagggggaaataaaaataacagaattgaacataggagtgaaaatggtgcttgtaaaagaaagctgtgtgtagggtctcagtttgtgatggttgttgctgtttcaggtaataggccactggtgctgaattttggaagttgtacctgaccttcatttatgttcaaatttgaccagttcaagaggcttattgaagactttagttccatagcagattttcttgtcatttacattgaagaagcacatgcatcaggtacagaaagattctctgcctcttctacctcttcccactgtcttttctctctcccttttccccaggccccatctcaaggttgggaggtggaaggaggaagaggaggggagagggaaagagccactattcactgagcacccaccactcccaggccctgcactgggctaacctcacagtctgtgctttcaaccagggtacagagagcagaacacctggagtgacagggtctggctaggagaggattctaacattttgatcggataaatagggaagtcaagggagaagaactgatttgaacacatttacaaagaattcagacccaaaatgtcacaggtgaaatgacggccttatggctatttttttttttttttttttttgagatagggtcttgttctgtcgcctgagctggggctggaatgcaatagcactcacatggctcactgcagcctcaacctcctgggctaaatcgatcctcctgtctcagccttccaagtagctgtactgcaggcatacgccaccatgcccagctagttttttgtattttttgtagaaacagagtttcaccatgttactcgggctggtctcaaactcctaggttcaaacaatctgcccacctcggcctcccaaagtgctggaattacagtcgtgagccactgcacccagcctatatttgtatttttgaaagaacactgtggtgaagaattaggagaaaaaatagtacttaaactcagtatgaattagaatcatctggaaggctgttaaaacgcagatgtctgggtcccatttctagtccatccacgctgacgcctagggtttgcactacttaacaaacttccaggtgacgctgatgctgttagtctggggacacacacttagagaactactgatctaaacccttgcctctccaagtatggtctaggcgccagcagtcttggcatcctgggagttagatggactctcagttccaccttcgacagaccgaatcagaatcttcctataacaaggtccccaaatgattcatgcacattcaagatcaaggagtgctggtttattggactatttcacgttgaagagcaggggtctggcagacagaagccctgggcttcagttctggatcaatcactaattcctgacgtgaccttgcacattcaaccataatgggaaaccaggccaaatcattgccaagggctcctctgagaacctcagttaaaagtgaggggctatttagtctgcaggaagtgtgtgctgtgtcaatgggactcggtgcctggcctttctcttgtagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaaggtggtgacctggggacagggggcccagggagggcaaaggggcccagggagggcaagggcaaagagaaggctttgcatcaagcagaactggattcaaatcaccacccagccacttaccagccatgtgaccatgggcgagtgctttcacttcttggagttccttcaatttcctcttctgcaaaatgggaatgttggtctccacctcacgggggatgaaataatgcacacgaatgtccctagcatttggactggagctgcatcctcccggcttccttttgaacccagatgatggcccagtcctggtctggtttcaaactcagagacagagaatgttgtttttgttctctgttttttgggtttctttctttcttttttttttttgagacagactctcactctgttgcccaggctggagtgcagaggggtgaccttggctcactgcaacctccacctcccgggttcaagcaattctcctgcctcagcctcccaagtagctgggactacaggcgcacaccacgcccagctaatttttgtatttttagtagagacggggtttcaccatgttagccaggctggtcttgaactcctggcctcaagtgatctgcccgccttggcctcccaaagtgttgggataacaggcgtgagccaccgtgcccggtctgtttttgttttatgaacaatgttcagagaggggaattgacttgtccaaggtcacgctgggcaaggctctgatttcaattctaaagcccttgatcgggtgggccagaaatgagaaggtctgaagctgctaacatttgcggcaggcctgaaccagggctggcggggtagaagtctcaaggggaatggaacccgtggtttggagctggaaatgctggacgcagggatgtgcggcagaaatgcatttcaggctccctttcttgtgattgcttcctctcaaaagttccagcctggtcagggtgagggaggtaagcacagcctctgactctttagacacagttggcttggcctcccttaagaaggtagaaactacattttaaagctattgaagggatttcaagccttggagagcagatgaaaccaagtatgtggatgctcctctgtccacagatcaagatcaagctgaccctacctattcagataaaacaagcaaaaacttgcaggcaaattcccaaggtgcaagggtcacagtagaagaatgtgggtccttcatcctttcctgtaccttgggacatggttcaggcatgattgaggcaccctgggcactgaatccctaccttgggttaggccctgtgcaaatactggaaacacaaaaatgaattgaaaatgactcatacctagccgggtgcagtggcttacgcctgtaatcccagcactttgggaggccgaggcaggctgatcacttgaggttgggagttggagaccagcctgaccaacatagtgaaaccctgtctctactaaaaatacaaaattagccaggcgtggtggcgcatgcctgtaatcccagctacttgagaggctgaagcaggagaatcgcttgtacccgggaggcagaggttgtggtgagcagagatcgcaccattgcactccagcctgagcaacaagagtgaaactctgtctcggaaaaaaaaaaaaaaaaaaaaaaatgaccggccgggcgcagtggctcatgcctgtaatcccagcactttgggaggctgaggcaggcagatcacgaggtcatgaattcgagaccagcctgaccaacatggtgaaaccctgtctctactaaaaatacaaaaattagccaggcatggtggcatgtgcctataatcccagctacttgggaggctggggcaggagaattgcttgaacccgggaggcggaggttgcagtgagccgagatcgcaccactgcactccagtcttggcaacagagcgagactccgtctcaaaaaaaaaaagaaaaaaagaaaatggcccacacccttacttcaaggtactcacaggctgagggataaggaagacccaagtaagactattacagtgtcccaactgctgggggactccagagcaggggtcagcacgccttttctgtatagggcctgatagtaaatattttcaactttgtgccaagtaatccctgtcgcaacaattcaattctgctgttatagcacaacagcagctgcagacgacatgcaaatgaaagcatgtgaggcatcaggactaacctggctctcagactgtaagtttttcaacctctggggaagggtaggcttctcagagggggcagcaattgcttgggccttaaaggataaggagttggcctagtgagcacagtgagtgaaaatcactgcggtatagggaagagggtgggtggaggcactgaggcatagtagggcagagtgtgaataaacgattggagacattggggttacacaggggtctcattctagaccaaggggtttggtcttcatcttagggcaaaggagagccactgacgggtttggagcaggaaagagacatgatcggacctgtacttagaacgttcactggctcacggctgtaactctagcactttgggaggctgagccgggcagatcacctgaggtcaggagttcaagaccagcttggccaacatggtgaaaccctgtctctactaaaagtacaaaaaaattagccaggcgtggtggcgtgtgcctgtaatcccagctacttgtgaggctgaggcacgagaattgtttgaacctgggaggcggaggttgcagtgagcaaagattgtgccagtgcactccagcctgggcgacagagtgagactctctcaaaaaaaaaaaagaaaagaaaaagaaagttcactggttccatggccgggcgtggtggctcatacctgtaatcccggcactttgggaggccaaggcgggcaggtcacttgaggccaggagttcgagaccagcctagcccacgtggcgaaaccctgtctctactaaaaatacaaaaattagccaggcgtggtggagtgcacccgtattccctgctactcaggaggctgaggcaggagaattgcttgaacctgggaggcagaggttgcagtgaatcaagattgcgccattgcactccagcctgggcaacagagcgagactctgtctcaaaaaaaaaagaaaaaagttcactggttcctggttgaaaaatggacaggagggagcagggactaaggactggggatagctgggaggggtggcagctgcccaggctgtaggatgaaaagggctgacctagggcagtagaactggagaggcagagatggttctgaggtaggatgggtagaacttgatgtgaaggctggagaagattaggccagtctgaaggtctgattatggaagaaaagcttatttgtacagaacccttctctttttgaaagactatgtcactttatgtcctctagtttttctacttctctgtccaaccttcctgttaactgctgatgccactgtacacactttctcaaccacctcacggttgcatctgccattgaattagccatgctgatggctcctacacagacatcatttgaccacctcttgcaactaacctccagacctacatgttccttacaacttggaaatccttaaaagttgggaatgcctgattcgtttctcttgcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctattttggatggcttccgtgtgatctttacattttcttttccaatttgtatctgattacccagtgtaatctgaccagcaaaaataccatacgctgaaagggcctcattttgggggaagaacattcaggccctatgttacatgttaaatgtggttttgtcttatgaactcctgctggagtgaaataatttttcacattggaatcaaattacctttataacatgacataaaagaatggatcaggagaccttttgctagcatgagaacatattctctttagctatactttagttgctacaaagttaatattattaatgttgtcactttattattttaaaaatagttattgcaagaggctgaggcaggagaatcacttgaactcaggaggcagaggttgcagtgagccaagatggtgccccttaattccagcctgggtgacagagcgagactccgtaaaaaaagttattattaatcatctaccaggcacagtcactttcagatatgttatctcatttaatctctatatatctcaaagaggagatgattatccccattttacagatgaggaaatcaaggctcagagagttaagtaacttgcataacttctcagaactagtaagtaacaagccgagattcaaaccggatctctaacttcaaggccagagtcctagctctgttcctgccagctgggtgactttgatcaagctgccttggtatcttgacctataaaacagggtatcaatagtgcctagtccatagattcatgagtagagcactcagaactgtgcctgacttggagaaagtgtcatgaagtgttggctattattacgattatcataattattgtcccacaactgcttcctcgggcccttttttggggggttggaggtggaaggaggacaagacaatatggatgctgaataaaaattccccatcctaccaaagccactcatgaccaacataggcatgagtttgtgaggctatactgaaaatgagaagctgtgacaatgatgggactgaagcacagatgagcactcactgttcctcctaagtactaagttgcacaaaaggagacaggatgtaaggcaagcctcttctgaatcacttctctgatggtcttccaattcgtgtctacaaatgcacagaaatctccccattttcactaaataatagtagctggaactgaggagcttttcagaatgacaaaaatagacccccggctttccaattagattctcttcaacttaatgcatcaaacattgagcattgattcttttctgggtgcagagttatgcaaagatggacgaggaagagctgttgtcctccagcagcttaatctcacaggggaccagacatacactccaatgaccataactcaaggtggagtatatgttagagtgaagactaagtgctcagagggcacagaggagacagcaatcctctgagctgggtgaatccaacaatgctttttggagctggtggcatttgagctggtcttcaaagatgcccagtacttccataatttgggatgggagcctggagaagatgggaagggagaagggcatttcaagtgaggagaactacaagggcaaaggtgggaaaagggctatgtgcaggagactgcaagaggtttgggttcaattccaatccttttgttttacagttgctagccataggccagtgtagttcaatggttctcaaacttgggcatgcaacaaaatcacctggagggcttgctgcaacacagattcttggttctcatctccagagtttacgattcgacagatctgaggttgagctagggaatttgcattactaacaagttctcaggtgaggctgatcctgctgtcccaggaaccacactttgagaaccgctgctatagtaggtgttgttggtgctctgcccagatgccttttaccaagccattgtactcatgagccagctgctgtgagtgttggctgctaatggctcacagatgcactctttcctgagaatttgccct

SEQ ID NO: 11867 - DNA, 48536 bp, Human
caggataatataaaccgcagggacaatgcaagctccaaaaaataagtgcttggcacatagtaggggattaataaatattcgtttaatcaattattgctaatattcaattaaacattctaaacaaggacggacaaaagtcttcattcctcccctactcaccataaaggagaaagagagggatgtcctcgaagctggacggactcagcttcagcttgcgttacctagccttgcaggagattccttctccaacgagattatttcattggctaaaacgttaggggtgttttgaactctggggtcaaaggaggaagtggttggaaatgtctcaatctcgtgccacaggtgaagtaaacgaatcttcctttccagggaatcacgggttttgggaaaaggttgaggcgagcgggcgtctatgctggacaatgaagaacgaggggcaccgggagatgtgttgcctcctccttcctgtctcctgccccgtgcgtcttgaatgatttagcactggcacctggctccctgattggtgcgagcgtctcgtttagggaaggctctaggagggccggtggatggaattccgagcttcacctggttgtatgccgcccacttcaagcagcgcagagcagctgccggttgagtggtttggggggacgtttcctacgtggagcagacacccccagcctgtccagccccaagcctcagtgcccggggctgcagtcaccgcgcgccccgccgtttaggatgttttttgtgtccttaaaaagtgccggggatttcatcgtcaggtggagacaaggcgacaaaacagtagtttctttagtaccaaaggcaacgcgattatttcaaaccccacagcgagatccctcttgctgatcaggccatgtctgcccagggcggacccttcgatctcccttatggaactctcggtaatttataatatttttgtgtgtgtttccattgtgttgtggtgaaaggcgataaggcattcaaagaaaacggacgggcctccgctgaaccagtgaggccccagacgtgcgcataaataacccctgcgtgctgcaccacctggggagagggggaggaccacggtaaataccagtaaaggaatcactgcctacacggtgtcacccagacacgcacagacatcaacatttttgccctaaagaaaaaaactgggggagaagaaaggggagaacttaaactagtgacagggcggtgagggaaggcatgaagaggcaagccggcgcgtaaccgtctggccagcagctccaggtgtgggctccgctcgggcgctggcggagagacccgggagcgcagggcctctccgtctctgggctcttggcgccctctggtgggaatttctctttcaacgcatttttacggcgaggggcttctcccaacgcagcggttcttttaactacgcctaaatattgcaaagggagaatccttaaagcgcgtgaaatcgaagggggagcgggccagggcaaggggggctggtccgccccttccggggcacctctgtgctcgggtgccccatgcgcgtgcagcggcgctcgtgcgtgtcatcaaccttcagacgtgattaatcaggaggccttcttttcccatcaccaagggggccaaagcgaggagcgagcgcatagcaaaagggacgcggggtccttttctctgccggtggcactgggtagctgtggccaggtgtggtactttgctggggcccagggctggatgaggaaactgtaattcctccatggtctaagaggtctcccctcatttctgcctcctttgcggttacaacaatcccagctccgtagagagccaacgaggacacgacccaaagcgcgctttcgctcaaggaagcgtcgcagggtcacagatctgggggaaccccggggaaaagcactgaggcaaaaccgccgctcgtctcctacaatatatgggagggggaggggaaatgggagaggggaaaggaggggagggaagaagaaacgctcagaaaggcagaattcttcgtaggaattatcttttccctcctctcacccgacagcctgcctatttccaaaggaaaaaaaaaaagcgtgttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgcccgccctagtccctgctctccacgggtgcgctgcgcagggacccccccccccccgcctccctcgtcactcttcttatccctgccctccggattcacgccccggggaagcacggaggctgaggctctagttgaagtggggcaagagcgattttcccttgagcttccatgctgcgagcgcctgtccctccaaagggcgcctgggcagcagcagccgaaggcgctactaggaacggtaacctgttacttttccaggggccgtagtcgacccgctgcccgagttgctgtgcgactgcgcgcgcggggctaggagtgaggtcggagggagggtgtggaggcgatggccggtgggcccttctctgtggggtcctcgatctacccagattagcccgcaatctctctgtcccggggccttcgggcgccatcgcgccagcgccgagagtcgagcaggggcgccgcgcaagatctttgtccgccgcctcctgcgcgctgcgcgcaagttcgtttccccggtgacgttccccatgcttacttaccccaccctctctggatctgtaccgcgagaaatctggggtcctcagggggctaggtagaggagaaacgctgaaaccggaccgaaacctcgccctaggcttagcgatggctaaaaaccggctgggataagagggaggcaagcaacattccgactcgctgctttctggctgtctggagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccccgctggcccacacgccggctgctgagtgcccaatggggcttgtagcggctcggctggaaaatcgctcactgagcgctcccctgtgctcctagcctagtcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaagtaggtcccgccccaattttctatcaaatgaactgcagggaagatgggggcgctgggacgtcgggaggctgagctggcggaaagggaagggggagcgcggagataatggaggctgggaaataaatggggctctgaccccgtccctgccagaggtcattcggctgtcagggacgctaggtgactcccagggcaccggagagcgaggaccacgcaaggtccgagcagcggcgatcgttgagggcttcgcggaggaggaggggcgcgcagccagggtgttgtttttattctgttgtgtgtggtttctttgctccgtgggacgacaggggtcagcgcagggggcggaatgaagagctaggagccccagcaggaataagagttttcagtccccggctttcgttgagccaagatctgacctcctcctttccccctgggctgtgttcaaagtctataatcagcggaaatttcgacgttaattgcagcttttagaaaactcaaggtccctaattgctccaaatttgcatcaagctattgacgagttagggagaagtcaggggcgggaaaggtgcataaaactgagactgagccttgacatttcatacaattaattacatctcagagaaataaataaataaataaataaataaataggggagcgggcggcatcctgagtggcaagagatggggaactgggagggggcaagaagctttatcatagagaggagagagcacctctctccttatcccaggcaagagatctgtcaggaggtgacatgtcccgaaaagagagaaagaaaagagacaccagataaaagaggggggaggatttatgcttccctgtcttaagtgcgacaggctcctcaacccatttccagaatctatctttaattttatttcctacctctgtaaaggcttgagatgagaaaattgtttttctttttccttgttggagtgaagaagtgtctcctgaccccacccccctaaaaaaacttatcagcttcagactgtaagtgttcccactcccccatttatttatttctgagatgtaattaattgtatgaatttccagaatttgtatacagaaagggcttaagaaggatagtgtggttacagggagtgcttattgatgcgcttttatggcactttatatttgagaaaataagtatcctcatcaatgaagtggggattattaccggaaagcccctttagacgctggcattggctcccgggcaggaggtctcgtgttaagtcctcaggtctcattccaatttcctttgcagctccctcttcccgccacccaggagggatacaattacccacacaacaaagagggcctcgggagagtcgccagccctggtagcatatgaaccaggcaccggcgttggagctggccagggcagggcgggaggaacgcgaggcctgcgcgcctttgtgtggtgctttcgccttgatggatttcttttctgacgctttccacatttcccgctcccttttgccgcctgggggtgggggtggggggttagcgggcagttgtgttaatttgccctccactcccggcgcccttacggaattcccggtggccgccagtcgccggcgcaaatgccaagtcaccggtaggagacacaacagaggcgatgacctgaatccgcacgtggcctggttcgcctggaagctgccaaagcgaaggcaagagagcccgggaccctgctgtaaaacagcaagcagcacgtgtcccaggcacactgttgcgggcccttagcctagctacgcatccgcaccccaggcttcaaaggcgcgctgggcgctctatccactctcaccctcccttgcagacaatacctttgcccgcccagctggctccacttctttgcccctttagagtctcctgggaggtggcgttagtgcaggcaacctaaggcactctcttgttccagaaacccttgggtggggcttggagccctccttgtccccaaccactaggtcttcccgacccttgctacatcaaaggggctctctcgcttgctctccccgtctccctttccctttctttcattgcaacccccaattttgaaaggcagtgcaatgtgtctgaactccaacttccctgttgattgaccttggaaaactcatgtaacctctctgagcctcgatgttttttctttgtcaaatgactcttagatcaacactcctgccagtttcataggactgttacgagaattagatgagatgatgttgaaagtgaaagcactttatcaggtccaaatagctctttatccgccaggtattattagggtttcgcttttgcactgatttcctgtctgtcactggaactccatctgtgacatgtcttaccgacgtcaggctgtttcttctccccgctggggctctgttgtgcctcaggtttaatggatgtcactctccttatcgcctccaacacctgtgcgaagctggaggcaccagtcagggtagggtaagcgagtgcttggagaggtttgctttgagagattggaaggggatttcgtgctgggctcaccacaccactccgcttgggggcttagtggggatggggctgcttcccacgcttcttgctggaagttgaaccccgaaggcagcaggtagaccttgaggggtttgagaacagcctggaaaagaaggaaaatccagcagcacctccaccctcagttgtgactcagaggaaaggtgcttgattccatttacctttgcctgctccagacccaagatgtcagagggaagggttaatgaggggcaggttgggaagaggggccagggatgaggacctgaggcgcactattgtcttccccactccccggtctgactgaagagcagccatgcgagcccgatcatctagtcaaatactatttttcacccaattaattcttgaactcttccacgaccccatttcatgccagtttattttaagctgccactaggctggagacccgccaagaaattatgagacgtttcggtcccagatgcctgtgttccctttctgggctgctgtggtcgccctttgagtctgcggggcccggccagtgggtgttgggcagctcgatcggagcctggccctttgcgtgtgggtcagccttcacccaactccgaccccacctccggagctgccgggcgggggtcgcttacgggcccggaggggcgccgggtgccccgcctctcagagacaccgttccatatttgaagccaggagcaggaagggagtatgatgggggcttagagtatatgcctgtcggctcacagatttggctcctagctcctttcaggaagtagcttttaatgaagagctctggcaaagtcctcatcctcccccaagaaaaccattgtcctccacccatttccccgcggtcggaacctccctaaccgaacctctctccctctctctcgtcctagcgtacgatacctggtgcggcgtggcccatggatgcaccagaaaactggggctcaagatctgcggtaagtgacaggacccactggggcccggctgggtggcgcggcgggcggacctttggggcttgggagactgggacgcaagcggagggggatccgggctcatgggtctgattttctaatgtaattacagccaggacagccagcgaccacgctcccctacaggccctgaccctcctctgcccgccccagacctggtccccaggggtcttttcctctggagtccccaatccccaacacccagtggagcgaacgccgggtgccctgcctgggcgcagaagcgggaggaaagcgcccccgcgcggcaaccccgccttcctagccctgcgcgcaagcagctcccacccggtgccgtgcactctgcctgcgcgtcccaaaggtcgcgtagaaaaggtgaactgatctggcttgctggagagcagaccaaaggcggtgtatctgcctaaagctgtagctgacacgtctcccccatcccctacatcatcgcctacccctcactcgcacctccacccgcgcagtcgggtcgcattgaaagtggtctctccaccttgaggggttttgccctgagatgtcataacggattcaagtttctttctttggggcttcggaggctaaagaaaaggattgcctggagccctccatggcctgcctgagggaggcacgagggtttgcctggcgcatccttgaaggcgaggagggaagggaaaggggacgagcagggacgaggagccgcaggcggcgaaagaaccgggaaggaagaaaatagatcagggagctggagaggagaaagaactgctctctggagacaggagggtctgaaatgaaaacgcccaaaggatgtaatttttttaaaggaaaaagggagatttgttcgaagggacacagctgagtgattctggctgaacaatgaggcctcactttcctggctacatttcaccgactaaaattctctagccttatcgggccagaaaatacggatgtccccgggcagaggttggagaggcgggggaagattaacgggcggcttattaaagagccatccgtcagctcctgcgcgcgggagatagcggcagagcaggcacgggacacgcccgcccgccctagccccggagcgccgagagccgcccgccgcctgggtgctctctgcacctgatcttcccagcctccctgggtcccggggcgagggcggtggcagtttgcagtcagagcagagtggccgctttggggaactactcccttccctgcttggccgcgccgcgccctccctgcatttctggggctctgtcctctagaccctgggactcggcgtttagggaggaacaggcgctccattcctagacccagccattttccaccgaaagcccagccctgccgccgggcggcctgggagtttggccttctccccagcgcaggacgcccgtggggcaaggccagggctgcatccctgtgctggggcagccggcggccgcggatctttgttctataaatagccccgtcccactcccacccccacctccacccccaccctgccgccattctgggcttaatggcccgtttcgcgccaggtcccttcggcggccgcagcgctcggcttctgcagccgtcattgtcatgcagccagccgggcaggcagaactgagcgagccctgggcagccgaggacagggtaggggcaggctctgggcgacggctccttaccagcggcgcctggcctgctgagggtggggggcagccctcattcacccccatcctgccccctgctgtcccctgctcctctggctgcaggcgctccacttccgcgggaataaaaggtctaagtgcttcttatggggacatacccgacgagttcagaaaggctaaagaggcgggaaagagtggggcttcgctgggtccggaaatagggaagccggagttggcctccactccccctcccccactgtcagccgaagctaggagggagagctcctgggggctacagtcctcagagagtttcctccctgtgtctgctccccacaacccatggtagtctgttgaggagaaattgccttgggctaaaatgccccgcttttggggccacaggttaggaggcttcccattaggtttgattgtgaaagaaaacaaaacaccaagatttattttccacaccttgagacaactttggctttccattttaatctagtggaggcagagtgcagtcttttgtgttggccctgggtccacagctccctgcctgcctacacacacacacacacacacacacacacacacacacacccctcccttcatccctggagggatggacctggagggtcccttcttgacttgacaccatccaggttggtttaccctttcacattaagagagcagaggaactcatggtcctcttcccacttccaaacccactgccctggatgactctcagaagcaccctcagtgccttgccaaaattcaacccccacccactctccccctgcccttccccaaaatccacagaatgaagctgcaaggaaggccctgggccccactagtggtagccctgaaggcagaattagctctggaggcagaatcccccagggagagtaatcagctagaagaaacccatggtcttgccaagagctggagagtgctgcaggcatggtggcatgacctaaatacgatgagttgcagggatccctaagttctggctccaggctctgctaacttcccagggtgtccttgggcttccatcacttatctcttgctgccaactacagcccctgagctgttttatttagcctacactcgtgtgtgtgtgtgtgtgtgtgttatgtatgtgtgtgtaattttgtatcaagtgccaaaccttaaaaatagagagatttcaagtgctctctttttctggtttctcttgaaaaaacttgggggtgggcaatggggagggaaacatggcaggtgctgttagcccaagaaaatcagaaaaagaagtcatggtggctcacatctgtaatcccaacactttgggaggccaaggtggtaggatcatttgaggccaggagtttgagactagcctgagcagcatagggagaccccatctctacaaaaactttcaaaaaattagccaggtgtggtggccacatagctgcagtcctagctactcaggaggatgaggcaggaggatcgcttgagcccaggagtttgaaattacaatgagctatgatggcgccactacactccagtctggacaacagcaatacagtatgaccctgtctcaaaaacaaacaaacaaatgaaaaagagcccctccgtctatgcatatgcaattccatgccatagcttggtgaacagagagtgtgctgggcttcagctcccacgtgccctgttggccataggtgtttatgccatacacagctcaaagccccacttggcaacaactggctggagccaggtgctttctagctacacatacctgtgcgcacatgcacgcacacatacacatacacactctctcactgggccccataagcctttgagtttggcagcaggggtgaggaacctgcagcaggagctcccctcagctcagaggtggagtcatgatttttctccccttgcggctggccagtgtgctagcacccaaccaaacacaactgcagctttgcctctcctctgctttcctctttgcctctaagaatgtagagctctgtgaccagttacccacaggcttaaactaggtcctcgaagctggggtgtagagcaagagggagtacactcggcttcattctctgggaccccttcttacaggaccccttgctagccagggaaattgtcaaggcactgacctccatgtcatccaccacctcttcatccttggagaagcagttccttccagggcctctcagagccaagggaggcctggttcacctacctttctgaggatcccagtattttagagaacaaacaccttcctaaacaaagtgaaagacatgtgacaatatatattatatgtttatattagcaaattaattgttttaacataaattataatgcagtgtaagtgtgctattcataaaataattacaggatttagagaggattctgattcctagtacattactggaagtgcagcccaaggaatgggatgcaggtttaaagccgtgtcgtagggccgggcgcagtggctcgcacctgtaatcccagcactttgggaggccgagacaggtggatcacctgaggtcaggagtttgagaccagcctgaccaacatggcgaaacccccatctctactaaaaatacaaaaattagccagacgtggtggtaggcacctgtaatcccaactacttgggaggctgaggcaagagaatcacttgaacttgggagctggaggttgtggtgagccgagatcatgccactgcactccagcctgggtgacagagcaagactccgtctcaaaaaaaaaaaaaaaaaagctgtggcataatgatcgtttctcagcctcatgagcgcatctctgggagagcctgtgtcaaaacctcaagccgagtttctgcttcctgcagctgcccagagggaaggggcttcaaggtggggagactcagggagtgagtcagaagcctaagcaggcgtcggggacaacagagtggaggttcagctgggcaggacctcactacatgaggccacatgggtttggtctttcaagtctggcaaattccacagctcaatgttctgggatgagaggagcagtctcagagttcaggtgccatctgatcctgcatccctctggcaaatgagtgctggctcctggctctggactttgaggatttggaggaggaattcaggaagtaggcaaagagatatggaaaaggatacaatcccatctttatacccaagtgtggagctctattatagtgtatttccccccttctcatgtcctttgggctttagtgataaatgtaaaaggtgctgggagcaacaaaaagcttggtggctctgctttccccttcttccctccagaaatagcccctggctcccttgtgtgggaggattctaatcaccgcagccctcccatgcatccccccttctcccacccatcacagttgaattgtagtcctgggaagcaaagctgaattctccagattaacttgcctttttgcacctcttgggactttcttccaagtctgccttgtgacacgtgtgactccgcaagtttcttggtatttacagaaacagctttggggtcaccaagaagcttagaacctttttcctcttttcagtgtgctgcattttgggctaagactgaggctgaattgaaggaggagaagccaaaggaaagagcagacgtgcgggccaggagccccacaggggatggtggagatgtggagggagtgtgctccacgctggcaggttctcctgcccttttggcttaaccctctttccccgtttgctgccggagtttgtcctgctcaccttgggcaggagaactttccactcactccgaggggcagaggtgaggcactgagaatcccgccctgggctcagatccctcctgtcatctctgtggagttcttggatgactagttttattccagcatttgtcaccatctgccaggcttgtaggctcctggagggcaggggatctgtcccactagctttatcagtccccaatcctagatgcttagcaaagtgtttttgtacaacaggtgctcaataagtacttatagaattaaatggcaacacagaagattgaagctttttttggtctcacagtaccttcattcaaggagagggggtggtgcaagaaaagctgcattcaggtttgcattcagaaaaataccacttacgttcaaccctgtgagcattacctggtgctggaggaaagtgtctgcccgaatcctctgtgttggacctcactccttctccttctgccatcctcacccctcctccttctgctgtcctccctctgctgtcctcaccctcctccctctgctgtcctcaccctcctccctctgctgtcctcgccctcctctctctgctgtcctcacctctcctctctctgctatcctcacccctcctctttctgctgtcctcacccctcctctctctgctgtcctcacccctccccttccctctgctgtcctcaccctcctccctatgctgtcctcaccctcttccctctgctgtcatcttcctccctctgctgtcctcatccccttccctctgctgtcctcaccctcctccctctgctgtccccaccctcctccctctgctgtcctcacccctcctcttccctccgcggtcctcgctgtcctccctctgctgtccttgatctcctccctctgctgtccttgatctcctccctctgctgtccttgctctcctccctctgctgtcctcaccctcctacctctgctgtcctcaccgtcctcctctgctgtcctcacccctcctcttccctctgttgtccttgccctcctccctctgctgtcctcaccctcctccctctgctgtcctcaccctcctcccctgttgtcctcaccctcctcctctgttgtccacacccttctccctctgctgtcctcaccctcctccctctgctgtcctcgccctcctacctctgctgtcctcaccctcctccctctgctgtcctcacccctcctcttccctctgccgtcctcacctctcctccctctgctgtcctcgccttcctccctctgcggtccttgctctcctccctctgtggtcctcactctccttcctctgctgtcctcacccctcctcatctctctgctgtcctcacctctcctccctctgctatcctcatcttcctccctcagctgtcctcacctctcctcctccctctgctgtcctcaccctcctccctcagctgtcctcacctctcctcctacctctgctgttctctcccctcctccttctgcttatacagcccataaacagtgctggcagcatcttctctgattgtgtctcctcctttaaagccctatcctggggctggtcactggagtggaagctgtccaacttacttaattgtgagttcactgtcacattcagagaggagaacgggcttcacttactgtttttctctcttgcatgactgggcctctgccactgatgacatttggcactgcccccctccctgcctgaaggcgagcagtgccagagccactgtatttaaaacacagacactcacttcttttctcaggagaaacaagagccctgcttggagagttgattcactctgcagctgaccctcaggggctgggcagtttgcagcactctctctgaccagcttcttgtgccataggcttcttgcaaaggaccaacagcctggaagagaagagtcgccttgtgagtgccttcaaggagaggcaatcctccaagaacctgctttcctgtgaaaacagcgaccgggatgcccgcttccggcgcacagagactgacttctctaatctgtttgctagaggtagcccctgccccactcccgccccatgctagccagtagatttcttatttgagtttcttgactttttcctgcaattttacttcttttatcaagaaatgtcattattctctctgaacccacatgaaactgcttttgtgactttgggggaatataattgactccctccctccctgctggccaggtctccatcattttggaaactggatgaaggcagtcaataaaagtcaactctaaagacactcgagggaacaaatatggattcatagactctcagagtcaaaggaaccttgcatataagaaaatctaatgatttccttaataacgtttatcctggaagattggccacacacatacacacaaaatcacactatgggaagttgcatgctgagcctcataaccaacgagtgtcctggaacttgttttcctttcagagatgttttactaacccctgctgccccacaacactcatctcaggaggtgctttaccagtctctcccaaacagctcataggtagatccgcttccatccccttctgtgaacttcccacagggccacagaaggcagaccagagtattaaacaatatgtcactaaaaccctggagctaacccaggaagtcacagagagtatcgtgcacaactgcacagcctgcctgtgagctacagaattgggcccctacagcttttttccctgcctaacctctagcctgactactgcagagcctgtcacccaaagtcacctctggatatctcaaagtccaggcccaaaagggtggggtcaagaaagaggcaggggttccctgtcccaccttcttgagccccatcttccagctccagtttcctgtcgaaggacaccgccaaggaccaccctcctcagggggaaccccagcctctacccacagaggccttaccctctgatgccaacagaccaagcacatcacaacaccaaaccagatagacagggacacacctggtcccaggggagcacgacagatgccccctccatcacactcctcacaggtgcccattcaacctgcagatgacaaccgcagtcgcaggttgttcacggcgtctcagagcacttcattccatgtctgagcagcctgtcagaaaggctgtgaacccccaggaagcatgtgcaaaacttctgtgtatgtgcatttttctggagatgtggtatatccgattctcagtgcacatacatatcccagaatgaaatcaggcctatacagatagcatggttaatattaggggtctctgggctgaagaaatctagatatgagtcaggtgaaaaccattcattgctctccccaattcagatctgcttccggctaagaacggtgaggagcaaaccgtgcaattcctcctggaagtggtggacatactcctcaactatgtccgcaagacatttgatcgctccaccaaggtgctggactttcatcacccacaccagttgctggaaggcatggagggcttcaacttggagctctctgaccaccccgagtccctggagcagatcctggttgactgcagagacaccttgaagtatggggttcgcacaggtaaggaggagagttgggtagacaggtagtggcaactttgccctccatctcacccttgccagttgtgaggatatcaaacttgtgttggaagaaaaacacagccctggtgagataaggcggcaaagtacccagtgaccacaagaacaagcttgggcagtaacagttggtggagggacccgacccaggcaaaagttcatcagcatatatcatggtaaaagtagataaaaaagatataaatgcttggtgctaggtcaagttctgtataaagagttttcattctggccaagcacaatggctcatgcctataattccagcattttgggaggccaaggtgggcagaacacttgagctcaggagttcgagaccagcctgggcaacatggcgaaaccttgtctctacatatgtgtgtgtgtgtgtgtgtgtgtgtgtgtgtgtgtgtgtgtatatacctatttttatatataaatatttatatataaatatttaatataataaataaataataattataaataataaaatttaaaaataataaattataaataataaatataaaaataatatataaatatttatatataatatttatattatatattatatataaatataaattatataatatttatatatatatgaaaatgagctgggcatggtggcgtgcacctgtagtcccagctactcaggaggctgaggccaagaggcagaggctgcagtgagccaagatcgtgccactgcactccagcctgggcaatagattgggaccctatctcaaaaaaaagaattttcattcttggatttaggctattcacaacctaaagagagcagaatgacccatcctctgcttcttttcttgcctccattttcaggtctatttcattctgataaatcctgcccttgcctgtccctgacactggggagaattgggctatttcctctccctttctgtattagtttcctaggaatgccattataaatgaccacaaattggatggctcaaaacaatagaaatttgttctctcacaattctggaggctaggagtttaaaatcaaggtgctggctatgctctctctgatggctcttggagaggatccacccttgtctttaccagcttccaggtgttgtggatattccttggcatttgttggcttgtagatgcatcgctccaacctctgccttcacttcacatggccttcatcctgtgtgtgtgtccaaatttctctctccttataagaatgccagtcgttggattaaggcccaccccaatccagcatgacctcatcttaacatgattacatccgcaaagacccgatttccaaataaggtcacattcacaggaaccagggattaggacttgaacatatctttttgaggaacacaattcaacccatgacaccttttaccagctaggccaaaaagacacatgcacacacaggccaaaaagacacaggcacacatgcgcgcgcgcgcgcacacacacacacacacacacacacacacacatacacacatgccttctcattctactgcaacttctggaacttaggacactctgagtcaccaaattctatttccagtgggagtccttgaggatgtcctcttgcctccttttcttgttccaggagctctctctaatcagcaatcctcatcaaagcagttgctttccaattgcctccagttcaaggactttggggcctctgtctgagatgcttagaaacagctcagactgtggactaagcccaggagtgacacagtggtttcttctccctataactctctccacactacagtctggctttcctgagctctcaggcagacagatctagaataattgacagtccctagcttagttgccaccacaggggaagccccaaggccacaactggcaatcctgtgttctttcttcttctttgtctctccttctttattttccctctcattcttcctcgtcatttgaagatagatttaagactgagactaggaggctggtggtgatagagctgagtaagactattggatgtcaaaaacaaagtgttataatgaaataatgatgctggccaaagatgctttttaaaatgaggaatcccagagagctgctgaggtctgccaacaccactggaataagtgcagcttcattaaatgactgatggatacacaagactcagttatatgtacaaaatttatgttgtttgatttttaaagaaaagcactctatcaatttacatttagttacttctcatcttggtcagatggctaatatattcctaatggaaaacaaatagtgttattcggctgcattttaaaaagagtcagaattccccatgtatgtttagcttgacttgctttggtgtgatattttgaactttgccagtttgctctacatgcgctttctcagagagatgagaactacatcattttattatgaaagcccagaatggcgttgtccctcaaataaaaatacatgattttgtcataatatcaactaatattatctacaaaaccaaagcatcttgtggtcagagaaagcactgacgggcctggcctggtggctcacactcgtgatcccatcacgttggcaggctggcaggtggatcacgcgagctcaggagttcaagactaacctggcaaaaccccatctctaccaaaaatacaaaaattagctgagcgtggtagtgtgcacctgtgatcccagctactctggaggctgcagtgggaggatcacttgagcccgggaggcggaggttgcagtgagctgagattgtgccactgcaccactccagcctgggtgacagcaggaccctgtttcaaaaaaaaaaaaagagagagagagagagaaagcattgactttcattagtccagtgtatgaacccacttaggtacttagcctgcaaacattcatttttgttcctcagagttgcttcttggggcagatatttgtctttacagagttcacagtcttccaagcaatatgaaacctcctgctatatctcaggattttggccctgataaaagcatgctgttgctgccgtgtcaaaacagctcctggttgctgatgtggaatttaagcatagataaggagcaatagggtaaaccccacaggtagctacacacagtagaaagtattttttcaaggatattaatgcattaataggctcagccaaaataatgaattgggttttaatagtgaaaacatactgatccgggtatagtctgtgaagagatgatgatggcatttagaaatttctctataaattaataaaagacttcttttaaaaaatgaaccagcctatagagatttcccatgaactaacaggcaccagtcagccttcagccacagcagctacttaagtgatttgtagatatgctggactcccttcgttgttctttttaaaactttttcttatggaaaattttaaacttatacaaaagtagaatcctataatgaaccctataaacctaatgccctgctttattatcagcttttacctgtaccgccatccattccccatcacctacattacatgaaagcaaatccccaacataatattattgtatccataaatattcattctttttttttttttttttgagatggagtttcaatcttgttgcccaagctggagtggagtgcagtggcgtgatctcggctcactgcaacctcccctcttgggttcaagcgattcccctgcctcagcctcctgagaagctgggattataggtgcacgccaccatgcctggctaatttttgtatttttttagtagagatggggtttcaccatgttggccaggctggtctcgaactcctgacttcagatgacccacccaccttggcctcccaaagtgctgggattgcaggcatgagccaccgtgcctggcccaatattcattcttaagaactttttttaaaaaagtccacaatgtcattgtcatacctgaaaagaaaaatttatagctccttaatgaaatatttagtcagttttcaaatttccaattgtatcatgaacgtcataaatgcttttagttaattaaactcatttgaatcaggatccaaataagtttcttacatgcagttgtttgccttgtctcctaatcaagagatctccccctccaactcttcttttttttcttgtagtttatttgtaggaaaactttgctttaaaaaataattctttccttctccccctacctgaatttaggccatgagcggcccagcaccatatctatcatctgctactttcatccaatatagagaattgaaattcaaattgaaactattttgttacttaatagaaattctgatagatataagatttgggggcacaaggttgtaaccataagctaaaaataagattttgaaggactttgtgtcctttatattttaatggacaaagagatactatttcactttgtgttaatctctctgtctttgtccatcttttgtttctgccaagctgtatggttttgatacattatcaaatagtgtgattgcatttatttaccattcagtcttgtcttaaaatgaagtgttattgttaaaagtttttaaatggatattgcatatatattttaatggctttcaatacaatgtgttgtttcaaaagacctcagattctgttggcaatgagcaaagtagagtaacatggaatcatttaactatctaggatagtccacatgaatatctagaatatggccccatacttaaactaagtttactagttatgcttcttttagttttttctaaaaaacagtattattttgtgagggctcttaagatgcagagactggtatcttctgatatgagaagtcatagtccagatgttctgaatcacatctagggaagaatagagattctcagagaggagagttagaccaggaacattctaacactagctctctgaccgtttttggttgtttttctttttttttttttcagaagcaaaggcaatttccactggaaacacagcagtcagcatatctttctaacaccagttcccagccacacgtccctagataatctattgcgttgactccttcctgacagctgagccaagcctgctgatgtggagttgagttttccgttgaatgctaagttggcaaaaacttggcaacaatcctgaatttgctgagagcaaagcctgttaaagcatactgtgggttgcacagggatttagagttacgtagcaaaagcaattatttcaccaacaactgaatgagtgaaataggctgcccatttcacagaggagagctaagttatctcagccataaatttaatttgaaggtcattttactatatatatattggcaaaacacatcaaaacacaaaacactggaaagcatgatttgtttcatgatactggatattattctttaaaagcacgatgctttagaaacatagaagtttgagggacattatgaatgttaatgttggtatagggtgggtcaacctgcccttcctttttcaatatccttgagcagccttattcgacatatcactgggatggaagccccatcagtgtgacccagtggggcaggccgtttgccttcaagataggttgagaaatctgcatttgccttgatgcttttctgtttcctatctaggtcatcctcgatttttcaaccagctctccactggattggatattattggcctagctggagaatggctgacatcaacggccaataccaacatgtaagtctcatatgttttcatataagcaaccctgatgtatgactatggcttgttgctttaaaagttcagtcccagtggttctattttattaaagtttccctggtcattttttctcttaaaatctttaggtttatcacagttctgatttaatggtaaatacttgataaactattgttgaatttaataatggaatttaaggaaagcatggtcatgagaaataataactctaacttccaaaatgtagtcttgaaatttcatgttaaaagacccatttctgttaatggtgtatctaaagaggttatgttttgaggtatgatcttggttttacctttttccacccaagcacattggtccttatcatttaggtcatgtttcttccataattaaagcagccataaacccacaaaccaatttgatcaacctattgcttaactaaaaattctaaaacaaaattcagccgatactgatacagtatatattcttttcaaaataagtgattgtttttctaaatgtgacattttttcatacttgtttgtgtaggcaaagccttcctttgtttctaagttcttgaaaatttacacaaaactgactctgaggtcctgtagggtatggggtagaagtactacctgggtagtcttatagcaatcatcccagattttcctctacatgcatgtgccctcttttaagaaaatgtcagattactaatcgatggaggggccatcagagtactgcctttgctctcaacactaatgacaatgttttaccagtatctatacatccagacaatggcactacatcctattaaagtatccaaaggaaaataacaaaacaaatatcttataataatttaaaaacaactatataagaattacatgggtgtccatcactgtggaaatattcagaaaatagccactcactttttaagttcatagaaaagtagattccaaaaaatgaatttaggtaaaagggtagtattgcttaaaatgagaaaatccatttgatatcaagatagaacgtaaattactgaagtttaaggtagtctgtttttcttaaactgctctcagccagaaaacctgaagggcatttaaaattatatagtgacccatatgtattctaaagctgtttaatgctgtgactcagaatacttaactatattcagaaaagtttctattaattaaggattcctgttttcttggctaatttaaaacaacagtgacaaattttaaagagcaaatgtgacaagtgaagcctctggtggtaaaaaagcataaaagattaaactgattgaaaaactaaaacgatgttcatgctccctgcttgcaggtcatggttagcttcacagactgtccatgttgggtcactgagatttggaagagccaagaggaatacaggtcaaagatacagttgcttggaatttgaacaaaaagctccatttagcaatctttactgtactgtgatttttgagataaaaatataccagccagcacagacatcatagtagagttaattataacttgagaaaagacactaatgtttaattgtagtatctagcactaaggaacaatttaaattaggaaatatagttgttgtttttaactcaaccatttggaaaataagtgaggaaaacagagtaaaagatacatatctattaaagtccaagtacccatattaatacaagcactgaatttactcagcacctttaagtgtgtgttctgcagggcactcagctgctttttccatgtatatatatgtctccaatctcaaggtaaataacggacctcccccctttcaaccacttatgaccagatattcctaaaccagaaaaatcccacaaattctccttttttggcatgtgttcataaaaccaaagtcccttactcttctcttagctcagctgcaaaacactaaaatgtgtcccagccatctgaggtcaaggccaatccaactaaatgacatgtagtaattgcagctgtacttgaatgggagatatttataaaatatgaccgattccaacagatcgatagagaaggttatttaaaatagcaaaatagtttctgtcagttctggagacaaggcattgtctgaagaagcaataactattatctagaaattgttctaagccagttgccctggaagatcatgaaatgtggcagcactgtcaggagctgaggcaaaatttgctcccttgtgacaattccttctccagtcgggaacagtgttcaaaataagtctgggaaagaatggcaaaaggatctttctatggcagtgcaggatttatttagtgataatgcctggtttttggtcctgtactctcattgaatttaggtggcacctgacatagaaaataagaactatattcctcagtcatagcctcttaaaaagaacgatccaataacctgacacaggtgcaaagtgcaaggtgtctgactattagaatagaaagatggtaggttgggtgtggtggctcacgcctgtaatcccagcactttgggaggccaaggtggatgggtcacctaaaatgggagttcgaggccagcctggccaacatggtgaaactccatgtctactaaaaacacaaaaatgagccgggtgtggtggcgggtgcctgtaatcccagctactcaggaggctgaggcaggagaatcacttgagcctgggaggtagaggttgcagtgagctgagactatgccaccgcactccagcccgggcgacagaacgagactccatctcaaaaaaaaaaaaaaaaatctatgtccatgcctttacacctgtttctgcacatagctgtgcagtatattcttcttctaagcaacgacccagtgaagatccaaacaaaagttcacaaatatgtagttatccaaggcacatacagctcttttcttccagaacagggccaccaagcacaattgcgcaggtagggcccgagtgtaaacaacagcctgccctcaaacatctaatggcaatacataatcttaatggcaagatctatcataaccctttgctatgaggttatgatttcaagtatctagcactttattttcatagaaaatatccaggagaaattctctatgggagttattcatcattttacaccaccgggcaggtcattagataggagcctgcagtaagcagttctcgtttgtcatggaaaagcagctgtgacatagacttggaattctgcttaaacacactaactcggagatcttaaaacaaaccactgaatttctctgaacctcagttttctcatcaggaaaatggaggataatagtatccatcctacagagtggttctgaagactaaaaatggctccagtcctaagtgcctagcgtatacaaggtacagtgtttgcacctaggaaaggcaaccaccgcacagtcactgttgctatttgagactttcctgactcttttatttctgtctctcatcatctggacagtagagtgtttccctaagctcccctcagctatgttaccttttaaggtgaagatgtactacctgccacatctgtaaggagaagtcaagaggagtatcaggatagagtcagcatggaagattatttctctcattaaagaagttcccagtttgacagtcaccagggatccagattttgtgtgcctttctaatccctattgtagcacatggctcccatcctcaaagttgcattatggtgcagcctggctgctggagctccagccatcactccggtgttccagaactcagaaaggaagggagggagggaggaagggaggaagggaggaaaggagggaggtagggaagggagggagggagggagggagggaagggcaaaagagacatactcctctttgattaaaaaaaaattaaaaaaaaaaccttctcagaggtctcacacatttccataaagcctctttagccagaacttagtccaagaccacaccaaaaaagggtagaaaatatagtcttcgatcagagtgaacagcaaccctaaataaaatttaacaaagcaagggaaaattgatatgggtagcaacaagcagactctgccacacaagaactacagcttgttgacagtcaatttgccttcgctctgagtgaactcctccgggaaggtgagttgaaccactgcaaaagggctgactcacttccctactcggaatatagacatgctcagaatgctcctctagtgtcactccatgaatgccaccatcctactgttttaaatctttacttccaatcccatgttcttatgcttcaacccagagcttctggcaggtttagtttctggttctgactctgaaatgtaatcttgtactttgactttagcatctaacctgcttcttctgaattcatatttgacctttgatctcttgacttcatttgctttcctcagtcatttaggaaaacagtacccaacctggaatctaggttgcaagagaagaatctcctatagttctatacaaaatgatgtgcctatcttcattttttacttggagagaaggactacagatttcctaggattcccaaagggatctgtaatcccaattaggtgaagaaccactgggcatggtggctcacaactgtaatctcagaactttgggaggcaaaggcgggaggatcgcttgaggccaagaattgaagaccatcctgggcaatatagtgagacctccatctctacacaaaataaaataaagttaaaaataagaaatttttaaaaactgctttggtgaactacaaggccttctttaagagtgcagctgcacagattgtaaacatggcccaggatggggcagcagggtcagaagaagtgtcaggaatgaagaacaccatgtcagcccatttgtcaggcctggctgtggatcagcagccatggactgatatactagctttcaggagagagtgtcaggcctaagctaataagtcaggaaaagagtggaaaattggtcctttagactcaggcagggactatcaaacaggatacagctaaggccaagaaccagatgctagaatcatcctagtaggtttcctcctcaaggttgagaatggtgtcttctaatatcttagtttccttagtacataggatgtcacctggcagagaatagccactcagtaagtatttgttgaatagaactgaaagaaagtttaggaatcaggtacctggcatagataaggaacctgaaatagattagatcagttaagctcatgataaactctctagactcttcctcctaatcctgagagtaatggccatgttcctggtccttggggaggctaattcatgcaaaccttgggcctaattggttttaaatctgaagcatggagtgggacctatgcctgatattcagtcccattccctctcccttgtccatgtggttcctgcctggccaacactgacttgatcctaagccaactttcatccagtctttgatatggttctgatattacggtatgtgatttcatttgttccttgccttaccccagagagctttcttatatagtactgggagattctagcacagacactgccaccagtatctcctcgccatgcaaacatttttgtcatgtcaacatttccaaaaaccagtggaaccattaataacacatttgttcaagaatggttaaaagcccatcatgagtttgcctcttggtacacttggcagcacaggctaaaccaggaatccttctcttcttcttcctttatcaggccatcagacatgagggagtgttggttgctacggtgatggggctcagagcagaaccaaagcatgattgtgacctccagaggtgatggtaactgcacacatggtttccaagggtcttcctcctaaatttccaggggcctcccaaggaaaatggacatattctttttggaaataaaatacttctaccaacatatctgaggatccttcaggatctttttgtcttcttttacctccatgtgattaatttgactgcttttttcatccacaattaaaacttagtagcttcacctgtgtcttatgtaaaacaatagttatctcatccttacaaatagctttgccttacattaagcaagcaagaattcccattagtcttcaacattagcacttggctcaaacaccctaaccagtgataaagcttccccatgtcacttagctgagtcagtctaggcatctcttttcggtgaggatgatctgagcccagcctacagactctaatgctaaagaatgccaagcaaaaacaagaaagacaaaaagcctcagagcttagtaaatatctttttgttttctggcttaattttctgtggacagaccttccttgatttttcttaggccccacgtttggtctcacgatcttgtttcaatgactagtctaccagactatgcctctgtgttgaattgctttgaaaagagcatggcttgctacttttaaatcagtttcttagaagacaaatgtaaccttccaagatatctgatgcccacagctagttgtttatgccagttgaccgtcttcttgttatttataatttgtaattagaaaatcatcacttagaattattcttgacagatattgacttcagagaattatagaaacatagctgtccttgaggattattacagaaaaaccatgtagataattatattgagatctttaaaacctgggtcaatatttccaattatcttcacagttagccttcagatgtttacattatttttaaaagatagactttggctctggcttttatatattctacaagtgtgaaactggcagtcagcttttttttttttttttttaaacaaattgtaaaccaattttacatagaacttggaatgcttttttcaattaacatttgcattgtcctataatcttagaggtaaaagggactcagaaaagtcattttctttccttctattcctctgggtggaccatgcctaagacattccattcagataagaatctattttgttggtgaagtatcacagggctggcacttccaccacctctctcagtaacccaggctggtttctgacattttatgatcggcgacttaatgcatttccaggaaatgaatcatgttagtggtttggaacagcttttttttagaacccaactacaaatactaaaccaatcctctgtgttcctaaaataagtggtttgacttctttattttctttcatccttcttcttaccacctttccaggtttacatatgaaattgcaccagtgtttgtcctcatggaacaaataacacttaagaagatgagagagatagttggatggtcaagtaaagatggtgatgggatattttctcctggtaggtttctcttctcttcctcttctcaaggtttgggattcttaagaatacaaaatatgaagtaggtttatggaagaataatgccttaacattttttttggataccctgacttcctattttttcaagatgaaggctaacaaaaatgctacattctatatgaattaactaacaaaggctatgcttaaatctgtaaaaactgacaaaggctgtgtctagataatgctaaataaccccattttttcttttttctttttttttttttttttttgagacagggtctcactctgtcatccaggctagagtgcagtggtgtgatcctagctcactgcagcctcgaactcctgggctcaagcaatcctcctgcttcagcttctcaagtagctgggactataggcatgtgccaccatgcccagccgttttaaaatttcttttgtagaaacaaggtctcactattaaacaactccattctgtcaacagcagtttgattatgctggggatcagtgaatcaagattattaattaattgattgatttcagccaaaatagtatatctactttgaatctctagtttgaagtagataaaataagaatttttaaaacaagaataggtattctgatggtgtcagagacagtgtgattgtgtacaaggggaaaagaagaaataagaattgcagttatctaggtaattcaagcagaccacaaatttgcctaagtttaattgtcagataattaatgtaaaattaactagtttgtgttggccaaacatacatagttatgtcagttctccttgtgtctttatttaggtaaacatgagtttgttcttattttaataaacttagagctctcctaaatgactcagtaactcagttgggctgaagagagcacctaggcaggtaaccaagaaatgtcattgtttctttctgtaagctccgttactctttctttctctgtctttctgaactcagggaacagattcatctttgttcagtaaatagattgagcagaaagtaaagcaggaaggatataactcacctatccctttgcagccactgatgcagctacctcttatatttctgtctagacttcaggtggaaagcgcactgaagtacacgaatcacctccagccaaattgcctagatagctttggtaataagtgtgactacttgtattcccagggtaaagggtccagtgggaagccccagcaatagggaagccagcaaaacctatcaggatattatcctttcgcttcctgacctcccttgtctcttgagacaccagctcagcgttcgtttttagaaacaataatcaaagagccccaacacctcccaatatgtccgcttgctgacagggggcgccatatccaacatgtacagcatcatggctgctcgctacaagtacttcccggaagttaagacaaagggcatggcggctgtgcctaaactggtcctcttcacctcagaacaggtgagtcggggatgctttctcatggatagtggtgttttttaggggactttccaacttctaacctcgagcctctgtttgttgcagagtcactattccataaagaaagctggggctgcacttggctttggaactgacaatgtgattttgataaagtgcaatgaaaggtaggcaggggagggtgaatattaggttcttgatgtattaaatgtgttcatctgttaaatttgttttattgtgcttaaggactggctcagtacattgtgccaagctgctaatggtctgttgaaaatatccgattaaattgctttttgctgctgctaaagtttttttcatgtgcaatctcattgactcttcattttaatttccctccttttccaataattatagggggaaaataattccagctgattttgaggcaaaaattcttgaagccaaacagaaggtatgtactccgtggtgcatctgaactccagttttaaaataccttctttctgtcctagacaaaaacagtccttgataatatgagacaattttcttgtgcttctaaaattctattcttcaaatttgcttatttccaactagtaaaataatttggttttaaagctgtgtctacacaatatcagggtttttttaaaaaatgaaaaatttggtcattaaactatttgtcctatcttcattgtgccaagtgattggtttgatgttcttcaataaatcaaatccctgagcatcatgaagatatagcctaattgaactttttatttactacttgttgggtattatctcattttaacagatgccattttagcttaggattctgtttagcaaagtgcttccatgccctggcagatggcccatggtacttggcacatccagcctcaacaaactctattaaacaaaaaaactcacagaacagatgtatccacaagtcagtgccaggtagctgtcaggccacttaccaacacatggttgtttcagttacattcttatacctccttctctaattgtagttatttgctggggtcttggcacaggaagtggatctaagtgttgtaaagactgagcaaggagcagaggtggagctgagcttcacaaaagcctaagaggcagggcatgggggctcgcacctgtaatcccagcactttgggaggctgaggcaggaggatcccttgagcccaggaattcaagaccagcctgggcaacatagggtaacccacatctctgtaaaaaattttaaaaaatagccaggtgtggtggtgcacgcctatagtcccagccactcaggtgaggtaggaggattacttgagttggagaggtagaggctgaagtgagccatgatcgtgccaatgcactccagcctaggtgacagagcaagaacctgtctcagaaaaaaagaaaagcttaagattcacagatttccccaaacttgtcttagatctattactctactccttcgtttattttttgtttatgtcaacatttaaccacgtccactgttagtgagtgtatcagctttcacagtgtatagaccttttttaaataattgaaccccacaatgtttcagtataattattatatcaatacacttaaaacaacacagcctcttaaaagaatgatgcacaggtgatattcagaactatctgaccatcattccaaacacttattattactctttcctgctttattttttgccatagaaattattgctattaaacatactgtatattttgcttatttaatttagcttattatctgtcacctgccactaaaatgtaaactccgcaatgacagaattctttatctgttgtgctcactgctgagtccctagcatctatggcagggcctggcacataaaaggcaatcaaaaaatgtttgttgaataaatgaatgaatgagtgaatgagccaacaaaacactactagacatagtatctggtaatacataagttttgccatttactgttagaaataaatgttacacaattcttcttcctgtgaaaatcagcaaatgagaaaggttaaaaatactcatcagcctatatctgtcttaccttgtagggatatgttcccttttatgtcaatgcaactgctggcacgactgtttatggagcttttgatccgatacaagagattgcagatatatgtgagaaatataacctttggttgcatgtcgatgtaagtgctatataactcaggccagtccatgtggggggtggaggcacctcttttttatgacttgcctcaagcttctccccacgccccagccagccctctctccacaccacattagttccagttcttgtctggaccctagccagccattcacaactggtacacaccacagacctggaacatcctctgggactcatccacttccttactagtcgattgctgtcttctgtggttcatcctagaatatggtctcattgccttcccaggtagctttgttgggacaagtggctacagaataaaatataactgatttcagagggaaaaaatagaagacacaacatacagaaagtggccatgaatgtgaaccctcagctacctgccttcagtccagccgtctatgacacgtctcttaaaaaggttatatctggctgggcgcggtggctcacgcttgtaatgccagcactttgggcggccaaggcaggtggatcacctgaggtcaggagtttgagaccagccttgccaacatggtgaaaccccgtctctactaaaaatacaaaaattagctgggtgtggtggcatgtgcctataatcccagctactctggaggctgagacaggagaatcacttgaacctagggatggaggttgcagtgagctgggatcacgccacatcactccagcctgggcaaaagagcaaaactctgtctcaaaaaaaaaaaaaaaagaaaaaagaaaaagaatatctgctacatttaggaaaaataaggcagtatacggaaggcattatcaactaagagacttaatcccaaatcttcccaggaacacaaaagatgcattttcacatgtgtgactgggtgtatttttttttttctttctctctgcccattttcttagggatttaacttctcacaattggccaataggatcatctgccttgctactgaactaatgactaacaaaggctgtgtcacgtggcatcccaactattcagtaaacatgcatcatggtacccacaaaaatgtcttgttgttacataagttgttgtgagacctccaaacccagcaggaactgctgctttttgagtttttcaggagctgttagaattctactctgggaagaaccagacagcaggcctcagttttttgagcagcttccagagccacccggagggggactcactgtgttggctttccacaacacattgggctaatgggccattggacctttgggtcttggcagaacaggcacctcaggctcagacctggcctagctgtatcacttgtgcagctaaagtccagaggaactttgaaaaagaaatgacaagcaatgaagaatcacaactgattgaacaatcagtgtgggctgaacttttctgagaaacttatgtttttcaccttgtactttcttgctcatgttttagtagaagtgaggactgactagttttagattcttaaatgtcactgctcccctcttcctctcctttctctgtccccacaggctgcctggggaggtgggctgctcatgtccaggaagcaccgccataaactcaacggcatagaaaggtaacggccagaactcgccaggcctccttccacccagcacatcaaacagaccatgctctgatgtcagcctgcaccaccctgccctgatccccagcatcatatttcggtctaagtttgcttcagttcagcaggcatttgttgagcatttattggatgactgatttcccagtcaaatgagtcctgaaggagttcacaatttagaaagaaagaaagacaggccaggtgtggtggctcacgcctctaatcccaaaaatttaggaggccgaggtgagaggatcatttgagcccaagagttcgagaccagcctgggcaacacagtgagaccctgtctctaatagctatcaatcaatcaatcaatcaatgagaaagacaataaacaagtagttagaacacaatgtgataagtgtaacaggagacaattgcaggtacccaggtaggagataagagagactaaccagtgaggggaattggaggccatcagagtttgccaagggcacaggaagggccactggttcactttcctcttcttcctcattaagcttacttccagaaagggcaggacactcagctcctaacttattttctttttcactgttcaaattcagtggatgttctaggccaaatatgattttgacctgactcctaagtgttgacccataacaaagtcacaatgattcattgattcgttcagcatgtatttactgagcacctatcatgagccaggtaggagttgatgtgaatattcagttatgtgtcttccatccagccacctatggtgcttttctaataaaaatgcatatctgataaatgcagaaaaaataaggcagtatatgaaaggtgttatcaactaagagatttgtcctcctgaagtttacattccagtgggctagatgttcataacaaatatttaatctgtctcatagtaaagaaaaataaaacagggttaggtagcagtgagtgacaaggcatgctgtttcagacagggtagtcagaggccttcctgaggaggtaacatatcagcagatactgcgataaagggagacaggaagcaaggatatgaggaacagtattctaggcagtgcgagtggcaagtgcaaaggccctgaggcaggactgttcttggcaagtgggaggaggatcaaagaggccattggggctggagcaaggtgagagaggtagaagcagactaaggagggagaggcaaacatggagcaggcagggagagcccgcccagggcttctcccacagccaggactctggcttttgttacctctactgtgcctccccaaacttttgtctcagttttgaaagaccagtgtcaacgtgggtgagaccggctctgtgaagtggacaaccccgtaactcggaggataatgtaaaaaatctgggcagggtgtagtggcctgtaatcccagcactttggtaggccaaggagagcagattacttgagctcaggagttcgggaccagcctggccaacatggtgaaacccccgtctctactaaaaatacaaatattagctggcatggtggtgcacacctgtaattctagctacgcaggaggctgaggctggagaatcactagaacctgggaggcagaggtttcagtgaaccgagatcacgccgctgcactcccgcctgagtgacagagcaagactctgtcttaaaaaaaaaagaaaaaaaaaagaactgtggatgagccagcccaatttaactttagatttctcagacaattttaattttctgtctttgagtctaggaaaacttaaaacatttcacactagactttttcttttctaacattttaaatcacataagtcttctaaaggaaattgaattcatattatgtcttattactttccttttgtagcagcaaagaatcatttacttcagacctttaggatatgcagaaaaccatttaagacattttatgagacctaaatataattttttaatgacttggtaaatgatagcaatgagaaatttgattaaattcactaccatttaaatatgacctgacactgatgctttttagtgagctaagcacttagttaactttccttggaatttttcacaggtctctttcacaaaggttttattatacactgaagggaaaagttcttcagaccttcctctcttctccttgaaacagagtgcactaaattattttgttaggtcctttaactaaaggacctaagcacgatgaagaggttgaaagttcacaacaagggtttagctctagggagagcagaggcaggatgattctgagccaattgctctatctaggggaaaagatccttcacaggtattaaaatgcagcacctagctataggccaggcctttgggaaggagtctgcaaaccaatgaggcaagttacccatgttttcatcatcatacattagacttagttgtttctgtaatgccctagctagtgtgctccttaaccatctaattgtgtctgacagaatgatgcagttgctaggagaccatgcttgttaagctatcattgcagcccaaactggcaaaatcactctaatttagcatttaaataattctgctaggtagtcagagtctagagtagtccagtcgagccttgcttttaggtgccactcttgatactgccccataagtgggtagggcagcatcaccagcctataaatgagaagagaaaggcagaaagaagccactgtgtctcctagagagaagcagtctagtggagtggttacaaaaaagggctgtgcacttagaggccctggacttgaatccaggctccaacacttcccaactctgtgactttgggtaatatatttaaccttttggcatgttagtttccccatctaaaacagaggtaataatagtacctaccttatagggttgtggtaaggattatgtgtgccaggcactcttataagcattttatattaagttattttgtcctttattcaattctgtgaggcacacactccccatttaaaagaaactgaggcacataagagttatataatgtgcccaagctaacaaatattagagctaggactcagacttaaacagtttggctccaaagcctgaattcttaaccataccatattgatataatacctgaaagctctcaagacaataagacatataataagttattcataaatgttagctattgttaatagcagttacttctaagatatagtccgtaatgtaatactccgagactgcctgcaaaacatttgtttgctacttgattagtcaattcaggagaataggcatggataatatttactaacttgagttggaatgggtgttttcctcaagagaacagttgcgtctttccaactcctgcaccttctcgaagtctcatgtgcttctttcagggccaactcagtcacctggaaccctcacaagatgatgggcgtgctgttgcagtgctctgccattctcgtcaaggaaaaggtctgtactccctccaaagctacactggggcccgtacgttctttagaaagcacaaaaagacacacgtggggtctctttgcagtacttgttggctgactcacgagattggcagccccactgagagactactgctgctgtcctttcctgcccttgcagctaacctggtttcttctcttggctcttgctggctactgtgcttcttctttgatcagtactcagggtctgtcagcaactgaacctttaaggaaattatttaattgagtattccttcatgtttgcacaaaaaaagtgggagcaagtaggtgaggcatccaatcagttttgtcctcagtgaggacaaaagcactcactggagcatactcggagttcttagtataaacgtgtggtcccaagaactgaaataaatgagacagaacaacaactacaaatatcaacttagggccacaaggaatattgccccaaaagctgctgtaaatggttgagcctcatattcccttcttcacatgcctaatgttaggatcctgccctccaaggctttgttgctccagtaaaacttctgcacacagaagcattccaaaaagtctgtctccagcctgtaggagccagaatctgcacagcgtctttagtccactcatatgtggaatccatgttaatgtcataggaggtcctggaaaggttggaagacttttgccagagcgcttttggagagaaaaattcttcacagcatgaaactatcccacccactgaggaattttctatctctaaccctggcccactgaatgccgtagcacttcccaatcttgaaacaatcccagacacccatacacatttccccttagagggatggcatctgagacggaaagatcatcttctaatcagagagtcagagacaaaagggatggcagtttttccaagagtgattttagaaaagggcatcagaacaagtgtaaggcctcataaagacatcagaagaaagattgcatatgaccccaagcccctccttccaagcagcctagttttaaagccacccacatctctgatgtgtaaatgcagatgcacccatcttaatttccatgatagggtatactccaaggatgcaaccagatgtgtgcaggatacctcttccagccagacaagcagtatgatgtctcctacgacaccggggacaaggcaattcagtgtggccgccacgtggatatcttcaagttctggctgatgtggaaagcaaaggtatgaagggaatagttcaggaaatagagcagaaatgtaatttgcacagactggctggcaaaagaggggcaaagatatatcacagataattcactatatggggaatcaatatctagataattgaattaactgtgttttctttgtgaatgaaattactttattccttatgtcaaattctctctccttttgttcagtctcctcaatttgaactattatgaagtcttcttataacgttctcttataacaactaaaaattatgccaagataaggatttctgcagcaatccttggggatgctggaattatttagtgcaggcatagagaaagataaaaaaaaataaaattactgcattattctgagtagaaccttgaattctttttttttttttttttttttgagatggagtctcactctgtagcccaggctggagtgcagtggcgcgatctcggctcactgcaagctccgcctcccaggttcacgccattctcctgcctcagcctccagagtagctgggactacaggggcccgccactacgcccggctaattttttaaaaaatatttttggtagagacggggtttcaccgcgttagccaggatggtctcagtctcctgacctcatgatccgcccacctcggcctcccaaagtgttgggattacaggcgtgagccaccgcgcccggccccttgaattcttttatgaggcttctcaacatgggctatgtatgacagttttaacttcaacttcaataatgcctttcccattgtttgtagttaatacaccattctggaaaatgtatactttattgtgaaaaatcctacttttagatggtagcatgctgtgtctgcattcatcaaccttttgggtttcatttctgtacctaaggaaaaaagctaactattggaatttcccccaaaatatgagtgagggagaggattaccatttgattatttgtttcaaaaatatttgtatgcaatcaaggaaaagaaattttgatttcatagttttatattacataccttgtttttgttataaattaattttaataatttctatgtttaagattgagtctaactgtctaactaacactcaaacaacaagattttctggcaaaatttctagtcaaatatttcttctgtaggaaaaatttggtagattattagttttttcctcagtaagtcattttgtcttttttttttttttttttgagacagtttcattcctgttgcccaggctggagttcagaggcgcgatctctgctccctgcaacctccgtctcccagattcaagcagttctcctgcctcagccttccaagtagctgagattacaggcatgcgccaccatgcccatctaattttatatttttactagaggcggggcttcaccatgttggccaggctagacttgaactcctgaccccaagtgatccacccaccttggcctcccaaagtgctgggattacaggcgtgagccaccgcacccagctctattttgacttaatatagaaatagtctgaatttgatttctattacaaagtaatcataggaattttaaacatataaatagccataggctgggcacggtggctcacgcatgtaatcccagcactttaggaggccaaggcaggcggatcatttgagctcaggagttcgagacccatctgggcaacaaagtaagaccccatctctacaaaaaatacaagttagtcaggtgtgatgacgcatgcctgtggtcccagctacttaggaggctgaggtgggaggatcacttgagcccaggaggcggaggttgcagtaagccgagatcatgccactgcactccagcctgggcaacagagtgagactccatctcaaaaaaaaaaaaaaaaaaaaaaagccataaacggcaacaacaaaaaaggagtcgtgtcattttgaaatataatgaccacacaacctgtttcagtaatttgtgtcttcttttttgtttctaacaataacctcttgaaccatctgctgcaggttttgaccatagtgattggttgctgaaatgggaccctggtacaggcttcattcctaagtggactgactagggtgtacagtcagcagtgacactacctggggaggctgatgctttctcagtgctggactttgctcaggcccattagcaatccacagccagccttgtgcatctgctctccttgttaacaccgacccactcaacaaccctcatactgctgttattaatcagccatgctggcttttgaaactcatgctcaaccagtttgtcaatagttggaactattgcaatatcagggcatatactgagaccaatggcttccccatctacctgcctgcctgtcacctaaaaggcataacactgttatgtggaaggttgcctgcctgagagggcatgggacatgtttcacaaggacttactgctggggaagatgagttctacagcagtatctttcgaagtttttctgatgaagaaccagttatttgttgttgttgttgttgtttttcacctatcatggaccaataccctaaagattaattgttagaaaaatgaaatttaaaaacatacaaagaacaagccactgttttttattagagtcaacagacaaaatccctttgtccaattgccattaaagtttcctatgcttaatctcaatttctacactcatttgattgtagaccagttacagttgtggagtggcctcagttcatagatgacactttgagtagcaccatcctaaagcaaaccagaatcaggcataggtccagttgagaataactacccagagactggagtgcctttgaaagaggaagcaggcacacatcatttattgcatgcacatctgtgaaaaagctgacatatttgattagattgttcttcctaaccagctccaaaaatactttttttgtttatttcccatagacagggacagcatagccttcccaaatgctcatcacagggaaatgcaaccacaaacatgacttttctctttaaaacagggcacagtgggatttgaaaaccagatcaacaaatgcctggaactggctgaatacctctatgccaagattaaaaacagagaagaatttgagatggttttcaatggcgaggtaggtaatcatcatggaccaggtacacagtatttccagaaaaactgctgagggaagctcctgaagcttctggcaacatgggaaaatcaatcccatgttgccagaaactgcttcaaaatttttattcttatacactcttaattcctctctttaattccttccatgtctatgaacttttcttctggtagcactgggatgactttttcctttacatcttttaaaactgtgttgctcttggccagcttttggcagacaagaggtctttccttgacaggtctgaatccttcatcattcttgggtttgttttgtgttgaacctttatgaaaaagtgtttttcaggctgggcatggtggctcacacctgtaatcccagcatttcgggaggccaaggcaggaagattgcttgagtccaggagctcaagaccagcctgggcaacatagcaagaccctgtctctataagaaaaaatatatataatttatgaaaagaaattttacaaaacgataaagtggttttcatttccaggaagcttataggatgggtatattcttacctcccaagacttgttctaaaataaggttctacttaacatagactcataaggaagagagcaagataaaattgtctctgccctcagttcatgtgcatactgcacacagcaaagtatttgtcagtgtttactgagtacccactgtgtgccaggcctcctgctaggacctagattctagagtattgaacaaaacagatacattctctgacccaatggagcttacacttgaataaagaaagatagaataggagccagtgttgaataaaagaaaatccacttataagccagtataatataacactgcttacagtcaacattattctatttatcaggcaacctaaactactaggaacacatgtgaatcaccaaatgaacaaaaaagagccctgggcagtttaaaatcagtgacactgctctgatcatttacacactactttaaacactcttaatagcagattaaaaacaacaaatgtgatatctcaaaccaattagaggcaggcacagtaatggcaaacagcaaccagcgagaaaactttatagcaagaatagggaagaactcaaaaagcacaggaatctttagaggagggacactaaacagtttgaggcatctcaacaggccttgccttatgctgtagaaacagtcttttggttttttttaggagcaaccctattaattgatatatccagtcttaatgtttgttatgatagtcctgagtcatcaagaaaagattcaatatcaatataataaactcaataaaatattcatcagcatccataaactatgtttcaattatcttctatatgtgaggcactacaaaatgacaacatggacagacggataccttttttaaaaaattgcccaaatgtaattatttgtaacatttcaatgtttaaagtcggtaactttagttacctagaaaattggttgtagggaacagctctcttgccacatatgattggataaatgaggcattgttctccctggtgtggaagtaacattgcctttgagatgaacattcaacctctttctttggtccaagagacttccaccaaggatgcatattggtttgggaacagctttctctcaagttatcctaattttctttgtttgtcttttaaaatctctgcagcctgagcacacaaacgtctgtttttggtatattccacaaagcctcaggggtgtgccagacagccctcaacgacgggaaaagctacacaaggtatggacttgctttttgtctcatctaatcctctgcaatttctctggctggtcaggacatcctcattccaatgtgcctttctagtgggggaaatataaaaaataaagccttggggtgggtttctagtaatggggtggtggggagccatcctgttatattcctcttgagcctgcatcgcccccttactgtggttaccacgggaacttctaaaggatgcatcttgtctccttgtccttggttgatgttcttcattaaaggagccctatgcagggtaagggaataatgtgcatattcctagggacattctagattaaactgtgtctgttacaataacattttaagttcaggcccactgtaatgctgattcattctaactgttttctatatccagtttatatcttatccagggttcttaagattatatttaatttatataacatttcattcatccaaccattcaacaaatatttgttaaacacagtctgtgtgccaggcagtatcctgggctctgggttatacaaaaccctgaatttgtggtgttgtctataagagttttttggttttgtcttcattttttattttactatcattgttccatgactgactttcaaaattcggttgcacagtactttctgagggaacttgtgaccaggtagtcatttgatattagcccctgaagattcctggatatgaaatatttctttgcttttatgtcaatgtaaacacaaatagtaaaatgcaagttgggttgaattgttaaaaagagagggtgttcatatcaatcttgagttttgttttgtgttttccatcacaaggtggctccaaaaatcaaagccctgatgatggagtcaggtacgaccatggttggctaccagccccaaggggacaaggccaacttcttccggatggtcatctccaacccagccgctacccagtctgacattgacttcctcattgaggagatagaaagactgggccaggatctgtaatcatccttcgcagaacatgagtttatgggaatgccttttccctctggcactccagaacaaacctctatatgttgctgaaacacacaggccatttcattgagggaaaacataatatcttgaagaatattgttaaaaccttacttaaagcttgtttgttctagttagcaggaaatagtgttctttttaaaaagttgcacattaggaacagagtatatatgtacagttatacatacctctctctatatatacatgtatagtgagtgtggcttagtaatagatcacggcatgtttcccgctccaagagaattcactttaccttcagcagttaccgaggagctaaacatgctgccaaccagcttgtccaacaactccaggaaaactgtttttcaaaacgccatgtcctaggggccaagggaaatgctgttggtgagaatcgacctcactgtcagcgtttctccacctgaagtgatgatggatgagaaaaaacaccaccaaatgacaagtcacaccctccccattagtatcctgttaggggaaaatagtagcagagtcattgttacaggtgtactatggctgtatttttagagattaatttgtgtagattgtgtaaattcctgttgtctgaccttggtggtgggagggggagactatgtgtcatgatttcaatgattgtttaattgtaggtcaatgaaatatttgcttatttatattcagagatgtaccatgttaaagaggcgtcttgtattttcttcccatttgtaatgtatcttatttatatatgaagtaagttctgaaaactgtttatggtattttcgtgcatttgtgagccaaagagaaaagattaaaattagtgagatttgtatttatattagagtgcccttaaaataatgatttaagcattttactgtctgtaagagaattctaagattgtacataaagtcatatatatggaaatcctgttacttaaatagcatctgctcttctcttacgctctctgtctggctgtacgtctggtgttctcaatgcttttctagcaactgttggataataactagatctcctgtaattttgtagtagttgatgaccaatctctgtgactcgcttagctgaaacctaaggcaacatttccgaagaccttctgaagatctcagataaagtgaccaggctcacaactgtttttgaagaagggaaattcacactgtgcgttttagagtatgcaagaagaatataaataaataaaaatattctccatggagaatttgaacaaaattttcttctagtttgtgtttcatacagagatgtttctaattagagttccttgggttgcccatagcccatttgctttctattggctgactttaggtgatgctcagtaccctgattaagctgaaggagactcgatccactgtcacaggctctgaagctcctcatctataaaatcattatgggctgggcatggtggtgcatgcctgtaatcctagcactttgggaggctgaggcaggcagatcacttgagctcaggagttcgagacccatctgtgcaacagggcgaaaccctgtctctgcaagaaatgtaaaaattagccagctgtggtgatgcgcacctgtggtcccaactatttgggaacctgaggtgcaaggatcacctgagcccaggagatcaaggctgcagtgagctgaaatcgtgccactgcactccagcctgggtgacagagtgagaccctgtctcaatcaatcaataaaatcattatgattataattaattaaatgtgcagttcaagccttgagaaagaaaagccatccctgtttctccttttcctacttgcatcttggagttacattcattcagtcattcaacaaaagataagtattccttctagtgggcatcttacatcacttggtatctctgctaactgagtgcctctaagatcacagaagcataacttcctgctgctttatgcttgtagagtggtccccattcacttcctagggaaatatatgttggtgctggatcattaggatatgggactgattttctacaatattctttgtgtgtgtgtgtgtgtgtgtgtatgtgtgtgtgtgtgtgtgagagagagagagagagagagaaagagtctcaactctgtcaccaggctggagtgcagtggcgccatctcagctcactgcaacctctgtctccccggttcaagcgattctcctgcctcagtcttctgagtagctgggattacaggcgtgcaccaccacacccagctagtttttgtattttagtagagccacggtttccccatgttggccaggatggtctcaatctcttgacctcgagatctgcccacctcggcctcccaaagtgctgggattacaggcgtgagccactgcgcccagcccattttctacaatattttattcagctatattaatacaatctcactcatttggaatacaagaagctccctatttagcacaggtagggaatacagaagagtcctttgtaattagcacactgattgcatgtaaccattgtattaaacgactctatagggagtgatcataaagccacttattctttctctcactgtttctataaaacgcccctgggggctgattttttccatgcccccatttgaatttaggccaatcccatagcttttctgtcctctcgggtgcatgaacagtctcatttttgcaactgagggtccaggttgatgtaataagcaaagtttcaatttttatatgatatagagtttctcccccctccccccgatctggcactgcttcagctgcaagcctacagtggcagggagagcaaggctgacggtgggtgaggtcaccttttttcttcatctttcagctcatctccctagctcctgtgcttcctcattcagggtcaggcctagcgggaggaagggataacgtgacaaaggtaaaattttacatggctattaaattgtcattgggcatcaagttccctggaacatgagtttttgttttttggggggttttttttttttttttttttgagaaattttctggagtgaatgaggatttttggaattaaggtaaaatttagatacaatgaaactttttgtagtgtactgtgtatagttttctgtggattttgacaaacccattcagtcatgtattaataactatcatcatgatcaaggtctacaacaggtctgtcaccccaacgaatttcccatccccctttgtactgaacacctctcctactcagcccttggcaacctctgctttgt

SEQ ID NO: 11868 - DNA, 300598 bp, Human
  misc_feature (1)...(300598): n = A,T,C or G
aaaaggggtaattctgaggctctcagaggtcatttctgttatggcacctggaatgtgcctaccatctagtcccccactttcaactcaggttaaaattaactgttaaaaagaaagcagaatggtggttgccaggggataagggaagagggaaatggggagttattatttagtgggtacagagtttcagttttacaagatgaaaagagttacggagatggtggtgatggctgcacaactttatgaatgtatttaataccactgaactgtatacgtaaaattgttaagatggtaaattttatgttaaatatattttaccatgataagaaataaatttaaaaagttaactgctatgcctgcaccaaaacatctcacgtactttataaatatatatacctactatgtacccacaaaaattagaaattaaaaaaattaactgttaatattaaactatgatgagtcacaagcagcataataatgaaaactatcctgttatgggcactatttgttttatatgcattatattattttactttcatgacagtcctttggcatgggttctattcttggcattttgcaggtgagaaagctgagcctttgaaaaattaaacaatttgaccaaaaccacacagataataaatctacccccaaagtgagtgagcttattttcttgaaataatcaatgaaggcaaagatttgtgtcttcttactcactgtcatattcccaccaccgagaacaataattggcatagagcaagtgcttggtaaatatttggtggagttggagtccaatcaaagcagtcttcttctagagtctacttagccactggatgaaatgcctccaaggtctctatccctcagcctccatctatttaggttcttatctcttatctgggaaccacagtgtgctcctaactacttgtcttcactaccattcccaggcttcccaaggtttgcaactcttcctgacataacacttaagcctagggataccccttactgaacagccttccgaatgccacaggccctgcttagtcatcattagtgcatttcagatattccatgttcacatcctagctctgacatatgctagctatgttgaacaagttgggttacttctctgaacctcagtttccttatctgtaaaatggaaaaaaatcacttaccctctctgagcctcagtttcttgtttatctcccaggtctcttctagctctcaagccttcatgactaacacactggtaccacagatctattgctgccccacccctaatgacttacagccccttgtcaaagttctgcaaataggtctggtgccatgagaatttgctaggcttttagttactaagatctgcctgcagttaccaaatatgcagaattcaatgatttcttacctcttttgaagaggtatacatagtatttctgcctttattcctacctaagacattttatgcttaagatctagaaatgaaagaatgagcaagatgtcttctgcctgggaatttgatgatcagaggttgaagccatgaatagtaagtatttgaggagaagtattagctatataaagctgttagcttgttgataggacctagaaggactcctatgtataattcctaaaaacttacctttttttcatgttttccttttctgaaaggaaatgctacagtaaaattaagaaaataatggtccctgttttatggcctcaaaacattgttccttccatttgcatgggtaacaccatggagtcctagaaaaataatattaaccttgtagaagaaaatgaagcctgttgccttaggcttgcctggagctattcccttctgtggcctctccttcttatgaactatgaccttcccagatgctaccacctggttgacagggatctgccccagtagtggaaggctaactgacccccttacaaactggccctatgactctggcttaagcaggccacagaatttccagccacttccatcattatctatgaatccatcccttccacacacagcaacagagccatccccatgacaaacacccttttggtccttatgccactctctaaagcttctaccctgaaaagatttgtactttctctcttggaatccatttcacaaatgtttatgactctggaatactgatggtattattataagtagagtggcaaagtgatatgtagaggcaataactatcttcaggatgggccagttcagagtgagcttcttagaggaaattacattccaagcaggcagtaagcaatgccatcctggctccctgaaattgactgggtggcaatccaactacaacatgtatctgatcattttataccttgtggcaacatattgagatcagaccacttcaggggagtggaatattccacctcagcggttggcccactcttaatgggtccttaacacatatataaggagatataataaaataataactctgttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaagcaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaactgtaattattattattcctataataatagggttcccacagatcttcgtatttttacatgttttatactcattatggctaatccacaaaacatctctttagggtatgcaaatacttttattgccagtatgctagagaggagatagagctaaaaaaaaaggtgaaatgaaggtcacagattatcagcagtgacttacgaaatagaactagagaattcctcatctcagaacaaatttatgtcatcagctcgctaaatgcttacagtatgagccaaattatactgagtctgacacaaaagtaacagaacacctgtttcctgggccttcaaaagcttctcagtcattgatgaagttcacatttacacacatgaggcaagcaggccacaactcagtccaggcaagctatgatcaaatgccaaaatgggggcttcaggccaagtgctgctggcagtcacagtaataatagatttcttgggggatgaggcaggcaccaaatgctccacagagcagggagtatcagccaggttttgaaaggcaggcaagaattggaatggcagagatttagagaatggcattccaggatggggacacagcatgagaaaatgctcagtagcaggaatgaataagaagtatctgaggcatagaaagaccactagtctagggcagaaaattcctacaggagacctgtggaagacaattttagttagatcctaagtcctaaatatagagagccatggggtagaaaacaaatacctactgtttgttgaacacctattatgtacagattctgtgcttcatgttttcttaatgtaaattccagactgaagagtttggactatatctgaaaggcaatggagagcttagggcccagtcactgcgttccaatatctaaaataagacagagtgtgctcagttacctcactcacatgtccttggccaacctctgaggacttacttgagtgttttataactgagtatacagcttctctcaggcaataccattgttacctgaaaatacaaagcctttaattttgcgtgacatcacacaaagagaattacagagcccgaatcctctttctcttggagcaaatggaccactctgatgtggtcagatgtattcatcagtagcacataaaagttacaagttaatacatgactgagcagcaaagtgctagaggggctacttattccgtctgcagatgaaactacattctaagagttgcatgtgtttacttaattgtagctatttctagctatttttagtcagattccaccccatggagcaagttaggtactttgggagacacagttttactttcaagccactgaaggagcatctgcaaggtccatgcaaaaggactcagctgttccgtgttgctgcaaaaggctaaagtaggaattaatttgaatgatgttctgcaccagtggtttctcttcccaccttgcaaatggattgagttctaaaagatgtgtaatctggctggcctacaggtggccttaaataccagagctgcttgttaaagcacataagacccagggtacaactgaacggttttacagcactgaacctaactctattgcatgctcatgtttctgtgggaagatgcgttcaccttcccaactcaaaagtttagtaacacatgttccctaagcactcccatctgagacagtgggagcagaaatcccatcggcttccatccccaggtgttggcaattcaatgtgactccagctgggtggtggggatgagttcagatggaggctcagagggcctagggaggagggatggattgtgagaacaggaaaaagaatgagatgggtcctctgcaggaagtgataaacagtgaggacacaaatgttgtagatcaaaccagtactaggcttgggacagggcatggaactacagtggcataaggtagtaaagaaatacattttattttatgacccataacacatatgcatgtatttaaaacccaaaacatatgtttcatgaaacaatgaaacaatacgtacctttactacaaagatgcaccttggcatttttctaggctgtttcatttatttttaatgctaggtcatgactcactacattgatttcataagccactaatgggttgtaccctgcataatttgcaaacattgtaggaaaagggaagaaagattagttttcctttattctttttttttctcttatcgatcatagactctggcctggaacaaatcagaatggaggttgaaaaaacaggcactgggataaaagtgatgaaggtgggttctaggcaacattcagggagaaaagataaatggataggaaaggtgtggtcatgctgtcactggaccagttatgagttccctagcaggaggtcatatgaaagggaacttgagagtagaactctgtatatctccagcatctggcacagtacttgatgctgttcaataaatgtttaatttaaaatatctaccaaattgatacacatacattagaggctgattgaacatacacatctgatcaaaacacagagtgaatatcagaatgtatgcttggccaatggcggtgttgacagggtttgttgttagcaactttatccctcccctttgtctctgcgttcaaatgccaaaaggtccccatgcagaggtatccccaactggagagtcattctcctagaggacaactaaaagactcagatcttccctgactgtcactaacggccctcaaaattttatctgacctgtgtcctgtttcctcagtgcctggttctcgtcagaactaatctgacaaaccaatccatactgaagtagtcatgagaaatactgaccgcatgtttcccttccagaccacatttgtaatttaatagggaattttgccatgctagccaaaaaaaggtggatgtttcaaaccttgtggtagtcaatggagaagagaaactgaagatgggacatctttctagggaccctcaaaccacactacaatgccactatctactctgcctacaaataggaagtttccattagtcattaaacaatgccctcctcccctccaaaaaaagtatgaaagttgctagtacaatgcctaaaacagttagtaactaataaatactggttggattagaatctaaaacatttaggtgggtaggcacaggaggcagctttaacaggtcctactcacctagcattgtctgtgataatggacaattaaatgttgcactgtccactagctgcacgtggctatggagcacttgaaatatgactagtgtaactgagaaaagtgtagtcacatgtggctagtggctatcaagctagacaagacaggtctagacagttaacagacatgagacacacattttgagcaagtacctttctctcactggtgcccttgttaaaaagctggatctttttctagattagccccaagacctaaaatgcctgtcttcaaagggttgtccttcttcttttaggacaaaggggtgtaggggatttgtgggagctggttacagagggctttgttcttagattcaagctagaccatctgttcccaatcaaagcagctttcaaatagagagcagtgcaaccctgaaacatcctgcaagggccactgaggtttacctgaatgtacaccctatgcttgtcagatggacatctcagcgtggacctccttggcacaaagttttacacagagccagaacaacctcccaaaccacaattgggcaattacttttaaaaatccaactggttgaattcaagttagaagaaatgccttttactttaacttgcctttttttttccttgatggaaaataggtttttttgctcttcaggctattgagacatatttgaaggaactgaggttgtatggatttttaatgcagcaaaaaggtgaactgttttgagtacaccaatcctgggtattgtgaagatggcttttcaagagttgctgtccatcaggattgcatttgggaaatttcataatgctgcttacaattgctttaaagtcttctagcagatatggatgctgaagaccatgaaccctagggtcggatattaattcaatttttccacctgtaaaatgggtaggccatttgcttcctaacaacaaacagcaatgaatcagcattttgatcttaggtaataacacactgcttgagttattctgtagaaaacaggagtttcccaattcttctggtggctcattcttcaccaaagaggtacttctctgtttgatcatcctctctcctctcagcatccttttctttttttttacttccttttcataaaacttgatgataaatggtaaagatacattgtcagagatgataaaacccaggagagaagaaaattgttccagttattttttacccaagatttaggcctgtgaatgtgtgtgaagaaccaaagtcagtgttaagaatcattcatattgcctaaactgtgaatgtgttaaagatataatatatttggagcatactgaagaactttagccagactatttattatctagttattgtcatcctgaaaggtataggggtgaagaataaagtagcatgcccaataattttgtccttggccctgtcctcttcagcatttttgtcaataacttggattatactacccgaagcagactgaccaaattgcagatgatgcataactgggagcgacatctaataaacttgttaaacaaatcaagattaaaaatgatccctagaggccgagtcaaaaccattaggacgtttttaaaaagcaaaagtctatatttaggtacaaaaaatcaacagcacatatccaaggttgggggaagcctggtttggcagaagtttcttaatatacctgggatataatttcaagaccacaaagtaggagtggtttccatggaaatctatggtgagctgtttgtttgttgttgtggttttgttttgttttattttgttttgttttattttttaaaaagccatgccatactcagcagcactgacagatatgtgttttctagtccagaattggggggtggggaggggtatcagttccctgtcttctggaggggttcaaccttactcacagtgtggtgctcaatcctggacgccaaactttaagggtgacatttgacaaactggaacacatccagagaaggatggccagagtggtgaagagcctgggatctctgaagaacagttggcgataggctgaaaaaaagaagtcatagacaggtgggatgcatattgtcagatgtttgaaagcctgtcatttgaagatgaagtagattgtttctgcatacttcagacaaaaaaaaaataatcctcaggtggtgaaagttacaaggaggtagatttgcagtcaatatattaagaaatttctaataattagagccatcccaaagtagaatgcactgttttgaagagtagtgagttcactatcatcagaagtattcaagaggggatggacccacctgccaattaagctatagaggggattgttgcattttttaggaagatggaggaggtgactgaggccattacaacattaagaatgtgatgctaaggaatccaaacaaagtgggaaataaaggcatgtcttcttcactgatgatggatctaaagattttattacttatatatggttttggctttaattatgaaatattttaagcctacagaaaataaaacagacaattattagttcatttttgagaataatttttgtttggggacccatctcaccctctccctgctcagcatgggctgcaaaatcaaagaaaatggctttcaaatactatatgatgtgatatcaaacttgtagctcttatctgtccatgacaaaccttagggctgatccaaagacatcataagagttcatcactttcctgcacagctttaaaaattgtttcattgactgtgactggattactggatcaattattttttcaattaagagtcctgctaaaccccatgtaaaatgagttgcaagtcaagacaagcccctgactactttagatgattgatggagatatgtggatgacagagacaggctgtaaagaatgacaattctgtggattgatttgttatgtggatgatgattactggaagccaagtaccaatactacttactcgttgatactcagggacttttgtaatttttaaaaggagaaatttagctattacttccatttattctctgcacgaacctgtgaggtgggcagagcaggtgttagcattgctgggttacaaatgacagacctgaagcccagggaagtgaccggcccaaggccatatagccaattaggggctgaactgtataaaaacccatctcagtgcaaacacactgagaaataatttttaaaataatataaataacatatatcacttatcaattgagcacagactatatgaaagtcataagcactttacacatattcatttaatccatacaataatactatggagtaggtactattataccaattgttatagatatggaaatgaagcttggagcatctaagtaactagcccaagtctatttaaccaataacttgaccttaaaaaaaaactccaaaactctttaccttcagtgccacaacacaattcaaaccactattgtctctcacctagactatagtaataacatttcaaaggtgttccctactttcgttgatgttcccttaaatctactcttcatacagcagcaagaaaagtcttttaaaaatataaatcagtttatgctatacccatgatcaaaattattctaatatttcctcccatagtccttggcataaaaatacaaattccttaccaacatctaacaaggtcctccacggttggttcctgcctcctctaccagattcatcttgcattatcctcttcctcactggccatgttccagccaggctagtcttctttcagtgcctcaaatgcatcaaatgcatttcagggccttgtcacatgctagtctctttgcatagggtgctcttctaccatcaggtgtcagttcaaatgctttgtccacagataacctttccctcgcctaatctaaattaaaaccaccttatcatgaagtcacagcatcctacacattctcctcttcatagttagaacgtgataatcacacattggtatgattatttgattcatatttatcatatttactgccagtactagactgtaagcaccatgaaggcagagatcttgtctgttttgctcaccaccatatttcagcacccagacactgccacacactaggaacctgaaatttatttaatgaatgaataagcaaaaaattaaagcccacgcctgactcctgagtcccaatgcttaaccatattatctcgatataaaagggcctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaaagactggaagcaactgaccagttaagagactactctcagtcaagagaaaaggaatgataacttgaactgacaatgaacaggaggtagatacacgtaccttagaggcagaattggtgaagcattacaaaagaatggtatagggaaatgagggagagaacaaaggcaatcatgatccttaagactttagctttggttcctggaacaagagcaatgcattagaagaaacagggacaacgggagcagacacataggtggaggatggacgtagagaaataatatgctgagttcgtgatgccttgagggcctctgggtgaggctgttttatgggcagttagaaatgtggctctggagctcaggagtgtggctgaagctacaggtatctagttagaagtcatccacatggaggtagtgagattagatccccttgcctggcacatagcaggtcctccataaatatttgttgaattttaaaaaaccatatttaaagtgaggagaaaagagggccagggacaaaatctttgaaacacatcctcattgaggaggtggacacagaggaaactgaaaaggaggagtaagagaggtagggccagcagagtttaatgcactggaaatccgagaggagagtttcaagggctaagatttagccaacaatatcaaatgcggctcagcaatcaattcgaacaacgtctatgaatagagggggatttgacagtgaagaagtcatcatcgaacttgagagagcagttcagtagaggagttggaacagaaactaggttccagaagctgaagactgcaagatctttattatcccatcattagtaatagtgataaaggagttagaatgatagttgatggaggtggcagggatttaggaggaaatggaatcttagcagatgtttagcctgacaggaagaaggcagcatagagagactacagtgtggcactcaagaagcccaaagagtaaaattaggttcaatttaaggacgagctccctagctgtcagagctgccctccaagggaagtagtgagttcccttgttactggatggattcaaggagaggcaatatgacctcacagaaggtggctcatgtattgaatgggaatttggactagataattcatttccaaccttttggacttatcagattaataatattttagggggaaaaaggtagggcaggtgcacattgatccagagagttaccaaccttttaattttgctatgttaaatgtattagctttctatttactgctgtaaaaaattaccacaaacttaatagcttaaattgacacaagactattatcatacagttctgtaggtcagaagtctggtacaggtctcaccaggctaaaaccagtgtgtcggcagggttgtgttcctatctggaagccctaagggagaccctgttttcttgtctttttcaacttctagagactacccatatttcttggcttgtggcctctttccacttttcaagctagcaatggccaggcaagtctttcccatgtcacattactctgataccgactctcattttgcctctgtcttccacatttaaagaagcttgtgattacactgggccacccagataatccaggatattcttgatattttagggtccattgattagcagccttaatcccatctacagcctaatttccctttaccgtataacctaattcagggactttgggactcagacatggacatcttttggggagtcattattttatctacccacataagagatatagatatataaatatatctcccatgtgatagacatcatcatcatttatcatcaacatcatcatttcagaaaataaagactacatatagcactaaagagtagaaattatatagagaaaagtactgtctttcaaaaaaaaaaaaaaaccacgagttgtctaccttactccaacacacacaataaaacacagcatacatttatttatttccttacactggtaactccaccaattactaataccacagctttagaaagcaccagactatatgatctctcaaggtccctcctagctctaagtttctttgatccactggacttcactgtactatgaaggaattacctggagaaccttgttgtgatgtagctctatgagtttcttcatagctatatttttcgtcttcctgcttgctttaaatgcaatcattaaatcagcaagagacttcagtttccctctttcctccttgattcaaaaggtatgaaaagtgttctgtaaatgatatgcaatattgttattctgaactttgaagtaatcaagttgtttgacatttttgtaatgatgccttttggaatatgggtggtataatttggtgccacactgtacattaacaatacccgtctcgaccctacagactcggggactataaataaaagcgtgacagctggctccagccttgcttgccactcaccattgaagggaacgcagctggggagctacactagagtccccaggaatccagaatgtagtcagaaacgacatcttcaatgagaaaaaaaattggtattttgttactgggaatatacagagacaggcactcttaggaggcagacaaccaagctatttcacactgagaaggcacagaggccccaggtagggacagcatttcaccagcacaaaggcattatatagggagggaagagacagaggacaatggcatcttcttgatccaaattggcagagtttctttaacccattaccacccagaagtgagactaggaaagaagaaatggataggaaaagtgaaagagatggaaagtgatatcctggggcttggtatgagatagagggcaatggttactgtggggaggataacacaatagagctaacagagggcaaagtacacagagagagagagagaggtgaagctgatatacttcatattttatttatttgtctcatttattgtattttcccctcactagtctgtaagtcccaagaggacaggatctttttcactcctgtatctcccaacatctataacagtgcctgacacatagtagacgctcaaaaaatatttgatgaatgaataaatagctagtattcattgaatgtctattatatgctaagcactgttataggtgctgcccatgaatgaacgtattttaactttcacagcaatgctgaaacagttattgtcattatcccaattttacagatgaagaaactctatcagaggcacagagatactaagtaacttgcctaataagtaaaggatacaggatttcaacctatgtggtctaactttagaacctgcctatgtaataaccatcctatactgaggctcagaaaggtcaaataacttgcgcaaagttacgcagcttatgactggcagagccatgattggaaccaagatctgcctgtctatgaagttgctgcctttccctctgcacttcatgactttataagattgccaagacaaatatttcttccatcaccattttaccagagagtcttctgagataaagaaatgggtgtgaggctgggcatggtggctcactcctgtaatcccagcactttgggaggctgaggcgggtggatcacctgaggtcgggagttcgagaccagcctgaccaacatggagaaacctcgtctctactaaatatacaaaaattagccgggcatggtggcgcatgcctgtattcccagctacttgggaggctgaggtaagagaattgcttgaacctgggaggcggaggttgcagtgagccgagatcgggccattgcactccagcctgggcgacaagagcaaaactccatctcaaaaaaagaaagaaagaaagaaaaaaagagaaatgggtgtgcttcattaaggattcagataaaggaaacagacatcccccaaaagaatcatgactcccaaaagatcaccaatctgcaaccagctctcactgctgttattggggctggagggagctgagggaagcagctggcagatgaatcatgggaaacccctggtagagccatctatgctaccttgtctgagggctaggcattgaaggtaagtcactttcatgcaggtgaatcctgacccacgctgcaaaagatagctctggagtagggatggtgaggaaatgccaataaagcttttctaagagactagttcataattcttgtgtgaccttgtgtaagacactccctccctttgtgtcatagtttctttatgatagggagacatcagaccagtgaaactctgttcaatcagaagagctccactgtctcatttgtaaaataaacttttccatataaaatttcatttggagaaaggatttcaccactaaaaactatgcttgagaaacaagtgaataaaaagtaagttccttctagctcaaacattctaagaatctaaaatcatagacattgtgggtgggtcaactcagtgttccattcaaccctacttttgacagccaggaacaggcctaggatctgctgtgaaaggcccttcacaggtcccccatgccccagcttctttcagaggccattaacactgtcctcatatggcagttgtcttccccattgggctaatccttcgcaggccttctactgatgtctgtctatgttggagtgggtggagcacaggggtcaatatttgaaggacagttgtacttctgttttatatgaaaggagtcaaatgtttcctgattttcacctaaaactcttcttattgatgtccaccaccaaaagacagtggatctgccttttggaccacggtggcatattattccctgaggattgccactgatctataaatattcctgagtcccttgtctgagtcacaaccagagctgtatgcttagtttggaaattttaaatttcagtgggttttctcacacaggctccctacacatttttataagttcttcttttgtctcattcttcttgtcataatatacaggcttaaagatttcactgggttcaccttcctggagacaactcataaagttttaccaaagtctgggtttcacatatacaatatgactcccttgatataaagctttaaaacaagcaaaaataataatatatcgtttaggtgtatgtgtttgtatatttttttaaaaccaaggtaataataaatacaaatttcacgatagtagttacctggggcaggggtagcagggaggagtgttatcaatacagggagatggactagaggaggaccacatagataaaagtaagttaccagtaatgttatagttctcaggttgggtaatggctttataggtgttcattatagtctaaataaataaatgaatgcaataaataaaatattaaaagtccgtgtatgaactaacaatgattaattaattctgcaccccgagttcaaggtcaatgattagaagagcaatacaagattttttttaatcaaccagaacctcgccacttatcttctgtttccttccactatttcaagagtttttgaaactgaaagtggatcatggctatagttttccttctttttaagtttatattccccctcaattattgcccataatctagtcaggttggagttctccttactgaaaatatgttgcattttcccatgagactatttttgtataggattcatggatcctaatttttcttttgccagttggtatggatctgagaattaccagctaccctttgaatcattttggttgaagggccatgattgcttgttctagtcttccagcccatgaccattattagtaaggagaggttctttctagggttgacagataaaatacaggatgcccagttaaatttgaatttcagataaacaacaaattatgtttttagtgtatgtatgaatttgaggcatacttatactaaaaaattatttacctgaaattcaaatttaattgaaaatcttgtttttatttgctaaacctcgaaaccctatctcttgtggagcaatgattactttttaataacattattggatttgagtacatgtgagtgtgagttttggatcaagcacactcagattcaaattctggctcctctgcttaatagctagaacagtttttttggtctcagaatttttatctattaaataggaataacagcaatacctcataaagctgatgagaatattaaatgaaaaaatatttgtacagtagttagtatagtgcctggctaaatactattctcattattaatggctgttattatcaatggctattatcattattattggatgttatcattattattgtcaattttgtacagaacattatgtgcactggccaagatttgatttggtattgcaaaactccacttacaggattaatttgagaatgggacttttcttagcatcacccttggtgatgatcaagacatcccttttgtttctgagtattgtactccctttggctcttgtcatgaagtaccccagattcactctagttggatttttccttttatttatttatttgtttatttttgagacggtgtctcactctgtcggtcgcccaggctggagtgcagcggcacgatctcggctcactgcaacctctgcctcccgggttcaagcgattctcctgcctcagcctcccgagtagctgtgactacaggtgcccgccaccatgcccagctaattttcgtatttttagtagagacggggtttcaccgtgttagccagggtggtctcgatctcctgacctcgtgatctgcctgccttggcctcccaaagtgctgggattacaggcgtgagccaccgcgacgggatttttccttttaatataaagacgtttcctgtgcatgtgtctgagggtcacttagaattcttcaagttgaagactattgtctcctatgatggagatggttaagtgactgataatcacttttgaaatgctaccctcaagccaatggctaatgactttggttgataaaaagagaacagctctaatcaacatagattcgaatcaaatgcagggaaagcaaaatactacatccactgagaactctatctctcacaacagggtcaagaaatgaattaaattggttttccacttgccttcatgttttcaataccttctttatttttggtgctcaacgtcttcactgtttctcctctcagggaggactccagaccccatacacattctcttctctgacccactcatccccatcaaaatttacccatctgatttcccactcatccttgcatctaatcagacattaatttatcttaccacagtgactgctaaataagattctatttaatcactctcccaggccacagacttcttttaaacacttgaagaagtaaacttaacagtggtatttagggttttctagtaggtaagggagaccatgcaggaccccttaaatcacaccacattatgcctgttatgtctgcttcgcatgaatggaagtgagcagtggtgcagataatctaaagatcatttccactttgtttgtgaatgctccacagtgttgttgtagctgatttgttttgctaattatgttctactgaagctaatattaaaattggttcacattttttaagctcttatgggccagaagagagaagaggcagcaatgtggcccactttgaaatgaaggaaaggtgacaactgtgaggggggtgtgaaaattctacatgtgggctagtggagtctataagatacatgcaaaaggatcaagatagaactttcccaattacacatgggcaggataggcagccacctaacccctgtgactcgatgagcactgaaaggacagtcttcccatggcctgcccagagccttaaatcatctaaattaatagcccacattaagggctttaataataacataactgtggctaagacattatgtaacctgaagggtaacacatttcctagcagacttattagcagctagtcttactaaattctcagtcacctatgagaaaaaggaatgaagggtggtacaaaaaacagttgtagttgtagtttgatggacgcattagtacactaagaggcccctgggcagctaaagtggaagtacaagagcactgaatgccttggagatgagccgggagggttttgaaagggagtaagacgactttcacctctatttttcccacattttcttggtttccagctcattgtgcacatagagaatgtgtacctgtatcaaattaattctcttccctttcttactcttctcctgttgggtaactgggttttcaggggcttctttcttctgaggtatgcaatttggggcctaattgtacattgtatttctaaccctacaagttgcagcaaaggaccatggagctattgaatctttttctctttttctcattgcagtctgctcccagttctcgagaggggtgtatgccatctttggattctatgaccagatgtcaatgaacaccctgacctccttctgtggggccctgcacacatcctttgttacgcctagcttccccactgacgcagatgtgcagtttgtcatccagatgcgcccagccttgaagggcgctattctgagtcttctgggtcattacaagtgggagaagtttgtgtacctctatgacacagaacgaggtaagaagaggcacctgctctgctctttagatattcatgtaattgtgttcaaacttcctcagcttatgtgccctttgcttccaataaataaaatctaattctgttttaaaattgtatttaatattccaaataaatcaaaggttaagattaaaaaataaaagtaatagtaattttagaacctaatttttcaagctatgtaggccctccctgaaaaagcagtttggaatacctcttgattgagtcaccattgttgaaaaagaacgcctcccccatcaaaaattttatctggtctaaaatgtatgaagtaaaagcagcttagtctaagtagagagaggcttaaattggaaagtattggaaaattaatcctgtcagaaactgtaattatccccatttcatagatgagatagctaaagtccaagtgctttttcatacagcagtttaaccactaaaatgggactggtagcaatgtctcttgcttccaggactcattccatcagatcacattaggttttcagcttagcaggcctcaacaattatctgatagaaataatgagtgagacagctaaactgggctttggggattgactttttgttttgtttttggttttgtttttgtttttgttttgttttgttttaaatagtgagacagtctacggccataccactctaaatatgcccagtctcctctaatagtgagacaatatattgaggatacactctattaaaacaggctcagaaattaagagtctgatcttaaataatatacagtaaggtctattgattaatttgctagagcacacacatcataattcatctaatcaggctcctccaacacccagttgtctttgacgggttccttggtaaaaccaagggattctatcaccaagacgttccagaagacaatgttactttatcactcatttgcctgtggttccatttataggctgggggtggttctctctaactcagaatttttaaactcagaaggattaaatgaaaggcttatctgcctgaggggtacctgtagaagaggtccttctaagtaacttaacttgaacggccattttgctcttgggaatccagaacactcttcactttactctcattttgctgcatcatcaaatcttaatagcaaatacttaggcctgtatttccctattgtacttacctccaaactatcatcaaatttcatgaacctgaagcagaagaccagaggtctagtccaagctctgccacttactagctcacttaacaagttgaccttgaccaactcattgacatgctcttggacttggcctcctcacctaaggtgtgttccttcttaatgttatattccatgattctgtgattttttttgagatatttgaccagctactgacactttgtatcttgctacaaatcgtaacttatatattatcagttaattagtcaatccattctacaagccattatcaacccccaatggtggtctccaatcctgtgatacatacatatataatatggtttcaagggggtgtgtacagaaaaagatacttataaagcaattcatgaacaacacagaacaacatcaaattgagtgctacactgtatactctgaatactttaagaattgtggaaaggttgcactccagaaaagtagagttttcagagaaagcttgctagagaagctagccttgaaagatagataagttgtgggttgcaagagagaagggagatggggctttggagaggagaaaagagaacaaacaaacagcagggccaggaaggaacactgtgtgttcaggtagagccctgtctgactgagatacaaaatagcttgaatattctaattcataatttgccaaattttaataaatttcattttgtccaaacagtatacatgtactgtatacagcgtaatctagtgcatatcaatttcgttttcagaactgaactttgtaagtcaggcaacttctctcctgaaacattttaaaaacgaaatattggttccaccaacagtgtacctctcatttattcaaaagcagaagacacaattaatgaattttatcctcatctagtgtgacccttctctgctcattagctctctactagaagaacgggaggaaaagaccatctatctatttcttacccttgcatcttttctctaatcatctaactaaatagtttggacaagtctatggtcttggagtcaaagaaagctttctgactcatgtaactttatatttttcacctgcagccatttagctggtgggactaatccgctctgcttaagaagtacttcccataaacttttacactaatttaccccttgaaaagccttcttacattactgtactaggatcctgttccaaaattttcaatggctttctattgcccatattgaaaaaagcagtctattcttcaagacttggcatgagtatgcctcaaccaactaacaaacccattctccctatgctacccaatgagaacctcccattgtaggaagctcccattttccactgctgcctaaatgcaccagaaccatgcctgcctcagcaatcgtacttttactactacctggaattctctcctttatcttgatatggtaatcatgtccattcttccaattttcaaaacccgcctcaaactctacctccccaaggtagccttccttgaccactctagctcacaattattcattaatgcaatagatgctaaggctacaataaaaaccacatagatatagttagatatggttcctgctttataaacctacattctaatgatggagatagacaaaaaccaagtaaattaacaaaaaaacaattgcacatttaaataaggtgctatgaaggaaaaaaatagacagataataatggatagggcttaatttccaaaggatgttcagtgatggcctcattgagaaggggcatttaagctgagaactaaaggactggaaggaggcagcatgtgaagagtagagggaaatagtttcaagcagtagaaatagcaagtgcaaaggtcatgtcgtatggttgaggaactgaaagaagtccagtgtggctaaaggataacaagtaggtagaaagtggcctgagagcagactgtagaggtagacaagagccagatcatagccatagagtataaacagaagccatgctgaggagtatgaattttattctaattgcagtgggaagtcattggaggattctgagcagggaagtcacatgatctacatttctgtagagaatggagtgtggtgcaagtaaaaaagaagggaaaccaattgaaagtccattgtggtcatccagatgagaagtgatggcagctttggactaagctggagatggagaaaaagaggtggagttgaagtatactttggagacagaattgacagaacttggggacagattgactgtgggatgtgaaggagaggaaggattcatggatgattactatgtgtttggcttgagagattgggtaagatggtaagatggtgatgccatttactgaggtgactggacaggaggagacttagttttgaggagcagagatcttgcctacctctaaacacccacagaacccttctgtccatgtcattcatctggcattgaatataactgccttctgctgttatttcactggctatgatctatactataccttcccaagcatttctctccagtgtgataataaacaactggctagcccctagatttatactttgtgcctcccctagtacatagcacatgcctgtgtgcctacttagtgttttccaacctcctttagtgattcatcaacaataagcctatgtctgtttttcaacactggactgaaagaaagagagaaagaaagaaagaaaaataaagaaggaaggaagggtgggtatgggtaggagggagaatgggaagggaagaaagaagataggaagggaagagaaagaagagaaggaaggaaggaaggaagggaggaagggagggagggagggaaagcaggcccaattcataaatcataccaatcacttggtacagttgtttaaaatattcagtattctgtattttcttgttttgtgcaatgatcatctcttgctttagtaataaaaattacagggagaaattacaatagaaaatataattttacaatattttaaattatataagagagatagaagagaaagagaaacagaagagaacacctataattacattcataagctaaatatacaaatgatgtgactctactgtataagggcagggatgagtggggagctgagaaatgggttaaatgtttgagatcatttaaaagaattgtagcacaaccagggtaaagttttctctgaaattatgaaacattgagtggaattcagggctttgttgactctgcttctatttctgtctgcagacgaaagtctgatttggggtttgcagtttgtcagtttctaaaatcctaccttgattcattaatacaaagttgaaaattactttcttggtgctatatacataaaagaacagtttttgaaaaaattatgaggttaagtgtgttgtctgccctatcggtaccctctcctattaacaccctctttccttactatggcattatgtttacacctgccctccctggcaggagcaaaaccttaacatctctgtctcaacctgcttctacaccttcataaaaacttccctgtcctgcattttcttcccactgattaatagtctttctctgctagtgacaacagctcagctgaccaatttattcatgctaatttatctatgactattaacaacttgatgggttagtgcatccagggaagaagaaatttctattcaggcaaaggccttctgtgaatacagaaccataatccaaggtgtagctttttaattctgggattccaggcaccatgagtccagtttgtgaggtcctttgcccacatgccttcctatatagaaagtcctaaaaccatgccagggaggtggccatctcttccagttattagacttatcttttgggtgcaagtgacctagttctctgtggtgctaacatttcccccagaacagcaacatacttgagaactgcagccagactctcgtgcacctgacaactctccttggcttcaatgggcacagcccacagagatgaaagaatccggcccagctgtggctctcagcttagataatgagataatagctctgggtgccctttgaggcaactagtccctaccttcttgccagtgttcaataaactcctgctgtctcccattctcaacctgaaactccctactcagttcccaagtaactctctggaagtcaacagccttctaacagatctttctatttcctctcgaaggttgtgacaggaacataggcagttgtaacaattatcctatcagtcaacaagcaattattaagctttctccagtgttagcttgtgctaggccactggtggggtttaaaagaagcagaattagatctcagctctgagaagttgacaatactgttgctgaaagagtgacttatctaagaggcctgaaaaaaataatttttaatacaactgtttccagatccaccaatgaaatatgcattcattagagcaagaaccctgtgaaaagattaaagagttgtcagatagctaggaaggtgggaaaatgttggaaggtcctaaagggcttaagaggtaaagggattccccaagaaaaggagaaaagggcctgtcctcagaggattatgaatgtttcaaccggctagatttgaactctactgagagacaagcaaagtttcagcctcacacttttctgcatgttgtcattctccacctacttacatagcctagcctcatcccattcacccagttctactttcccaaataaagcacaaaatacctctctctctctccctctttctctatcttccttctctttcttcgcctcctttcctcctttctcctctccactccttacgcccttttctttctctctacacacacactcatgcgcgcgcacacacacacacacacctcaataccaatcaatgacacatgtcaacaaatctgttattgttatcattttattcttattgtgataagagcaactgccatttcttaagcacttattatgcactaggccctgagcttatggattatctcatttaatctttgtaacatccctgcatctttacaactgaggagaccaaagcatggaaaggttaaatgatagttcctagggtcacacagctacaaagtaataaaaccagatttcaacctgggtctgccacgttccacagtctatgtactgttctctgactgacatactgcctcctacattcttaacagttgaacacaactattacctcttcctttagtcttcccttcagccattcttcaaagaccaggtacttagaccctccctatcctggttgtcttcccgtggatgcaatccaattgccaatttccttcttaaggcatggtatccacaaatgaatgtaatatcttgttgtctcagggtaccaggaatccagacaggcaagaggtcaaaaatccaggttaagaggtaaatgagttgcaaaggtgaaggcagagagacagcagagttctaaatgcaggcagaaggtaactgctgtgatgcatactaacggagggttgtgctgaggccctgattctgagggaagggaactcatctattcttctctgggtcagagactttcctgaacacagaaagaaaaatctgcaggttgtcattggtaaggggctatatttctggttggaggagcctattctggttcaggataggccactatcatgaacttctttaaagttccagctaagtaccatgactgcttggccaaaactgttaagacagtagcagggtatctcaattatgaaagaaagaaagacagacagacagacagacagacagaaagaaagaaagaaagaaagaaagaaagaaaggaaggaagaagaaaggaaagaaagaaagaaagaaagaaagaaagaaagaaagaaagaaagaaagaaaggaaagaaagaaagaaagaaagaaaaaaaggacagactatcatggattctttttcttcttcactttaagaactgattaaaagacgtacgaaggaaacagatggctccaattctgattgtgtccatttgccttctgggaaaagtgaagtcaagagagtttttattgaaattcaagctactttttacatctgaataaattaggaaggcccagcgagtacattatcgtgtgagagacggatactaaattcccctgtttgagcagcaataatcagggttgacagtacctgagacatttggtagtttccacagcctgcctaatctattgtgatgagtcttcaactatgagagcatcttgagagcccgcacaataataatagtgaatgactatttggactggattgtgaataaaagactgtacatttgtctgtaatgagaatttcatcgaaaatgaaaataccagagctgtcatattttttaatacttcgatttgcacatccttgactgctttggggcataagaagagaaagtgccgagcaatttgttgtcagctcttgaaataaattatcatttaaacacttactctccacaaaggttattagcttagtagctcgttcctggggttggaccatcagtaggggaaaaaattcaaaagacattaaactaccctttcagaagctgaatattagttactgtggaaattgttctctcggtagcttaacatatttttctgtagctctccaatgctgcagattaggctgcagcaactattaataaatactgtcatattttacagctgtcatgcaaagctgaaaaaaggcttcactgtgattagatcctgtttactgtaatatttccagctcagactcagaaaggcagttttcctataaaggtattttccataagtagaatatttctccagaaaatgacgattaattttaatgtatttttaactccttggtggcagtgaatttgaggttgaattgacttcacagccagagacattcctctctagagacaaattaagctaaaatgtcaaaatttctctcttgggttgtccttcatatgcggaaatggtgctactgtcaggagatgtgcattgagtagccccccacccctatagaaggacaaatctgcactggtttatccaacttcttttaccctgtccctcttgtgaccaattgcattgtttgcaagacagctggtaaggatgttgggtaggaatatcacttcagtaggctagctaaaaattctgcttcctgagctaaaatgtcatcatacgagctaaagaaacagatctctagcccccctacaatgcattagctgtttgaaatggtattcacatctctgaaaaaaaaggaggtgacagctggcagggttgcttttgctctgaccttctattgctttttatcaagctccttgagggaattaaccctcactaagctgaatatctagtttttaatgaataggtagttaattaacccattaagggttatctggagtagtctataaattcagggtttgggcctgaaacatccttgaaaaggttcttccaaatgttccttggggcagggatggacagcggtatagacctgcaactgtgactttgaggtttgtcccttgaagccctttagacaacaattaaagccaaggcagggttgttgtgagagtttaacaagataatgcctctaaagcctttatcatcaagctgaacacagtaacaccccatgctcaatgacttttagctcttattattttattaccattatggaacagtggtcctcaatagagagtgagggtaattttcccccctcagaggacatttggcaatgtctagggacattttagtagtgggtagaggccaggaatgctggtacacatcctacaatgcacaggacagtatccttctccacgctctcaacaaaaaaattatccagcccaagatgtcaacagtgccaaggaagcagcaggccaaataaatggttgcagaaactccttaaggggttggcagtgaaccaatctagcatttattgagtgtctcttactatgcctagatcagtaataacagctctgttcaataagtagagcctttgattctgaagagcttacatcttggccagagagacatattaagattaatgcacagaagcaaatattagtgcaaaacagcataaagcaagagctagattgtgtggtatggatgtgaagtaccgtgggagtccaaagaagagaaatttcatgataggcaggctggactagccagggaaggcttaatggaagaagttataaacgtttctgaggccaccacagaactgcctcccctagcaatgaccttgccttgattactaaggccaagttggtatctagaaccaaaacaacatggcattcccatcaatgctcccaaacgtcacagctcaaggcaagaaatacaattaaaagaaaaaccaaaaaaggaacaatgttccttttactaaatggaaagcaattacagggctgttgaaaataggcagtaaacaaagggagggagggaaatactggcaaaatcccattttctcaactaatcctgtagcaaaagtgcaatttgcaacaaaatcaacagtgctctttccctctctcttgcagtcaaacacactgtctggcatcagtatggctacacatgatgccttagccaaaaagtgcatgcaagcaaggaggacagaatatgaattggagaggagagcagaggttaaggtggagcacagctcacttcacctccaactgaagtctctgtagagcattcccattcagaggaaagagggggcacacatagagactacttcactccctgtcttcctggatcctttccaatcaataggttgccagtgtcggctgctgtcctgctttgtcgactccacaaacgatctgattaattctctggtgctaactgcctcagcaggctttctcagcagtagaacagaggctaattaagatcatgtcaggcgaggaggctgacaggttatgttcctgggctacactgaacttttagagggtgcttcaacttcactgcaggcaggcagtgcttggctaggcgctgattccatagcaggcttcccatttatttccacgggttcctgtgtcaatgggtctccgttttgttaacgatttacatcctcctcctggggataaatagttgctactgtgttgctttcaattgcattacttgggctctctttcatttaaatttttaatatgcttgtaaacaaagataacaattaatagtgaggtcgttttccatcctaaatcacatgtgtgtctgagactgtgtatatgcttttgcatcttatcaacataaagcccacagaggtgaatttaggacaaataaaggaaactctacttctcacagcaggtagaaaatggaggagacatatggaactcattacaccaagtggtggattagactgaagatataaatagctttcccctccccctaaataaaggcttagatgaattcatggatgacagacccatagtgagctattaagggaaacagagatgtttggaaactgaggttggcacaaatcaccaagtagatttttgaatccatatttaccttctcataggcaaatggccacacagagtactggcactctatcctctgtgttttaaaataaaatcttaagaatccaccaagcatctaggagacaggaggaatgctcagaaatagaggaaacttctccaggagcattctgtctggtttcatatagagtctctaaccactgtcaaagataaacaaagctggacatttgttaaagagctaaagactgattttaatcagtaatatactattgcagtagggaaaagcgttcagcataaactgaactcaccttcaatctgtacagaggtggctgggcattttgaagggaaaatgagggaaaggggagggagatgaaagggggcccaatagagtcaggaaagtgaaaagttacaaaaagcaggaaaggggaggtttggcctatgtgaaactcatctgagtttgtcaactggcacttactgaagttaggctcccacccttccatggagactggcagacaggagaactatattgaggtgttgggtgaaacaaacaataaattattttggcagccttgagtcttctcaggcagccactttaaggaagactagaatcttcctagagatgttgtcttgggctattagaaactatgttagtgttttgttctagtctttataggccaaggttgggacggggtggagaagagggctcagaggagcatggtgagaatttggtcaaagaatctttgtcaccacatgtcaagaacactctgttatgagaggtgaatagtcccgttaagggtgttgaagaaaagcatcatcaactcagaacctcagttccaggcccccaactctgccactaagtagctgtgtaatcctgggcaagtcacaatagcttttctggtcctcagattccacatctgtaaaatgacagagtggactccatcattctgcaactaacaattcctgagtgcaggaattttgtgtcagggaagttacaggagttatggaagtgaatgaaacagagtgcctccccttaataagctcacagtttagaagggcagcatggacatataaaaaaataaatacgtaaatacaatctagagtgattccttttgattctaaaattctgtgggctattacaacacttccatttacaattgacccttaaataacatgggagtagggggtttacccacctgtacagttgaaaatccacatataactttggactctctcaaaacttaactactaatagcctactattatctggaagccttaccagataacacaaatgattcattaacacgtattttatatgctatatctattatatactgtattcttacaataaagtgagctagagaaaagaaaatgtcattaagaaaatcataaagaagagaaaatatatttactattctttaagtggaagttgatcatcataaaggtcttcatcctcattgttttcatattaagtaggctgaagaggaagaggaagaggagaagttggtcttgctttctcaggtgtggcagaggcagagaaaaatccgtgtataagtggattcatgcagtcaaacctttatggttcaagggtcacctgtataatgaaactagaacttattttcaaatgaagtttgaaattaactcttaaggagagttatggagacacaaataaccagccacattggctttggaaattggccagaggccttaagtgcactcacatgtttcccttcgtgttcatttctgagccctgaaccctttcaggaccctgatagataggcggcaaaaggaaacaatgcctagatagtagattaggatatcccagtagatcttaaaacccttcctggtagatctccaagccaggggctgacacaacacacttctagcaagttttcttctaacaaggtttgtcagtattctcaacagtggcctctcctccacttaaggcctttactgccatcactcttcgaggtcttaaaacacagacctacataaccatttgcaatttccaggattccttaaaataaaaggagtatttcttctcaaaaatgatatgaatttctaggataaaagataaagcagttttgcttcttgaatatttttgtaatgattcaaaacccttctctatgcaaaacagttgcaatttcacatgggctttccagaggccccaacctctctttccagttctggatccatagtttggtttccctctaaaacctttatcttgatgccctacctggacctcaaactcaatgttctgaattccgaatttattcttttttcccagaaaacttttgcctccacctatgttcccacactcagtgaatggcactgcccagttgcccaaagtagaaacctcatccttgaatcttgcctcttcatcatattgcacatctcatcaccaaagaccttcgtctacgtttccactgccactgactcaagctcaagctcccaccatctcctgcaccattctcctaactgatctccctgatgttaccccctccaccactgataaacagcaatcttcccatcatgtcactcccctgcctaaaagatttcaacaacattcctgttacccctagattctaagcatggcacacaaggcccttcatgatccaacaaaactccaacccactttcctactctcttctccacccatcccttaactactagtgctctatactataaccatatggaactatgctactttcagtatgtcacatggactatgaccttttttccctccattcctttgcaaatacttttcctttttttagcactcagccccctcactccattccccccatacacacacactttatctggtaaatgatatatcttcgaaattctgctgaaatatttgcttccccagaccctagatctccagccccttagccctgctgtgtgtcctcatagctatttatgcagcactggtcttacaatagtattattatttgtttatatgtttaactccctcacaatactatgaacttcttgaagacaagattgttgtcttatttatctctgccaatagtgcctggattattattatttgtaaattgaataactgaatgagtaaatgagataactttagctaaaaacaaaatgtaggattacaggaacattgaggagctagcaaaggacatggccttgagtaggctgtgtcctcagataatacattagatagtcatctacctcctgtgcactggacttgccttgattttgacccaatctccctaccaaaaacattaccttcctggtccgaccaacttagaagcaaaacagatatcttggttctgggaaccttagtcatgggtttctggctagaggacaaagctgcagtgcgccttatggttcctgagtctcagccagtagaatcattaacatatgagtaatctcaagagctagaatgtagatataacgctatttcatataaatcaatggtatttagacagccacatgaattctctaaagacaagagtagcatagtattattttccacagctcctaatgaaaaactaaagaaggaaaactgcttcaaaatgtctgtgtaggcaatgtaacaaggatgaaaaatgatgtgagaactgttataggtagttctcagttatctgaaccagaggaggtaagcttggcacagataatccaaaaggcatttctgtgagcataaaatagtgcctattcataatgcatcttccttcttggttctatctttcttaggcttggctgagcatgggaagtaagggaggttatctcagggataggaatgttttggatgtcccttcaattacatattcccaaaagtcagggagcatccttttgagggactagcagaagtaagatacaaaataattgtatgcagaaatatgagtggatgggggaacacagaagaaaagagagggacactaaatccagggagaaaaagaatagtttcagggccataaagacaaacgttactgatctcacaatgacctgagatccttgttcctgagactataatgtctgacggacacaaataaagaataaacaaaatcaacaataaacatcataagcttagtattttttgctaaagaaatttgatgtgatgttttatacttgcttaagaagctcaaaagaattgcatcagctgtaaaatttccaggttccaacacgcatactacagaactatttcacagaagcattttatacctctgagaggctgagaaaaaggcttccaaagattggtccagtctctttttctcttggaaagctcttggcacaaatgtattccttctgaaaatcctagagaaagaattactggttttcatttggcacagtatgaaaggaagcagtacaatattatttaccaaagctacccattctcttccattttttattccttttgataatataaataataatataaatataaataataataatataaatatgtcatggttcatcagtaaggtagaaaccttaaaaacctttaataatcactttaacaaatgattttttttatcccaccacttctatccacctagcataatgctgaatagtagcatttaaaaaatgaccttagacatgtcaagctagaaaggtctttaaagttcttaaggctgaggtttcaggttctgaaaaatgaattggcccatattttgtcaagttggtgagtctcctaatctgtaattctacttaaaatgtgggattcgaaaaatctaaaggctagccccagatttatcgcgttaagccttttctaccctgtctcaattcttttatctgcataatggcagtaatatactttgtaccctatcttgcaggaataaagaagaatggcatagtgatgtaagctaaaatcaaaatgccgagtatgactgggcaattgcctaaagctaaaagaactgctctgtatataagtgattaagatgcgggaggaaagcctcttccttttgtgcccacgcagtcacagtgctttgtgtaaggctttacccaacagaattgaaagagtcaatgtaccttcccatgttcctcatgtactcacccacccaggagaatgcagtcagttctatctacttctcacatcgattagcaagtcaacaagtcacggcattaaatgctaatcagaacagcggcttttgtggtatactctctgggccatattgtgacgagaaagaatgaccacaggcattaggctctgtgttgtgtggctgtttcctcaccaataaagtgaacataataattgcccctaacttatagaattgttgtatgggttacatccatgaaaggcacctagaacagtttctgccacatagttagcattctgtaagtgcttgccactaccattatgctcttactagggttacaggaaagcagacttctgagacatagaacgaagatctttagctgccctagctgatgtctcccatgccttggtgccaccttgctcatctctccaatgtgctaattttggttttcttctatgagaatcagaacctgttcccaggagaggagctgggaaactcatttacactctatgaaggtagaaacggctgatggacaacgtctctcagacatctctgtggtttaggcaagtgtagaaggcctcgggccaaaggaaggaagtcttgtttttggaatcgcaatactggtgatcagaaagcggaggttcatttccttccaacaatcctaactacatagccagccatccgcctatcccacattttgctaaggttaggcccattgctgcagagaagaatgcaatcagaaaagctggaccaatgcatttttatggctttactgggcatatattttggagaatcataaaaaggaaaatgacattctctttattcacaagcaaacggaagtgcctaaaggcagcttaagctaaacagacttctttggaaattcttgaagtcagtggctccaccaaaaatatatctacattttcatttcttaataagctgagagaaagcaaaaagcatacgtattttctgacatatttttaggctcccctggattcatagtacatattgaatcttagaattgggaaactaagcttagtttacggtcttgcatttgtttggcttaagctggtgactactaggaattgggaggaatggccatgtatctagttccaatttcctttccaagctctcccttcacctgcaggcccatttcctgaggccattgccatatggctggatggacccagtcatttgtgtgtatcatccactaggagggctatgaagagaaagcaaaggacagccattggagagcatgcagaatatttggttattttgtgggagatcatgggaaagattttttgtggccttaaagacaaacaaataaaaagataggatagccactaccctcactgacagcccacataaatctaaagtcagtgttccccaaattcaagcttccctcatcacttgatcgtaggggctgtccccgccaagtggatgctcagaattctgtggtacaatggacctattttctgaatgcaaaaacaggacacatggtctgaaaatacgttttcttttctttctggcttttctaaggcaatcctgaggattcaatcccagctctgacagagattagctgtgtgaccttgggcaacaacctgtctgagcgtctgtaaaatggcaatgattatagtatctacttcattgggctgttatgaaaataaaatgagatactgtgaaagtgcttagcacagtgtctgataaacagaaatactcaacaaagtgtaactattaattatgataaatgattaaaattgtataaaagcatcaacatgaaatcacatttagttagtaatttcacatttagttactaattttatagaaaagaagaaagatacacgaaatttggattgtcctagaaaatcctgggtgttttatcactgtatctgtattcactgtctccccttcagattaataaggcatcttagaagaagagacagaaagaagacaaaaataggaggcaaaggcaaccttctcactgaccccataatttcttatagctgctgataagctatttggagctctgtagatctgattttgtttctagaacccatctgttttcctctctgaatgtgctaacttgaaattagagaagatttccataaactatttgtttcatgatgtcatctaatatgaatctgaaagttcaaaattattgtttaactggaacctactgaaatggaagaccattcagttattctaattaatattattcaaaaggtaacctaccactttacacttccaagcactttccccatgtcttttatcatcattcatacttaatgaggagggcagtgcaggtatattgttgttactttacagattttaaaaatctatatttttagagagggtaagtgatttgtccaagttcacacagctaatgagcagtgaacgcgggactaaagcccgtttcctaacacccagtccaaaaatcttccattacaccagaccactgcacacctttaggacaaaagattattatatccttactgacaatgaaaggctcagcttcagagaaagttttggggccaatgaataatcagttcctcagactaacatccacccttgacgagcattcatgtgccatgctctgggctaagcctattaaatgcatcatttcctttagtcgtcacaaaaattttaccaaggaagtactgtcatgatcctcattttacagatgaggaagtagaggcatgaattaagtaatgtgttcaacatcgcattcctagtaagtggtggagccagtgctagacgccctgattcctaactcccagtgaaagtgttcttcctgtcactccatactgacagccactttcaactctcctattagcaaagaaaggatgttacttttaaagatgctttagggaaaaagggtaactcagtcctctctcaattccacatacaggcagagggggagaagtttagaatacaagcacatcatgcctaatcccaaagccatgaatgtgcaaatgtgggaggacagttaggaacacagagtccagcagagagaactcagggatagggatacatcctctcttacttattcatgccttgggcgtcagtcacatctggttctcagccaaatagaagggcaaagtaggtatagtcagtctgtagtttccttcctcctatggggagcctggggccctaaccacgtttcaacctaccccacagacctcatcaaaactgctctgttcccttttccctagaattccactagatgcatggagccaagtccaagtgttcatggctagggagaatagtggctacccgcctcagtgacatttgctttttaaagaagttccttctaggccttcacctttgagcctctgaatagtgggtgcagaagcaaacctgctttccacccttcccatcccaatctgaggtggggacagccagttaggcgggatgctgaagggttgccttggctaactcactagtaattggaagttgacctttctcattttcttgcctccagaaatcctcccctggggatacaaatgtgtgcaaatcaccctaaagacaggacaggtgaagctccaagtgcacatttagactgggaaagggaaaaatcagttcattatttcaagacctcttgagatgctgtaaatacacagtcaacacagaacaaagatccctttttcccccttacattatttatgtgccatctaaaaattacacacccgttctctttccagcactgagagagagaaacatgcatattcatgatctgataaatatttaagtgggatttatttaaatgagagagtccatttacaaacattccctggctctgagatcttatcctgggcacacagagggaggataatttcctctggtagattcaaaacctccgctggccacctgtccccctaaacttggagctcttccttgagagctggtgaatgccacccgcagtatttcaagggagtcttccgtacctcctccctacagtccggccttcctgctctgagctcatgtcataggatcagtcgttggcaaaatgctagagctggcagtttatttggtagtcgggggaggaagtcacagctttctttgcctgggcccttcgtccccaccacataagcccgatggcagcacccaccactgatattcctagctttcttgtgggaccatcttcccctctcaaggagaacagttatgtgatacaccaggtaaccaggactggttgactgtgctgcccctctctcaggaagacatgcattttaatgcttcaaaagcgttttgtcagtacctgttttcaaaggacttatacatagagtgtttccattcactcctcacaacaatcagatgagaattgacaagaattccaaggcaaaaatcattttcccagccttaaaaatgaagaaataaaaaagagaacccctgcttgcccaacctaagtcacacagtttgtaagttgcagagttaagacttgaacttaggtctgactctaagatctgggatcttttcattatacaaggctgcctctcatcaggaaggaggactggagagaaagcaatggtaacccaaaaggaagactaatggtgacctatcaggcattgtggccacgggggcccaagacctcttcattcctatcatatagatgactttctgtatatgaacttaactctggactttccattctggtgcccattcttggacatcactctgtctctagtcctatcccacttcttctcgctcaaattaaactcacctgttttgtgtctcattttatctagactttatgagatgatcagtgaactcacccatagagctaatctgggctaaggcattaaattaaatgctgattaatggctcaatatgcaacctctcttaggtcatacacattttttgacagaagcttctaaaactttactcaaggatactgtatatgacaaatacttcaagcaatgagccaggccagtgagagcaatatcattgggcaaatgggcttctcaggcctttaacttatgctacctaagtgaccatctattctgcctaatttagggttaccagatgaaatataggacatcccattaaattcagtttcagatgaataacaaatactttttaagtataagcatgtcctaaatatcgcatgggacatacactaaaaattatttgttgtttatttgaaattcaaatttactgtgtttcctgtctttttatttgctagatctggtaacccaaacttaattgtaagatctgttccgctgcgcataaccatcaaaaagtacctattaggcatctgcttcctcatgacacttgcttgtgaccaatcctatagcatggaacactggtggaggggtgagggcaatgagaaagaaaaagcgaaagcagacatgggaaagagtatcccatcatgagactggtcttacctagtcacttgtccatgacataaaagtaatgtcactaggtcttttcagaaaatagaactagtcccatttgcctctcatcaccaacccctcctcccatctgctatgctatactgttctgttctattttgctttttgataaatgaaaaaggaacatgttttggcaaatgccagcccctgtgttctctaagtgatctgggcctcagaaggcatatcccaagcaaacatcaaggtgggatggagggcgctaccaggccactgcacagacagtgaggctgcccaaatgtaattaagcaccaggcgcagaccccaagagtgacagtgggaagaattccatgaccaaaaaaatattagggaagtgaagtggagaatgtttacaaccctaattagcaatttgcacaacaccagaattaaaatttttcccagtgtcaagcaagtttgtagactgacactatggaagctaaactgggcccatgggaaaaggcagcactaggctcctgctagtcagtccagtccagtggctaacgcacctaccaaggcattcaaattgagaaaatgactaaattagaacacaaacagtagactgactcatatgtaagataacaacagaagcgaaggaatgcaaactccagaaatgaggcctttgagtagcaataacaaggataataacaataataataacaataataatataacaatattataaataataataacaaagataattataacaatagcaaacctatgtgagcacttatgtgtcaggcactgttctatatactttgcatgaattcgctcatttaatcctgatgacaatcctatgaggactgtcatccacattttatgggacacagagagattgtgtagcttgcccagattcacacaactattgaatgatgaagcagaaaatcaaacttaggcagtcaggggccaaggcccacatatttgaccactaggctttaccacttctctaatctgttcttgaagacattttcccagaagtgggatggatttactgagcccttcccaccacattttccagtatttcactggtgcaagagacacccatttgtcaaacaggtagaaaggttaaaggtacactgcatggatctagggcagaaggagcctagtgactttctcagcatcatcatgttctaattaaatgaactaaccaccactgggctcttgaaagtatcctagaactacgaatttaaagtgtgaattacacggacacttaaagagatcatacatatctgatagtactttggaacttggaactgaccttgatctgttaagttggctgatatcttagttatcctttaagacacatattaacacctcctccatgaaggctttcccattttcccagttggaagcatttgttcctttaagctccaaatgtgccttttcgtgtatcattgtatctagcttctatctgtctctccaaaaagaatgtaagcattttgaggccaaggattattttatttatatttatatctgcatacatttcccccaaacatacacattgagtatttttaaaacaaataaatttagtctaacccattatttctccatatgaaaagacaaaggcccagagagggaaaatgacttacctagggtcacacagcaggtcagtggctgtctcttgactctcaatccattgctccatccactatccaaggatgcatttctggagattctgaatgggtgcaatttttctcctccatattcttgctattctagtgcattttcttttagttccagaacctgctggtttcaagctttcttttttgaagctcatttggaaaacagtcactctgattcctctccttacaacctactccctcccttgggattactttttccatcctttccataaactctcatatctaggtgatgattttgagactattacattttttaattgacagagatgcagctgggtcctgtataacagctgagcaacacagaatctctccccctttcctccctcactgagccatgagctgatgaaaatttgtaaactatacagaggtatgcctattctatgccagccaatgcactaaaacaattcatggattttatcttatgtcatcctcacaataattctatgatctaggcggtgttactgtttttattttgcaggtgaggacatagaggctcagagagcttaaatgatgctcccaaagttacacagataatacaactggaatttgtatccaggcagtctaactttagtgctcatagccttagtctttacataatcccctctggaacatctcacatgacataattctgccagagaacttttcctaaagtatgtcattattgtgtccttccctactgcctctagagctgtacctctagagcagtgtattagagacagtatggtaactactagacacatgtcgctatttaaacataactttaagttaattatgattaaataaaatttaaaatgaagttcctcagtttaattacccacattgcaaatttcaaaagctagatgcagatagtggctactgtattggacagtgcaaatagagaacatttctatcattgcattttatttctgcaatgaaagctctattggacagcaccactctagaaactaaagtttgaactcctctgcctgttttttttttaactttttttttaattattaaaaaaaaattgtgagtacattgtaggtgtatttattcatggggtacatgagatgttttgatacagacatgcaatgtgaaatacgcacatcatggagaatggggcatccatccccttaagcatttatcctttgagttacaaacaatttaattacattctttaagatattttaaaatatacaattaagtattattgactatagttgccctattgtgctatcaaatagtagatatttcaagtgccctgcagtctggttcctacaaacttttcagcagaaaagcagaaaacaagaagcgaggaatgaagctagaaaaaggggtaggagtctgaggatgaaaggtctcctatgccacactaaggaagtaaggcctcgtgatgtaggaaggacacaatggatttcctctctgagaatagatagagccagtgcatgttgagacctggctcaaactcgcctctctcaggaagcctgagtaaataactacagaggtctgaatatcatgtcactctgttgactggttgctccccaaaagtgacaggaagggttccaacacttacagagaatacaaaggtctcacattcaaaatggattcaaaggacctgttctcaaatcacagttctatgtcgtgttgggacctgccactttgcatcactgagcttgtttacctatctgtgaaatgcagccaataatatctactttcctgattttcatgaccatcaagtaagacaatgaggaaaatgagataatgatgtggggtggggcctagacttttaacttcctcatgtgattctagggaatgccagggttgaaaatccttgaactggatgatctctgaagtcccttccagctttgaaattcgaatcaagctttgactcatagtaagaaaagtcagcagtcattttgaacaaaatagttacctaggtccccacaacaggctgcaggcttcataagcagtcaacgtttcaacgatcacagatagcccagatttccaggtaaagcagcttctttgatgagagtgcagaagcagttccatgtacaatggtgagcattctactcttgagagtgcaggatcagttttggcttcttggaagagtcccctccccaccaggtggcagatgtactccaaaaccctagacaaggactataccaccatttgtttttattgtcctcaaaataagtcatttaaaagagtcaatggatattaaccccttgtcacatgtatagtgtgcaaatattttctcccatgctgtaggttgtgtccccactctgttgattatttcctttgctgttcagaagctttttactttaatatagtcccatttgtctattttggtttttgttgcctgtacttttgaggtcttagccataaaatctttgcctacaccaatgtcctgaagtgtttcccctgtgttttcttccagtacttttatagtttctggtcttacagttaagtttttcatctattttgagtttatttttgcatatgatgagaggtatgggcctaatttctttcttatgcctgtggatatccagatttgccaacaccatgtattaaagaggctgtccttttcccaaatgtgtgctcttggcatcttggccaaaaatcaattggttgtaaatgcatggatttatttctgggttttctattctcttccattggtctatgtgtccatttttatgccagtttcatgctattttggttgttatggctttgtagtatactttgaaatcaagtaatgtgatgcctccagctttgttctttttgctcagaattgcttgggctattctgggccttttgtggttccatataaattttagcatttttttctatttttatgaagaatattattagtatttcaatagggattgcattgagtctgtagatcactttgggtagtatggatattttaacaatattaattctcccaatccatgaacatgggatatattcctatttatttgtgtcttcttcattaagtgaaataagccatgcacagaaagacacacactgcatgatctcagtcatacatggaatctaaaaacattgatcttatagatgtagagaataaaatggtggttaccagaggatagggtggttaggagtgggagtaggtgatgggaagaagttggtcaaaggatacataattacagttatataggaggaagaaatttcaagaaatctattgtgcagcaaggttactataggtaacaatattgtatttttgaaaaatgtaaagacagtggatgttatgtgctcttaccacaaaaataataataataaatttgttaattagctagatctaaccatgacacaatgtatatgtacttcaaaacatcatgttgtacacaataaaaacatacaatgttatctgtcaattaaaaattttttttatatagagccaacagatttcaagtttggacgttggttcaaagctttctcctttcatatggaattgctttgtttcaaggaaatagaagtttcaaaacagcaggcagatggatgtacagaagtatgcaaggtgaagaggactgagaggagctggcagagggaggaagaagtaggcggggaatattctaactaattcagatagcatccctacaagccccagcagaatagcacaacaaagctgatttcccagcatgttaatttcccaaagacttctctattagccagccctctgcacatcaacaacatatggggacctggagttctacctatggctcaggaactctttaaggtcttgaagtacctccctaaattaccaaagaaagacaaaattatgttcaaattgatacaacattataattatattttgctttatatttactctttgaaaatcacaaatccctataaagtgaatagggaagcactctgttaaactagactatttgatgaatcaaggtactccattcccaactgtgcataaaactgaaagtttgaaggattgtagacatttgtaactccatcttgcaaccagagaaaaagaatcaaatgaagatcagcagctcacacttcacaaatgaatatcatagctccaaatagggctcccagggcaaatcattcatcactttcttgattctcaatcacagccacactcctgagttcatcttgaaaagacaccctaaggttttagacatggaaaccaaaacacgcagacatttcttcttttcactatagtctcactttatttcacattcatcttttgcctctaaactgtacaaaaaaaccacttcatctttttttgtggtgcttttgggtctggctatcaaactggttctgtggcggaatgccaaattaaatacactcttttttattattaaaaataaggtagctgaggattagttcatcaaaattctcgggtaatggactgttctaattaaaagaatattctgataaactgggtttagctgcaactacaagaatgttgaaacaacgtatctagtttggtctacttttggcatattttctgaaatgtctggtttcatgtcccaccttaaaaatatgattgaatcttcggtacttgaggctctttcagggttttagagttattattttgaacatctatttttaatgtccagagttagaaatgaatatagataaaactatacatgagctgagttctggacatagctttggtgaaatttccaatgtgagaggtttattgtgtattgcctcttttaagtcaaggacaacggaagaggacaattatgctaactgaagtttctggctaaacaaaatttaatgtaacaatacattcaacttttccatacattttcacacctggattcacttgatcttcattatactctcgggagactgactcttcattttataagctgaaacctagagatgctaagtgacttactcaaggccgagattatcaagtttttgaagtcccagtctagtgttcttttcagcacatgcaatatccatgtcaattctagttttactatatttgtattgacttcctcccaagcaggccacactgagctcagctaatctcaacacagtaggagtaatatatgaatatatactcaaactttagtagcactcagaatagcttaggtgaaagtcatggctaagataatgacagctgccagaagagtgtccttaagcactccagttgagagctatttattttgcataatatgatcttggcatactaaatgttcatttgcatcctcacattgaggacactttacttgtctatggcatcattgtctgtggaaataaattttcttcagaaggttttagtgtctctaacaataactgctggacttctgagtggccaaagaattctagtatttgaaaagaagggagaatgtgtgttcttagattgcttgtatgtcttttaagaaataaaaagaaattatctctgttgatctttatagtaattttatgaagttggtactgcaggtgtcatgattccgttttacagaagtgattcctgagattaaacaagcttgtcatggtaccttaaacctagccacacattccttttcctatggtgcttactaaagctcacttatcatcagaatgccctaggagcatgttacaaatacatatagccttcccagctccttccctgacatcctgaaaattgcctgctccaccaacttcataagatgactatcaagatcaactgataaaattttaattttcttactgaaaatgaaggaattaagacactaaagaatggcagctgcttagagcaataatttaatgattacctgctctgtgatgaacaccacatcccatggtggaggttggataggaataaggacacacaagatacataggactcagagtgtggccttggagagtttataaggtagttggttgccaactaccttatagcagtagttgcaagaaccaactctagcatgcctcagaaatcatctggaggacttgttaaaacaccaattactgggcctcagcctcacagtttctgcttcattaagtctacaggtggaactctgagaatctgcatttttaacaagttcccaggtgatgccaatgctgctagtacaaagaacacaatttgagagtcactagcttaggcatcatttaaaattgtatgactgtcttggagttaaaagtgatatttcagaatatatgcatgaaagaaaattaaaacaaaaggaaacaatgatctgtagtattatacggactaccctgtgtccccctcctctttcccttcactgccctcacagggctacatgtccatgcactgcagtcacagaaataaatctttctgatatctgaaaaacaatcccattttcttaccacaaatgcactggctggcaccacttcaaatggaaacatttgcttccttcactgcctggtttctctagaaataggaaaaccctctgctttagagtccagaaggaggcagaagagaggaccacctctccccatcgccaaaggcagcgtttctcatactccagtcctcagatgaacagtggcagaatcattcggtgtctttattaataacgaaaattacaggctgggagcagtggctcatgcttataatcccaccactttgggaggccaaggtgggcagatcacttaaggccagaagttttagatcagtctggccaacatggcgaaaccctgtctctactaaaaatataagaactagttgtgtgtggttgcacgtgcctgtaatcccagctactggggagactgaggcaagagaatcgcttgtaccagggaggtggaggttgcagtgagccgagattgcaccactgcacttcatcctgggtgacagagtgagacaatgtctcaaaaaatataataatgacagattaaaaatgaaaacatgggtggctggcaagacggccaaataggaacagctccggtctgcagctcccagtgagatcaacacagaaggcaggtgatttctgcatttccaactgatgtacccagcttacttcatggggactggttagacagtgggtgcagcccacgaaaggcgagccaaagcagggtggggcattgcctcatccgggaagcacaaggggtcggggaactccctcccttagccaagggaagccgtgacagactgtgccataaggaatggtgcactctgacccagatactatgcttttcccacagtcttcacaatccatacaccaggagattccctcgggtgcctatgccaccagggccctgggtttcaagcacaaaactgggcagccatttgggcagacaccgagctagctgcaggatttttttttcataccccagtggcatctggaatgccagcgagacagaaccattcactgccctggaaagggggctgaagccagaaatccaagaggtctagctcagcagaccccaccctcatggagcccagcaagctaagatccactggcttgaaattctcgctgccagcacagcactctgaagtcgacctgagatgctggagcttggtggggggaggggcgtccaccattaccgagacttgagtaggcggttttcccctcacagtgtaaacaaagccacctgggaagttcaaactcggcagagcccactgcagcttggcaaagcagctgtaaccagactccctctctagattccccttctctgggcagggcatctctgaaagaaaggcagcagccccagtcaggagcttatagataaaactcctatctctctgggacagagcacctggaggaaggggtggctgtgggcacagcttcagtagacttcagtgttcctgcctgctggctctgaagagagcagcagatctcccagcacagtgctgaagctctgctaagggacagatggcctcctcaagtgggtccctgacccccatgcctcctgactaggagacacctcccaacagggggcaaaagacacctcatacaggagagctccagctggcatctggcaggtggccctatgggacgaatcttccacaggaaggaacaggcagcaatctttgctgttctgcagcctctgctggtaataaccaggcaaacagggtctggagtggacttccagcaaactccagcagactggcagcagaggggcctgactgttagaaggaaaactaacaaacagaaaggaatagcatcaacatcaacaaaaaggatgtccacacagaaaccccatctgaaggtcaccaacatcaaagaccaaaggtagataaatccaagaagataagaaaaaccggcacaaaaaggctgaaaattccaaaaaccagaatgcctcttcaactccaaaggatcacaactcctcgctagcaagggaataaacctggactgagaatgagtttgaggaattgacagaagtaggcttcagagggttggtaatagcaacctcctccgagctaaaggagcatgttttaacccaatgcaaggaagctaagaaccttcaaaaaaggttagaggaattgctaaccagaataaccagtttagagaagaacataaatgacctgatggagctgaaaaacacagcacgagaacttcatggagcatacataagaatcatagctgaatcgatcaagcagaaaaaaaggatatcagagattgaagatccacttaatgaaataaagcgtgaagacaagattagagaaaaaagaatgtaaaggaacaaacaaagcctccaagaaatatgggactgtgtgaaaagactaaaccggcatttgattggtgtacctcaaagtgacagggagaatggaaccaagttggaaaacactattcaggatactatccaggagaacttccccaacctagcaagacaggccaacattcaaattcaggaaatacagagaacaccacaaagatactcctcgagaagagcaaccccaagacacataatcatcagattcaccaaggttgaaatgaaggaaaaaatgttaagggcagccagagagaaaggtcgggttacccacaaagggaagcccatcagactaacagtggatttctcggcagaaaccctacaagccagaagagagtgggggccaatattcaacattcttaaagaaaagaattttcagcccagaatttcatatccagccaaactaagcttcataagcaaagaagaaataaaatcctttacagacaagcaaatgctgagagattttgtcactgccagtcctgccttacaagagctcctgaaggaagcactatatactgaatggaaaaaccggtaccagccaccgcaaaaacatataaattgtaaagaccattgacactatgcagaaactgcaccaaccaatgggcaaaataaccagctggcatcataatgacaggatcaaattcacacataacaatattacccttaaatgtaaacaggataaatgccgcaattaaaagacacagactggcaaattggatcaagagtcaaggcccatcggtgtgctgtattcaggagacccatctcacatgcaaagacacacataggctcaaaataaagggatggaaaaatactttccaagcaaatgaaaagcaaaaaaaaaaaaaaaaaaaaaaagcaggggttgcagtcctagtctctgataaaacagactttaaaccaacaaagaccaaaaaagacaaagaagggaattacataatggtaaagggatcaatgcaacaagaagagctaactatcctaaatatatttgcacccaagacaggagtacccagattcataaagcaagttcttagagacctacaaagagacttagtctcccacacaataacagtgggagattttaacaccccactgtcaatattagacagatcaacaagacagaaaattaacaaggatattcaggacttgaactcagctctggaccaagtggacctaatagaaatctacagaactctccaccccaaatcaacagaatatacattcttctcagcaccacatcacacttattctaaaactgaccacatgattggaagtaaaacactcctcagcaaatgcaaaagaacagaaatcataacaaacagtctctcagaccacagtgcaatcaaattagaactcaggattaagaaactcactcaaaactgcgcgactacctggaaactgaacaacctgctcctgaatgactactgggtaaataacaaaattaaggcagaaataaataagttctttgaaaccaatgagaacaaagacagaatgtaccagcatctctgggatacagctaaagcagtgtttagagggaaatttacagcactaaatgcccacatcagaaagatggaaagatctaaattcgacaccctaacatcacaattaaaagaactagagaagcaagagcaaacaaattcaaaacctagcagaagacaagaaataactaagatcagagcagaacgaaaggagatagagacacgaaaaacccttcaaaaaatcagtgaatccaggagctgctgttttgaaaagattaacgaaatagaccactaaccagactaataaagaataaaagagagaagaatcaaatagacacaataaaaaccgataaagggacatcatcactgatcccacagaaatacaaactaccatcagagagtactataaacacctctacgcaaataaaccagaaaatctagatgaaatggataaattcctggacacacacacccttccaagactaaaccaggaaaaagtcgaatccctgaatacaccaataacaagttccgaaattggggcaataattaatagcctaccaaccaaaaagaaccaaggaccagacggattcgcagccaaattttaccagagatacaaagaggagctggtaccattccttctgaaactattccaaactacagaaaaagagggacatctccctaacttattttatgaggccagcatcatcctgataccaaaacctgggacagacacaacaaaaaaagaaaatttcaggccaatatccctgatgaacatcgatgcaaaaatcctcaataaaatactggcaaaccaaatccagcagcacatcaaaaagcttatccaccacgatcaagttggcttcatccctgggatgcaaagctgattcaacatacgcaaatcaatacacataatccatcacataaacagaaccaatgacaaaaaccacatgattatctcaatagatgcagaaaaggccttcgataagattcagcacccctccatgctaaaaactctcaataaactaggtattgaaggagcatacatcgaaataataagatctatttatgacaaacccacagccagtatcatacagaatgggcaaaagctggaagcattccctttgaaaagagacacaagacaaggatgccatctctcaccattcctattcaacatagtattggaagttccggccagggcaatcaggcaagagaaagaaataaagggtattcatataggaagacaggaagtcaaattgtctctgtttgcagatgacatgattgtatatttagaaaaccccatcgtctcagcccaaaatctccttaagctgataagcaacttcagcaaagtctcaggatacaaaatcaatgtgcaaaaattacaagcattcctatacaccaataatagacaaacagagagccaattcatgagtaaactcccattcacaattgctacaaacaggatataatacctaagaatacaacttacaagggatgtgaaagacctcctcagggacaactacaaaccactgatcaaggaaataagagaggacacaaacaaatagaaaaacattccatgctcatggatagaaagaatcaatatcgtgaaaatggccatattgcccaaagtaatttatagatttaatgctatccccatcaagctaccattgactttcttcacagaattagaaaaaactactttaaatttcataagggaccaaaaaagagcccatatagccaagacaatactaagcaaaaagaacaaagctggaggcatcacgctacctgacttcaaactttactacaaggctgcagtaaccaaaacagcatggtactggtactaaaacagatatatagaccaatggaacagaacagaggcctcagaaataatgccacacatctacaaccatctgatctttgacaaacctgagaaaaacaagcaatggggaaaggattccctatttaataaatggtgttgggaaaactggctagcattatgcagaaaactgaaactggaccccttccttacaccttataaaaaaattaactcaagatggatcatagacttaaatgtaagacctaaaaccatcaaaaccctagaagaaaacctaggcaataccattcaggacataggcatgggcaaagacttcatgactaaaacaccaaaagcaatggcaacaaaagccagaattgacaaatgggatctaattaaactaaagagcttctgcacagcaaaagaaactatcatcgagtgaacaagcaacctacagaatgggagaaaatctttgcaatctatccatctgacaaagggctaatatccagaatctacaaggaacttaaacaaacttacaggaaaaaaaacaaattaccccatctaaaagtgggcaaaggatatgaacagacacttatcaaaagaagacatttacgtggccaacaaacatatgaaaaaaaaagctcatcactactggttattagagaaatgcaaatcaaaaccacaatgagataccatctcaagccagttaaaatggcgatcattaaaaagtcaggaaacaacagatgctggagaggatgtggagaaataggaatgcttttacactgttggtgggagtgcaaattagttcaaccattgtggatgacagtatgatgactcctcaaggatctagaaccagaaataccatttgacccagcaatcgcattactgggtatacacccaaaggattataaattattctactataaagacacatgcacacgtatgtttattgcagcactattcacaatagcaaagacttggaacccacccaaatgcccatcaatgatagactggataaagaaaatgtggcacatatacaccatggaatactatgcagccataaaaaagaatgacttcatgtccttttcagggacaaggatgaagctggaaaccatcattctcagcaaactgatgcaggaacagaaaaccaaacactgcattttctcactcacaagtgggagttgaacaatgagaacacatggacacagaaaggggaacatcacacgctggggcctttcagggtctggggcactaggggagggatagcattaggagaaatacataatgtagatgatgagttgatgagtgcagcaaatcaccatggcacgtgtatacctatgtaacaaacctgcacgttctgctcatgtatcccagaacttaaagtataatttaaaaaaaatatatatatatatataaagataaagataataataaataacggaaattgcagtgacccactacagaccaagtgaatcagaatttctagaagtgagacctgggaatctggaatcttaagtgccttgagtcattgggcttttctgaggcacagtgaaattggagaatccctattaaaagaattttcccaatattcggtttggataaggacactaaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattgtgagcttctcaatacaattccacacagagtagattaactaatgaaggtcagaaaacactatggagatataggttgctaggacacagaaccaaacagatgagtcctctatatgggagggggcacccaacatgtgcaattcactaatgctcagttttaattggcttctaaattctgtttctcttgctccctctcctcaaaggactgtgtgtgtgtgtgtgtgtgtgtgtgtgtgtgtgtgtgtgtgtaagggtatatgtataaaaaaattatttgcattagacatcataatcatgttctcaatttatatagcacaataacttttacatttctgcagaggatcttatccaatgctctttttcgcattacttttcaggatcatgcaaatattactgagaatttgaataaaatctgtgaaagtaataaaaagtcatccctacaataattccaaatggagccagaccttttgaaggtggccacttataaggtggggttaatgagcatccaaagtctttctctgacccaaaatgtgtcccttgatttccctgccacagctatcaaaatccatttgttacaatggaggggggtcaccctttgaggctaacacagtggagaactctgctataagttaaagctttaacacacaggcatttattcaattagcttctatcacttcacaaggccctgagggaaacaggacacagaacagattaagctttattggttttaatagtggtagtgaatggagatcaggaaagacctgaaactgggcacactggcatagcaggctgacctggacaaagcaccctactgaggagaactgaatagccaggaactgaaaagccttgaaggtgctggaagcctggtagtaggtagatatgtatctattaagataacaaggctgcaagtagcaaatcttgactatctgtgctttaaataagtagtaaaagccttcaagcaggtagttgtaggcattgtttctgctgcttaagaataccatcaaatggcaacaacagacaccgggaactactactgagagagggagagaagaaggcaagagttgaaaaactgttgggtgctatgctcagtacctgggtggccaaagcaatcataccccaagcttcagcatcacacaatatacaaacctgcacatgtacccctgaatctcaaataaaagttgaaattatttttaaaaaaagaaaagaaaaaaagtacaatttttaagagaaagtataaaagaataacatcaaagacctaagctcttcctttttgcttctccatccttatcacctggctttcacctatatgcttgtttcccattcacatctcgtttgccagaactatattgcatggcccgcctcctcaatatcagttgcaagggagcctgggaaacaaagtatctagctgggcacattgccaccttaaacaaaaccaggattgtgttagcaaagaaggaggaaatagatattgggtaggcaacaaacgatgcctgccaaagaccaaaggagagctctggctgcccttagatcaaccatattcactgggcacctactaggtgccaaacactgtaccatgtgcttggagatctgacttttgcctcaggctaaccagaattcagagaatgaagctactccagagggataaattaccaaaactagcatctagctgtgtgtcaagttttatttttttttcctagccaccaagctgcactgagctttgagaacataatttcatctaatctttcaaattatttggggcagagattcaaacatcagctaacccgctcaatatagggaccatcacaaagaaaggtctttgaattttagctatcaggatcatttttaaaaactgtgcatcagagttattttatgcatgcaaatctctttctgctttttaattggatttgtgcctggatgtactacaaattgcttttaaagatgggctgcagaataggttccagctatggacaccaatacaatggcataggcaggtacttttggtgtcacctcacctccacacctttatttccacacagtctccaatctcatcctacttgctgactagtcggtacaaaggacttcttctaacctaaaaacaacctttgaagacctccccccaccccacaccccaaaaaagcaaatgcaaaatcattaagagctccagaatgatttttactaaggaatttttcctggggattctctctccaaggaaagataaataaacggctctcacaaaagaacgagtctttgctgctttgatgtgaatgaggccaaccagaaaatccctgcagcttaaaacctaagctcagtaacactttgtttttagtaaagtcagaatggaaaaagactttggggaagtcaagaagtggccagtaggattacatggcatagactcttcaaaatccaactttctgcaggctggtagcagtggaatacaaaactgtctaccaaatgtgatttgagaagaaaattcatgcccacagatttctttttaccttggacgatcatggcgaaagtccaagtcccttagggctttctggtaacaggtgcactccatttctagggaaggataatatgttatctgggattagtttatctggttggcctattgtcacccagaagagatcagagccctaagggtatggtaccttctggtgtttttaaattttgagaaataggaaagggatggtttataatttagaatccaagcagaactcagtgaggtgcaccagaaggaacttcaagatagacacggaagagtaggtggccactagacccctgggaagagagtgaaccaaagagaagtaggagagcggcagggctctggaatgagtcaatcatgacacctatctatgccaagcttatgttggaatcaaaagagtatactgaagtgggatatttagacccatttcttaaatgatgcagagtgttacaaagcacccagtatagtgtcttacagacactcatagaaaatatataataaatcctaaccacgaaacatttcataaagtagaaggtttgaggaaggataaggttgatagaaaggcagcaccttagtgaaataaatgaaagtgttcattgatactcctgtaccatccactgcatcccctgtgcttttgcttgcccatacctgatataaaatcccacccaacataacatctctatatatgagtcattagaattcatgggtggggagggtagtaataatttatggagtagaagaaagggactaggtggggaagggacagtaggaaggagaataaaagaagcagttgagggtagaagcaaaacggagaatggctgtgaaagtgcaaagcgaaaatacaggaagaagacactggatattaacataataacaacaataatagtaaaagttatataaggcttactatgtgccaagtcctgttggaagcacctcacgtacattaactcactcttcacaataatcccatgaagtagatttattattatcttccaattttatagattaagacattgaggcatagagtttaagtcaaaataatgatacttataaagcagagacaagggataaagaaagagactgaattctgacatcatttgctctccagatttttcaattaagccaataatgtctttctttcaagtcaatttaagtcaggtttctgtcccttgcaacaaagagtccttgctaataaaaaaaaaaaaaaatctattggctgtttatcatggacaaagtactgggctaagtgtttttatatactttttaaatttaatcctgatgactcaatgagtttggtactgttattattatccctattttgaagatgaagaaactgaggcacagagatattaaataacttacccagagtcatgcagctaataggtagcagaactgagaggtaaactcctgcagtttgacttcacactctgtgcttatcacaaccatactaatctttgatgtgcacacaaataggcagataaaggaagagcatgtcactagccagtagtgaataatggaaactgaaggccacttcattccaactgttccttttaaagagtaacctgataaagttatagccacccattcaaatttccaagaaatcaggtcctatgcaggtgaacatttgtttggagtctcctgactcttgggaaaccattatttttgatggtatgtagccttgactctccagtgaggagtcacttagcactaatagaaactagctctaggattttatgtccccaaaagagactccctttcaaacaggaaaaggaagaagttatggtgaagctatctctgtgggtacggctgggaatacttcttagaacaggaaaccagtagcatcacaccctggaaaccaccataccaagattcacaaagctagcatcaactgagcaaagccttcttccatttcttacgtgcctacagcctctccatataatcaaagcttgcatccttaatggctttcagtcaatccctatgagcattccttcttccacaagtgtactacaattagttgctgtagctttactgcagaaggaactatgtatatgtttttaattttttgttgttttatttttaatgtatacaaatgcctatctgctagcgataactattggccaaagaataatagtctattcaactgggattcaaacagttaaagattacaaatggctttcattgttttataactattagaaggctcccctgataattccttgctgatttatatcttggtctctatttctgcatagtcaccataaaaatgctgtgttaaataatttcatattaaaaaacaaaaccaggatttaatcgtcacttaagaggcaaacgataatttttatcagcctttgcgaatgggccttgtttctccttcattacatgtctataaatgtttgctagttcttaaaggttaaatgactagaaggatagaagagacgtgaatttttaaaaatcagtcactgtttttagctccattctaaaatacatcctgcatgacacagtagatcttctccatgagactagttaataacaagcattctgcatattttataattatgtgcactaccagcagagtgccattggatttatcgcacatttgagcccccagaatcagagtcgtgcttcacactacctatcataacaaatggcatggaggggttctttatgttacaggttactgagttggatatttaaatagcacattcggaagtgttctgagatatggtcaccctgcaagaaaggcaccatccaaagtacactatgatttaagtgtcatggcccatgctggagctagcagctagctgactcagaattgggatctataaaaaaggaaatgaataaaaccctagttgattaggagcagattgatcagaaacatctattgtttctgattgggtttttggcacactccaatttttagatgtaagaggcaagaaacacagacatacataggtcatattacttctttttttcagtagatagtccaattgcctatacctcttttctatctccatcctttaaaatgttggaatgtatcactaagtgatatgtgtgtagaaaccccttctttctctggcataaaaggtattccacacatggagcagtatttctctcactcccaccttagaatgaagggagaatgacctttgtttttccatcatatacatagaaagtttgaagaattttttatttcaatgtgtgcaaaataattactgatgcaaccttgactgtttataccacttttactcatcaacctattatcctcagataatgtctttggatatgaacactaacactggtacaattaactctacattggtatgcttggagtggtgacataacttatcctaggtcccacaacaaggtcgatataaaggacagactagattacaggtctcttgacttctggccgaatgttcttactactgaatggtgttatctgcaacctgtactgcccttggttaatttactttgagaaacatatgcaaaaaaaagtctaggatgttgttttcttaccctatgctcatgaatcaaacttgttcttcttccccctcctgttaccagcaccctccccaattcccaccccaacctccacatatcatttaaaagcctgtgtttccttctactattcaagagactggaacatccagatcatctaactatgacttgagataaatcacgctatgttccctcagaaattactttgacacaaacaattactccaataatatacggtggaaaatagtgttaagtacaatcagcaaatctaaatggcagtaattggcattactaattcttgcacacaaataaataattatactactttccttccaaatttcaatttggacatgcaaagtccacttagttcactggagcagaaaatggaagcctttaccaaagttgacagtccacatgataatgtgtagcctataccttaaactcatctttatattgttcacagtaactgttagcatgaggctttgcatgtagcagggttttaaataaagccttgttaaatgaatggttgttcatgaccagtctctaatttccatattattttttatcccatgagaataaaatgctcgatttcactttgtattgtggtatataatagaagttcttatataacttagtttattaaatatattcaagcatgcctctcccaaagcataccaattatggagaagaccctaaagacactaccctatagccttgctacttaaagtgtggtccatagaccagaagcatcagcatcaactgggagcttgtcagaatttcaggccccatcccagacctatggaatcagaatccacatttacaagattctcatgtgattcccgtgcatgttaaagcttgacaagttctgtgccatgggaacagttgttaatcctgtcacctgactccaatcgtcacactgcacattccagtctataaaacctcttgaacccctatgggtttattaggcactagatagaatacagacaaaggaaaagacatagcttttagcaaggacaatatataatctagctctaattcatgtggtttacattgcagtaatgcaatcatagggaagatcaggtagattgggttgttcagggaaggcttattggaaatggaataatttactaatcagtacttttggaagtggggaaaagtggtaacaatagctaatgtttgtctagtgcttactatctgcaaaggcctcaggttacactttttcatttatcatcccatttaatcctcacattaattcgatgagttaggtttagtgtagtggcaaagtgcgtaggctctaaagtaaaatggtctgagtttgaatcctacctttgctacttactagctgtgagatcttggaaaatattttttttaacttttattttatgttcgggggtacatgtgcaggtttgttacatagataaacttatgtcataggggtttgttgtacagattatttcctcacccagatattaagcctagtacccattagttatttttcctggtcctctcccttctcccaccctccaccctctgagaggcccccgtatgtgtttttcccctctatgtgcctgtgtgttctcatcatttagctcccacttataaataagaacatgcggtatttgtttttctgttcctgtgttagtttgctaaggataatggcctccagctccatcaatgtctcctcaaaggacacgattttttttatgctgttcttttttatgctgcatagtattgcatggtgtatattatgacattttctttatccaatctctctttgatgggcatttaggctgattccatgtctctgctattgtgaatatgctgcaatgaacagtcacatgcatgtgtctttatggtagaaggatttacattcctctgggtatatgcccagtaatgggattgttgggtcaaattacagttctgcttttaggtctctgaggaatcaaaacactgtcttccacaatggttgagctaatttacactcccagcaagggtatataagggtaccattttctccacaacctcaccagcatctgttattttttgactttctaataatagccattctgactgttgtggcatggtatctcattgtgattttcatttacatttctctaatgatcagtgatgttgagcttttttcatatgattattgactgcatgtatgtcttcttttgaaaagtgtctattcatgtccttttgcccactttttaatggggtcgtttgctttttcttgtaaattggtttaagttccttatagatgctatatattatacctttatcagactcatagtttgcaaaaattttttcccattgtgtaggttgtctatttatactgttgatagtttattttgttatgcagaagctctttagtttaattagataccatttgtcaatttttgcttttgttgcagttgcttttggtgtcttcctcatgaaatctttgcccatgcctatgttctgaatgctatttccctggttgtcttccagggtttttatagttttgggttttatatttaagtctttttttcatcttgagttaattttttttatggtgtaaggagtccagtttcaatcttctgcatatggctagtcagctttcccagtactgttcattgaatagggaatttttctccattgcttgtttttgtcaggtttgtcgaagatcagatagttgtaggtgtatggtctcatttctgggttgtctattctgttccattggtcaatgtgtctatttttttgcaccagtaccatgctgttttggttactttagccttgtactatagtatgaagttagacagcatgatgcctccagctttgttcttcttgtttaggattgcttggctattcaggctctttttgtggttccatatgaattttaaaatacttttttatagttttgtgaagaaactccatggtagtttaataggaatagcattgagtctataaattgctttgggcagtatggccattttcacgatattgattcttcctatccatgagtatggaatgtttttccatttgtttgtgtcatctctgatttctttgagcagtggtttgtagttctccttgtagagatcttttggctccctagttagctgtattcctaggtattttattctttctgtggcaattgtgaatgggagtttgttcctaatttagctctaggcttgactgttgtttgtgtataggaatgctagtaatttttgcacatggattttgtatcctgagactttgctgaagttgcttatcagcttaagaagctttggggctgagactatggaattttctagatataggatcatgtcatctgccaacagggatagtttgacttcctctcttcctatttggatgccctttatttatttctcttgcctgattgccctggccagaacttccaatactatgctgaataggagtggtgagagaaggcatccttgtcttgtgctgattttcaagggggaatgcttctcactttttcccattcagtatgacattggctgtgggtttgtcatatatgacttactattttgaggtatgctccttcaatacctagtttatttagagttttttaacataaacagatgttgaattttatcaaaagcattttctgcatatattaaggtaatcatggtttttgtctttaattctgtttatctgatgaatcacatttattgatttgtgtatgttgaaccaatcttgcatcccagggataaagccaacttgatcatgatggattagtttttggatgtgctgctggattcggtttgctagtattttgttgaggattttgcacgtatgttcatctgggatattggcctgaagttttcttttattgttgtgtcgttaccaggatttggtaccaggatgatgctggcctcatagaatgagttagggaggagaccctcctcctcaattttttagaatagtttcagttggaatggttccagctcttctttgtacatgtggtagaattcagctgtgaatctgtctggtcctgggctttttttttttttttttttttttttttggttggtaggctacttactactgcctcaatttcagagctcattattgatcttttcagggatttaatttctccatggttcagtcttgggagggtgtatgtatctaggaatttatgcatttctgactgtttatttgaattttctctcttttcttattagtctagctaatggtctatctattttattaatttcttttcaaaaatccagctccgggattcattgattttttaatggttttttgtttgtttgtttgtttgtttgtttgttttttgtatctcgacctccttcagttcagctctgcttttggttcttgtgttctgctagctttggtatttgtttgcttctggctcattggtttttttagctgtgatgttaggttgttaatttgagatctttctaacttttcgagatgggcatttagtgctataaatttcgctctaacactgccttagctgtgtctcagagattctgatatgttgtatctttgttctcattagttttcaaaaaacttcttgatttttgccttaagttcattatttatccaaaagtcattcaggagcaggttattcaatttccatgtaattgtatggttttgaatgaatttcttagtcttcatttgtaatttgatcgtgctgtggtcccagagactgtttgttacaatttcagttcttttgcatttgctgagaagtgctttacttctgatcacgtggtcaattttagagtatgtgccatgtgccaatgggaggaatatatattctgttgtttttgggtagagagttctgtagatatctatcaggtccgtttggtccagtgttgagttcaagtcctgaatatctttgttaattttctgtctcaacaatctgtctaatcctgtcagtggggtgttgaagtatcccactattattgtctgggagtctaaatctctttgaaggtctctaagaacttgctttttgaatcttggtgctcctgtattaggcgcacatatgtttaggatacttagatcttgttgaattgaaccctttactgttatggaaagaccttcttggacaagatatttaaactctctatgccttagtttcctaatctatagaatggagataatagcagcacctacctctagtacccattagaattaaaggagttaatatgtatgaaacactaagagcaatgcccatcacatagtaaccatccaataaatgtcagatgctactattttcattttatatgtggagaaactgatgcacagagaagttgaataactttttcaaagtcacacagctagtaagtggtggagctagaacttaaatgttgctttgtgtgactacagagctcacactttcaactctttattacataatttaaaatgttcctgaagagggagaaggagaaaactgttctaaatccaaacttttccaatgattatgagcccaatcctcctgtggaagctgggcccacacaagtattaggcaataagctgacaatatttgagatagtgtcttcatataagattccaagcagatttcactatttgcaacaaaattcatcaaaactttaaattgttttcccagcagtggctatggctttgcccagtaatttataatcttctgcctggataacttcgtgaccagacaaaagtaagggatacaggctgcacaaggcctagaataaacgtatctggccctcatgagcctggtatttaagaaatggtgtttctgtgcaaagcacacctttaaaagacagactgaacaccttctgaatagcctggaatcggatcttagacatagaatcagatgtcactggattagagggtagtttttggttctttctaaattctgggtcttattcagatgagattaattctgtgtcaaaatcttggctaagctctcttctgtatgaccttgagacagtcagtatccttctctggacctcagtttccaatatatgtaaaataagactaatgggatggtctctacatgtctttccaattccaatatagtctttacagttttgaaagtgtgttttatccacaccacttctctcctccctggtctttagtgatgtggaaagagcataggctttggaatcagatagacatagggttacctccttgcccccaggacttagaagctgggtgaccttggtcaaaatatgcctctctctggatctcgattctctcctagagatagtaatactcccacctcacagggttaccaggaattgtatgtagtagaaggcatgcaatttactaataaatatctctccctgaatttctgaggatcattatatgggtctattactctatcgtctacacagaaccacttttgtatgcttagagaagtcaagggtaacattggcctgtgtgatcttctaatactgaaacctttccctataagccagaaagatccattgaggagttttaatatcttgataaggtcagagaagggccaaggaagagctattgtaatggtcatggcgtaccccttagcaattctatcctctgtctaagtctaataggacaagtgtttaatattacacactcacaatagaatttcctttctatgacgtgggctcccagagactatttcaaatctgagtttcatagcaaaaactttccactgccaaccccttcacaattttttcaccccagaatggtctcctattacttttaaggactactgcaacatttatttaaagtaaaattaatgttaatgcatttagattttattcagatattgggttgcaggatctagtaagagtgtgtccaagctcctgatcaatcacattggaaagcagaattctcagtagtgggaagaatctagatttgtcattgactaaccaaacaagtcataaaatcattcacttgtttttagagcagtgctttggttcagctaggaaggcttagttccttctagtcaggaaccatatagaaaaatgaaagaacacttccgaagaacatttgtcaccttggtttgggtgacggtgtgatgtatacaggaaaagatgttaaggtgaaataaaatatataatttacccagcaggatatctactgctgggaataggttgtcatccattgatgagagtcataagcttcactatgtaaacattttaaggaaacatatatctgtgaaggcactatggttaaaaagttcatctctttctctgatgtttcatctatgtttcatgttttgcatcgttactcatttcaggcggggtcagtactggtctagttccattctttgcaataaggccatgttatttgacaccacacttcttgaccactccaccccaacttttgctcccatacccaaggagaatcttgactcacttcagacacttcttctgtgaggaggatctcccattagcccccaaagccccacttttagtgctacaaccaaggagaatccagtgaagatatagcatgtgtcagccctaatttcagattccaaaataacatttaaatttctttttacagtaaaatctctatcaaacagagtctgatgggtcagaatcttcaaatagccaaaatttctgcctagagattttagggaaaaaaaaatgatttcaaaaggagcgggtgatatcagggatttagtaaaagtgacagtctccttgggctgctccagggtcagtacacatttagccagttgcctccattttaacttctacagtcctgggtaatgaatacctatgttcagaaagatgaccctgagacattgtaatatccttgggcaccaaaaaagattctgcaatattcagttggttatatttatcaaggaagaaaagtgggcttacatattttatagaaactttcaatggcatttcaataacaacaacaataacaacaacaacaacaaaaagacttcttggtaagcattcaattctacatatgttactgaaaggaacttttccccttcctcctccctttacaatttccaagcatgccacatttccctctggcttttagtgtgtacatctgtaaaatcaaaagattaaattagatgatatctaaggtccctttcacttctgatgtcctgcgattataccatctctgtgatttcttacatggcctctataacttcagtattatgcataattctagcagagtctacctcagtggaaaatatttcctccaggctccttctcttattcagtgccttcgaagtgccaaagaccagggaacagtctcaggaatactagcccaagttgactaagcacagaggttttgcggatcccatctgtaaaggctaccagagtccctttgatgaccaccttcaagagggctaataaggacaactcccatgtaagaagaaaagtccatctgacaagtataaggcagtagtttgaagaattaaataaaggacagtttggcaactgcttccaaaaggctatactggcctggaggtagtttgaaataaagtctgtattactaattgaaaggcaagaagagagtcttggaataaatcagataaaataaataaagagattattttacttattgtcagcaatgccacaggcagtcttggaatttggtggcagtcctatcttcttaagcttttcgttgccaactctcaaaatgttcaaaatccatttctaggtcttctttccaccccatggttataaatcttcaatgacaaaaaagcaaaccttgaaagttctataatgttaaatatttctgaggatacaacccactccccaagtagagctagcacctggatacttcctcccacaagaaagaattgctggagaagcttgcctgagccacatctattaaacttaggcttctaggagtctaagaaaaatgtactgttttcacgtcgagtttataccagctgacctgattttgaacccacacccacccaaacacaatgtaaaactctgctcatgattctaactactggagagtgacttgtttcacttaccaaagagtgtcatgccaagacttaggaactaccaaaatatagcaaaaacccacaaccaaataaataagataaagaaattagagaaatgatgcataagcactatattatctgtatatgttctatatcttaaaatatagattttctacacatacccaaaagatacttcttataccaaaaataaacattgagactttggaagacttgtctcttgcattatccttgtccaattataagggattcgttacctataatgccaatactgctttcgagtttggccattagcatttatttttctgcactgagggaaattctacataggcattttgtatatgtctgagagatgagcatggagagagtggaaagtagaaaatgcacaagaaactgaggcagattctcctttcctctagcatcaggcctttatagttaaattcattcccacagcatgcagacacattcaaacaaagtataaaataggttacacaattaaatacaagtgagtttaagcatattcactatttggtactattcgaaccttggattccctgtccccgttgcaaataattgagaaaagtaagttttaaagcataggtagacagaatagctgaagatgggaggtggtgggggaagatgggttgggtagactaaatggtctattgagacttccacttgctctatcattctgttaggagtcattgacgttaatgttcttagactattctgtatgcataaggcaaattataatagaccctcagattgatcattcaagaatctgagggctgttttgaaagatggagcttaagttcttttcttattcatcccttgggtatgtggataattcaaaagcaagtaatagacatgtctgttgggtctacctggcttattggccagtttgatctttaatattatacagtcactactctagctttatctaaggctttatgattcccttatgccaccaaatcgcaagttgaccagatattacacgtgcaaacacaaggctcagagagcagaacaggtgactactgtggctgtgccccagacacactcttccctagaaagaagggagggagtaaattaacatttagtgagtacctactatgtgccaagtactgtgctaataacttccacatacattctaaagcatgttctacattggaagcagggttgatctattcaaataatatatgatacattggaaagtagaagaagagaggggtgttgcacctgggaatcaataaatccaacagcaaaatattgattcaagaaatactagcaacctctggccagagaagcttaccttccaaaaagatataatcacagcctcagccagctgaagataggaatgtcaaaaggctcaggggaggatgcatatctttcgaaatgatcacaacagcagtatttctccaagctacattgagctttcttggcaccacagacagagtaggggagcctagggttgaaccaacatacttgtacccatccagctgtgcccacatatctgccacctccagataaccctctctctagccctggggcacaagctgatcacacaccattttctgaaaataattcttctttgtcttgctccagggactttggcagagaattggggaagatgctttgtgcatcctgtggcactcaactatctaatgccgaaagcttgcagccaggggaggtttgtccaaatgtctgacctaaaagggccatggcttcacttcttttctaattaggataattaacctcccctgctcattcatcctgttccaatccaaaaagctcaaattaaaatggcacaggagactgtcaggctctagggacaagagacagtttacaagtctttcatttccatgccaccaccatcaaggcaaagccaggacaaagttgtcacagcaactttacccttgaaacaaccttggggcccctggaaggccactttcagaattttcatcaatgtaaatactccatcagctataaaattttgcacagctccataacacttgctgactaaattggggcagaagggagggacagggaagatgataataggagataacatttctctttctattgtcatgtggattctgtggttggtccaaggagaacaaaaactagatgctttgagttggtaggatttgatatgggattcagggaatgtattctttgggaacaatcactggaggcaaaactttgggagcatttaaaaaactggaagcaaatagcagcacttcaagcagggcagagacacaactaaggggaagcaattctacagttcttcctctgatgactttaactgtcctttccccacctctgagcaggttttagagtttcatatcagatgcccaggcagataggactgatgactgtcctctggatctcttgcccctccctactctaggattcagtccagcatcttcactacatgcagcccttcctacctacctgtgtgggaagccactgtgcgctgtagtctcggtgccaagaattcgttggctacagacctttgtgagcctccatggctgataggaaaggcaacggacaacaggttaatagatgagattgtgctgctcatttggactgagtactgaaaagttctttccagcccagtagtgttgattttccctgggtctgccttgtttggaatatctccagtagtgaagaccctgacttgcaactcagtatgtcctagatccatctacataaatttttcagcatgttaacagctttgacttgggcctaggttgagcaagttggtcactctctaaactttgccaaatcatgtcctggtcccctgctagccctacactgttcatgtcccatccataatctccactgcagcctgggcctttcctgctcttgaattaccaatctgtgttaaccagccaaagcgtagttctcagtcgttatacaagaatgactaggccagtgcttctcaaattttgatgggctaatgaatcacctgagaagcttgttaaaatgtacattctggttcattaagtctagagtggggcccaagagtatgcagttctaacaatcagccttggtgatgccaatgctgctgatccatagaccatactttaagtagcaagtagagcatctttagggtcttctctgtaattgatatgctgatgtagaggccacactttaagtagcaaaaacatatgctcatttcccaaatgagttagacccgacttggctgcttgaaataagacattgtggcacatcaacctctcttcttggcagtcaacaatagcatcctttcatattaaggctaaaagaatttttagggtaaccagggctgtgcagagggtgtgacaaatgtgaaccttagtgtagagtattcttcttaggacttgggttactggaaaaaagccttcctgggcacctgaagccaatcatgcaggccaaactcatttcgtatccagccactccattcatcgcacccactttcatagtggttctggatggctgctgccgccacatcactcatgctgtgatctgcatcagtggttgagacaacggaagcagctacatcatccaagccacaatccatttatttcatgctaagaaaaacaatcttctatccaagtggggcaagctaagctgggcagttgccacaactttaaggttataggaaatatgccttttgcgctatttacctcctcagtggagagcaatgacccccttgaagaggacccagatttcatcagtgcatcagtgccatgccaggcagagcaagcccatttctcctctgaggcataaggcgtataactcctggagttgtttaaacatagattttcaggccaggcgcagtggctcatacctgtaatcccaacattttgggaggctgaggcaggtggatcacttgaggtcaggagctcaagaccagcctggtcaacgtggtgaaaccctgtctctactaaaaatacaaaaaaattaacagggcctggtggcacatgcctgtagtcccgagaggtggaggttgaacctgggaggtggaggttgcagtgagccaagatcgtgccactgcactccagcctgggtgacagagagatactctggaaaaaaaaaaaaaagccataagttttccagagaaactaactgccttgtttctcgtttctctctaaaggtaattcttgaatcctttcctctttagcattgctgctgattgtgttctttgctcaaataatagctaataaacttcaaagaacatttgtatttgttttgagggatgctctgttatgttgatatttacagagttaaacactgcagatggggagttttccctaagaagattccaaagcattatgattttgtggttttgatccaaaatatatacatgttttatggcctaagggggttgtcaaacagtgttttaaaaaacactggcaaatttaagatgcctttaaaagtaggacagcttggggatccagaagggccccacacctacatttcccagtggctgtgtagaaacaagtcttgctgggctggcctattgctggctctggtggggtctccaagctaaaggagtagtcctcattaactttttccctcttatccactatccctgcccacctaggcaggttactaaactctcctggagagcttaataaatactttcatcttcacaggacctgacaactccattttcctcaaaatgatacataagacttaagacactggccaaggggatcagatgcccagccaagaggaactgaaccattttgttaagttctgtcaatgagtactttgcctgaatgagcatagaagctctttgggcatggccaactagtccctgcactgacccagtcattatgatggctagctatgtgatttataattagattcattttattcaaataaattcctagccagtatggtttcccagaagtccatctcaagagttgtcatcttaactctaagtgactcagggctttccccctgtaaactctccagccccagattctagtttgctgaagcactcctaaattcagtcactgccatgtggttgtttgttctttgcaaatattatagttagctcagctgggtatatcccctggttaaatgaagccaaagtcatgactttgatgactgctagtgccagtcagcttacttctcatccagagatctagacttttccctccatcttggccagccaaccttcttagtaatctatgccatcaatggcaaagaagactagatcaaatggtgagctggctttgcttacatctctttgctttatgctccacagctctagacaaagtgttaatttccaagtgaaatattatttgggaacaatcagggtaagggagcagaaatctttagaaatatattttctctatctctcctcctttcatattatctttcctttttttctaaattctagcctccttttgtctcttatcaaaatagaattctcaaccaggcatggtggctcacacctgtaatcccaacactttgggaggccaaggcgggcggatcacttgaggacaggggttcaagaccagtctggccaatatggcgaaagcctgtctttactaaaaatacaaaaactagccaggtgtggtggcacacacttgcaatcccagctactcaggaggctgaggcacgagaacctcttgaacccaggacatagaggttgcagtgagccgagatcatgccactgcactctatcctgggcaacacagtgagaatctgtcaaaaaaaaaaaaaaaaagaaattctcttgatctgtcctgcaaattctgacagtacctatttatacaatccttatgggactcccaggaatagaatatcattttacagatgaggaaactgagtcccagaatggaaaaaaacaaccacatgctcatgtattttaatgaggtccccaagacttttttagaaggtaaatcttagattgcacgcaagttcaaacatttataatgccttctctgaactttctcctatgggcaaagaaaaaggttggaaagtttttgagaatgagcatggctgtaacataatcaaaagagtgaagaagttaaagctgaccttagtgagaagcttgcatgaaagaggactgctggagtagcccaagcatgtaccaataataacttcagaatagctggtactaattagagcgtaaagaatgtggcagaacacaaagaattaatatatttgactttgtgtactcttagggcagtggaaggctccaagatagtattcaaattttgtaactaggaaatttgacagaaataagaaagtcagaagaaaccgctgctttggaggcagggatatctgagagagtgtgaagaataagtaaggacacaaacaataataaaacctgcccagtctaggaactccagctcaattacaaagttggtgattaactgacaggaaacataccattagccagagaaccatgactgtgtttcttttaagcactgacttacaattgattgcatggcctgtatccctgtgagcctgaaaaatcctgggcatcttcaggtatttacacaacaatgtgttctagagccctccctgccatggagtaacacatagaaaaatgtatgattccaactttcctggacaactgcacatgttggaataatttcagtcactgatggggggaagaaataagagtgcgaacttagaatccagactagttaagtgtttttcttcatgaacatgtgcgtctctgagcctcaatttcctcacctggttatttgggataactatgtactctttaagattggaagaattaaacgtgataatgtgtatacattgttagctctgtactcagcccaaagtagacaataaatgttcatttctatccttgaccccgccttgacagcccaagggaaaatagttcaatttaaaacctgagggatgagagtaaaaacattatacatcacaatacaagaaaaccacaaatctcttagtcaaaaaatgatttaaatttggcattcagctataatccctcagagatgggagtaaccatctatagcctaagattctcaggctaatagaagatggatgtgagagctcggaatcttcgtttcccactatctcaatcagatgatctgttcagtgatacgtattttaaggtgagtcttaatgaatgaaaggtttgtgggatggaagtgaggctttgtggtggagggcaaccagagtaaatcatgagagatggaaaatgctggagaaggctgtgccttgcatgagaatttgtgtgagtaagcagggtgaaccaagccaaaggctttggagcctgcgtagattagagtgggcctcagtgccaaatgggagtcccagctagatttgaggaggaagatatgctttaacacacaaacttgtttgtgggctctctcactcctccatgcaaaggtactgaaggaaaggagaagagcccttaaggaagtcacagatgtgttgtaggcaaagtgcaagggatatatccatcatgacattcctattggattttaacttttagtctatatcaaaatgaatctttattcagaaaatgccacagaaactttgttttacattaatattgaaagttaaaagaagacaagtattgtggtcatggtcaagtttgggatctatcattggggcaaaccattttgtctttctgggcttcagtttcttattggcacaatgaagagattgggaccatcactaattctggctctcatatttgagaattctgagaaacttggaagaactctggccaccacaaacagcctgacttctctgcagctcacacaagattcagccactctttctggaacccaaggccttgacattagcctataacccgcctccataatgccaaattcactctcatatccccattggaaaaaactcaattgaaagtaaacaactaatcaaagtgagttgatcttgggggtgttttacgtgggtttctttagtatggtggatggcacatgaaaatacttatttatcttgtgagttttgaaccccattttgggtgtttcccaagcagattttaaaccacagtattaagtcaaaaagaacttgtcttccgcaagagaacagcatgttctctgttgtcctcaggactgtatctttggctcctctgtaccctctaggcaagagtttgcccttaatattacctttgacagccctccaatggtattaggatcaaggagtctcagcactcctggaggcacagcaggcagaataagctacagtcctttgcactcagatccagacacttttcatctttggcatacattcacccccacttccttcccccttttccttctcactggtaaccatcattcatacctcacacccagaactcagaaatgttaagaggtttatcttggccttgctttttaaaaattgagaatgctgaagaatgttcccagataagtgacttgcctgatgagaagccttttgcttagtggaacctaaacacatactttctgagctcaagtctcacttcagtcagttcactttacaagtccataggcacaggccacaatgtgaactactctgcacagaagttcagggtatggatgctcaatataaaatatactcacttctgggaatctcttcaaagttcatcttctgctggagaaggggcagcagggtgggtggtcatcttcttctttgtagtcactaggttccatgtggaataaatgggacctgggaagaagatgtactgtggctgactggtagcactccttcctccaacccataagtgaagcccccttttaatcatgcataaggccttccccccactgccacccaactagggctggcaagtgcattctctggttgtgatctatggtcagctctctgccccgggtatctataaagtgcttactaacatccatgtcactcactacttgctctctaggagacgcagtcacaagatcagagctggaaattacggatttcaaagggattaagatgccgaatgaggaaatgtcatgtaagaaaccctattcatgggcatgattaatcctctcatggcatctgttaagagctcaacagtccatggagaaactttgagatgactcctgccctctgtgagtttgcatcgcaggcagtctatcccagaacaattatttagataccaaacagaaacatgaaggaactacacacaatcattgtagcatccccttcaatccaaaccccagttgctttctgttatttttattttttttattttttatatcagatattgtgtgggtgaggatcagaggcttgcctattctgctcttcccagatgttaagtaaatctactccagatggtcttctaaatttcctttcagctgacaatgcaaagcaagtttactttcactcaatgaaactgacatatctatttgggcatgttttcttagctcacagagaggagaatggagctacataattcaccaacagggagacaaagttcaaataaggaacaagatgaaagagaaaaatggaaaaggcaggattacatgcattgccagcttcagagccaaggttacacttgactagtagtcagtagctgcctcctggagtgagctattggagtacttggaatgcctcaagtaagatattggggtacctgttagctcaagttgccaaacaatacttgatcaatcacttacggctgtctacaatttgcccctgtattgtaagtctttggttctaatattaaaacatacatccttcatgaaggaggtcacagttgaagctgttatcagtcatggacagtctagtataagagtttcgtttggattgagagacaatttgtattgggagagaagaaaaagcacaaacaactgggaaactggggtcaccttctgttcaatgattccacaaattagccaagtactcatcctaataatgcagctgcaaggagaagaagatttgcagagggtcagctcttaattaaaggaaaatttaaacaaatacaattataaggaatggaagtctcagggaaatattaatttgctaacggtaaattaaggattgaatgtcggtgaatatttgtctttaccttgttccataaaattcacagactgacatccatatgcaaatataaaggggttcttgatcttcccatatcaaactcttcacacacagaacagtttctgtattagcgtctcaaatttagacaatcactatattgattttgatggaaaataaaagggtttaaatcaagttaaaacaaaaacaaacaacaaaacaacaaaatgtggattcaaatgtgctatagaagtctttccatgaattatttttaaatgaaagtatactttgtaatatgaatagtaatagcctgaagtactggctctgagttcagatttttgtatatcaggtttctgagatatgggaaaacataccatgaaataactaaattgagctcatcatctttctctttcctctgcctctattttttctttacttctgtctcagaaaccaccttcacactccatatctagcttctccattgctttacttggccacaatatgcaagggaaatttattggaaattccatggagaccaaagacattgcaagaaatggaaagagtggttggcataagtttggatttaaagcccatgtgagcactagaataagagtagaagagcaaattttggtcaggcacagtggctcacacctgtaatcccagcattttgggaagccaaggcaggtggattgcttgagcccaagagtttcagaccagcctgggcaacatagcaagaccccatctctaaaaaaaaaaaaaaaaagcaaattttattcgtcattcacgtgattttttgatgaaaaagaatattaatttcattaaaatgtcaaacttttattcatgacaatgtatcataaatattaaaagtaaaatacactggattaaatatatggcatatgtcaagatacttaatgtcaatatataaaggctcttataaatcaataataaagacattaacatcactaaaaagttggacaaaggaaataaacaggcagtactcgaaatgatgaataaacatggacaaaaaaataaaaaagtcactagctttactaataaagaaatgctaacaaaaaaagagaatcctctttattcacctaccaaatgggcaaatatattgttcagtgctggcaaggggacagagagacaagtactctcataacctgctaatgggaacacaaagtgggacaacctttctggagggcaatctggcagtatgtatcaagagccttaaacatgtccgtaaatgtttggcccagtattcctactttgagatattaattctatgaaaataattagagatgctgtatgagtgttgtcagcacggcattattcataataaggagagattggaaaacactgaaatgttcatgttgcagaatagttaaataagttatagtatgtctaaaggttggaatactatgtcatcattaaaactcatgtttgaaaatgtctaataacaagaaaatgttcatgatataatgctagattttttaaaggcaagacacaaatacagtcatgcgccacataatggcattttagtcaatgacagactccatatatgacagtggtcccataaaattataatactatacttttactgtgtcttttctatgattagatatgcttagatacacaaatatttaacactgtgctacagttgcctactgtattagttcgttttcatgctgctgataaagacatacccaaaactgggaacaaaaaaaggtttaattggacttacagtcccacatggctggggaggcctcagaattatggcgggaggcaaaaggcacttcttacatggtggcggcaagaaaaaatgaggaggaagcaaaagcagaaacctctgataaacccatcagatctcttgagacttattcactatcatgagaataggatgagaaaaaccagcccccatgatctaattaactcccctgggcccctcccacaacacagggaaattctaggagatacaatttaagttgagatttgggtggggacacagccaaaccatatcattctgccctggcctctccaaatctcatgtcctcacatttcaaaaccaatcatgccttcccaacagtcccccaaagtcttaactcatttcagcattaatccaaaagtccacagtccaaagtctcatctgagacaaggcaaatcccttccacctatgagcctgtaaaatcaaaagcaagctagttgcttcttagatacaatggaggtacaggtattttgtaaatacagccattccaaatgagagtgatttgccaaaacaaaggggttacagggcccatgtaagtccaaaatccaacagggtagtcaaattttaaagctccaaaatgatctcctttgactccaggtcacactgatgcaagaggtgggttcccatggtcgtgggcagctccacccctgtggctttgcagggtacagccttcctcccagctgctttcatgggctagtgttgagtgtctgcggcttttccaggtgcacggtgcaagctgtcagtggatctaccattctgggatctggaggatggtgcttctcttctcacagctccattaggcagtgccccagtagggactctgtgtaggggctctgaccccacatttcccttccgcattgccctggcagaggttctccatgagggtcccacccctgcagcaaacttttgcctgggcatccaggcatttccatacatcttctgaaatccaggcagaggtttccaaaccccaattcttgacttctgtgctgccacaggctcaacaccacatggaagccgccaaggcttggggcttccaccctctgaagctgcagcctgagctctacgttggcccctttcagccatggctggagcagctgggacacaaggcaccaagtccctgggctgcacacagcacggggaccctgggcctggcccacaaaaccactttttcttcctaggtctctgggcctgtgatgggaggggctgctgtgaaggtctctgacatggcctggagacattttccccccatggtcttggggattaacgttaggctccttgctatttatgcaaatttctgcagcccggttgaatttctcctcaacaaatgtttttttcttgtctactgcatcgtcaggctgcaaattttctgaactttaatgctctgtttccctttaaagatggagtgcttttaacagcacccaagttttaaatgctttgctgcttagaaatttcttctgccagataccctaaatcatctctctcaagttcaaagttccacagatctctagggcaagggcaaaatgccaccagtctctttgctaaaacataacaagagtcacctttgctccagttcccaacaagttcctcatctccatgtgagaccacctcagcctggaccttattgttcatatcactatcagcatttttgtcaaagcaattcgacaagtctctaggaggttccaaactttcccacattttcctgtcttcttctgagccctccaaactgttccaacctctgtctgttacccagtttgaaagtcgcttccacatttttgggtatcttttcagcaacgccccactctactggtaccaatttactgtattagttcattttcacactgctgataaagacatacccgaaagtgggaacaaaaagacgtttaatatggacgtacagttccacatggctggggaagcctcggaatcatggcaggaagcaaaaggcacttcttacatggcagcggcaaggaaaaatgaggaggaagcaaaagcagaaacccctgataaacccatcagatcttgtgaaacttattcactatcacaggaatagcacatgaaagcccaacccccgtgattcaattacctccccctgggccactccaacaacacaggggaattctgggagatacaattcaaattgaggtttgggtggggatacagccaaaccatatcacctacagtattcagtacagtaacatgctgtacagttttgtatcctaggagcaatacgctatgccatatagcctaagtgtgtaggaggctattccatgtaggtttgtggaatacactctatgatgtttgcacaatgacaaagtcacctaacaacgcatttctcagaacgtatccccatcattaagtgatcaatgactgcattacaatccattttgctaaaataaaaagtgtgaagtctatttatataaaacagaatgtaaagagggataaagtcacctatactttttcttttaatttttgtactttctgtgtttttccaaatgtccaaactgagcatattaattttatacttagagagaaacacccagatgctacctcagaaaaggaaagatatttgtaaagtgctttgagtacatctgggtttgcttcccacatactgtactcaaggtttccagattcttcatctaccacaggaagaagcaatttgtaaacctggcctgagccctcccttcttgcctctgtgtctttatttgctgatgtctaggtagtatatggcccttcttgaaacatgcctttctcacccagaacctttctgctggtcatgaagaacacctcaggaaaaaaaaaaaaaaaaaggcctgctttaatatgccacatttgtattgggtagcccttagaataggtcagtgattctccactctggctgtacatgagaatcccccagggagattaaaataaaacaaaacaaagcccaggaatcactttgagaaatcattattttattgctccagagtaagccttggccatccatttttcatacttcctagggtaactgtaatgtgcaaccagcattgaaagccacagaggtaggtgaagacacagaaaaggaaagaaagaaatggttttttcagctgatttcagttgagtaacatagacaggaatggacactaaccttctgtggacctgtctcaccattgtcttcccactccactggcccctgagataccccatatctacaagctgttcatttgttaaactccgtaagatcatcaagcacatcaccaactttcaaattcatcatctgaatgaccccataagatgggcagactcaaaaacaatgttaacattctcttttgttttccttccaaactcattcatgttaaggtcactgctaaaatgtacgtgtgttcgctgaaaggataacatgttatgccattagctatttttacgctggcacctggaaaagggaagggtgctgagggaattgagcacaggataggaaagttttaatatggggaaagaggaagaaaaagactgggattggtagtgataggcctactcaaggtactggggagacagggaagcgaacatcaggatgttgtgtgacatcaaaaagagaagagaaaaggacatgaggaattaagttctgtccacaccaaaatgttgctaagcgtcatcttaaaatgagagctataaagtaagttggacatgatgcacttgaaagaccactaaattggaagccaagagacttgcttacagggtcaatactagggcaaggtaagtgcggctgcacttgtgcaaccctcagaaagtgccttcttgaatatttaccctaggtgcttcacctgcctcaccttagctccagctctgcttgcttagattccagtctcgcttcagattctaaactgtgtgatatttggcaagtcacttcccctgtctaagcaccacctctcaaacccgagaagctccacttttacctgtctaagctattgggcttccataaaaatttcatttgaaaagagttacacagctttaaaaattgtatcctacttctctgagtcatctgtaagagtactagcctgtaatactgtggttctgtgtctaataattgtaagctacaggagttttcatgggccacttaaagcctctctttatcaacctgaaaatattgacaaggtaatttctagcacaggccactggaaaagtattgaattaccctctgggaaagaccaacttgcctctctatagaacatttcgagagggccagtaaacctttttggggctttatggcaaaccctctgagaatcacagccaggcacaaattgctataaatgtcaacactcatgagaagcctgttcatcaatatcagcaacttccatcatttgggggactgttaaaagaccccgtcagaagtacaaatgctgtggctctgagagatctggtgcagattcacagctgacagcaggtggtgatagtccctgctggaagatgcacaacaggaacaaaattatcctcaactatattttcttgggtatctttattatgaacttccatatgtcaatatcctacttattgttcttctgtgttttcagatgaaatactaaatgtgttcagcatggagcgggttttcacttgtttatacatttaacaaaatcctggccttctttcccctgtgaaaatgattttgacaattgtatatttgagaactttttgtatctgatgctatccctgtcatgagatcaacctcatagtcacagatgaatcccccagaaataaactgaaatagagattcacatgcaagaagtttattggctggtactctcattgtcagcaattgtgggaagaagagaaggatgcaggtgagggcacaaagagaaaatgagctatggtgcagtcataacaaaccctcagctcccttccgggagctctgaagctaggatgacttgcccttagagttacctcgctgggggtatgagggttgtgcctttctatcctggggcaatcggtcattggatgcaggataccccaggaaagggtcataaccttaagctgcaacttttccaacaactgaaggaataagttctatggtgctgaaggaggatctgggtggtacagcacagcatccaccacactaccctttgccaagattatcacaccttatttgccaagagtagcccaaccaccactccagtaggattaaattggtcatagctgcagcccagttcttcatccataatttccttcccactccttgccacaaactgcattatattggtaaaatgcagatgacaatctagcattcacccacttacctatatggtaactaccattctttaaaatgaggaagaagaggaaagtggatagcgacagcagtctggaatcagaatgagagaatttgctgctcaagtaaaagtagtttttagtgttgcaaaattgggcacgttaaagctcacagagagtggatgacaattctgaagctgctaaaacagcaggcttatttttacaaagccaagggtttgttacgtacctctgctcctacaagcaccaatgcctgtttttttctctgcctcctgtgtcaaatttttctctttttttttctccctcaagcgcatatttactctctttggtcagcttcatcaggaaacagtcaaactacaataaattaggtatgaaaacaaataaaagcttttcttgggctgctcagtgacaggtacggagctgaggtgaccattccccccagggttctatagtacacagccacatgcttaagcaaacacagagaaattctgcatggtaaaagacactgcagtattcagccacggttctgacttgctcaaaaaatgtgagcaaggcttatagcccaggaagcttcagacatgccctcattaaaaagcagtgtgctttttctacttaatttttgaataggtaatacattcacatggttcaaagaacaaaagtataaaaagatttgtaagtcagtgtttagtaaaatgcctctcatttgtggcagtatgcagcctacaaaggagctctcatctatcatctatgtcttccagaagcctatgttctgagaggacagcatgagttgtacttctttttaatctttattgtttttgtacttacagaaaataatacctgcttcttgtaaaagggccaaattttacataactaaatgacagtgaaaataaaagttcttggtaatcctacatctcagagataacagccaattccttcagattttttccacacatatagaaacatatagtttctttacaaaatagaattataacataaatgccattttacagcttgttttttctattattacctattatccaatatattatatatactgtacaaatcttttcttgttagtatatatagattgagctgtcttttaaacaatagcatagtattctatgcgtatttactataatttctttatgcagttttattttaaaattttaaatgtctgtgacataattctttaaacccatttctccattgcttataattaatttaccatgaacttaaatctactcatttctggagaagttaatgagaagtcagtaaaggaagtttcatggacaaagaagataattcagaaaggtctgcaggtgtagacagatgtgcctgttaagtggacagacaagtgtggctgcctggagtactgaataagtgagtgaggccattttccagatttgaatgaatttgaaaataagggagaagtggggactggaatggggtgagggattaaacaaagggagataaaagcaaattggaatggaagaaatcttgatacacggatggtgagtctttccagacgaaagatttttatggagagaactgacacgttttagttgaatccaagcttgatactaattaacaatataatttgggtatttaaaaatattggcaaaggctgctaaaataacaacccacgtcaaagcaagcaataatctcattgtcgtccacactgatcagatcacactggaattatcaggatcaataaaatattgacagatatccataggagagagcaacagtgagggaacttgtcatcatgccataaaagtaacggtggaaggactgggacgtctttagcctgaggaaaagaatgttaaagggaaacatgctaactgccttcaaaaatgtgaaggactaacacatgcaaaaggagttaaatttgctctgtgtcatcccaaatggtggaataagaccaatgagtagagattacgagaaggcttattttgattcaacacatgaacagctgtattctgctaaagggcctttaaaaaagtttactttaaatatattaaagactctgtccactttcattaacattattatttagccaatgttttcttcataaatagtacaaaagtaaaattcaactcagtccttgatgaagtttcataaattcttaattagtgagattcaaaataatgaggctttatcgtacactgcttgagaaagattttcaattgccttaatctctttcttcctatgtttatttctcaatcccatgccttggcctaccatgtcccctcaactcccactgaagcagagagcacatcaacaacccacacgaaaatgtaaatctgagaaataaatatgcgtggttggtttaaaaagagaaagaattaacatttaaagcaatggtaatttactctgatctgtaattttgagctcctgtgctgaaattgctcatttggaaattaccaagtgcttgggtctcatttgtgatcttcttcctgcatacacccagcacacaaaggagtcataatgaccggctgagtcactgctgccatctccctgaagcgtgctcttcaaatgtcaataccattttctatggtacaatgaagaaaattccgaattgtagcctgcttacactaaagggtgagcccgaaacagcacagaacctggaatatgctcaaagggcatcgcaatcctctcccattctcttctcctccagtcatcaaattgctatggcatggatcattttggctttgcaaatcatccctatcacccactcccattagtcattacttgaatataaatgaaaaactatttaggtttatgggaagaaatgagctgcttttggcaatatcccaataaaattatatctatagttgaagttatattcagatatggattcaaaccagaagcgaaactatagacacaatgtaatattagagacatgaagactctaaaagaccagcatgtagaaaactcttgtgctattcttatggatcatacttcagatattttgttcttcccaacttcttaaaccctaactccaaaaaggttacccaaaactcaagcatcagatcttttctctttttctcattcaatatagatccagggtaatggtagctaacagttatctaatgtaaattagataaaaaggaaccaggaattcctggtaaatttaattgagaaagggaaagaactcaggaaagcttaatatgactgaactttttaataatgtggtgatcaagagctcacgagtatgatatctttgttatagattgtctttttcaggttttcataaaattattttacttgggagacataatttaccttgttggatagtctttctatgtaaggagaagccatattataatgaggcgctatctctactgaagttatttctaatttgccacaatgcttatatagaagatgaaataaatgagcttcaactgcagtaaggaaattgcaggcagttgtaagaagttcttgattttattccatagatattttgagagtgcatgtcaataaaaacaattagataatataattcagctgtgagctctcatgtagccacttgatgcggggtgcccaaaagttgtagaatcttctttcctttgcaacaaaatgaaagtgcaaactgtctggagggttaaggctgaggttatgagtaagcctgctttccataatggataaggttcaaaggcacctgatggactgtgactagaaattcagtagaatctttaatacctacagaaagatttttaaatcattgaagctgtttttccttccttcaggattttccatcctccaagcgattatggaagcagcagtgcaaaacaactggcaagtaacagcaaggtctgtgggaaacataaaggacgtccaagaattcaggcgcatcattgaagaaatggacaggaggcaggaaaagcgatacttgattgactgcgaagtcgaaaggattaacacaattttggaacaggtacgtttgagatttatttcaccgccagccaacatgttaaattatcaacctaagtcagctcccatatctgctaataaattaagtagccaacagactaaacgtgccaacagtttttgatagtctctctaatccttttttcctccccagtggctgcagaaaaaaaaaaaaaaaaagaaagaaagaaaagagaagaaaatctaagctgttgaaaattgcatgccatgattaatctggaagtatttgcaatttaatgctacctatcagataaacatatccctccacacctctgtttcatagacaactgactttcaaagtaatccccttcctttcccataccttcttcccaacagggaacagacaagggactaagcagtgcagatggaaagggtttttgtttcaggagcctcattgctggaatatgtactatttccagacccttctaaagatcaccacccattcttgatgactatggatagacagactgtcaggacagtactcaccaagttttgaatttgtctacatttttgcagattatccctctggatcagagagagagagagagaacaatttaagaccattttttcccattttataactttttaattcattcactccacaaatattcatttaagacccattacatgctgacaatgtgggcaacaagttatcactgtcccataatttctcaaaggagaaataagatcttgtattactttaaaataacaattttttttgagacagagcaagactctgtctcaaaaaaaaaattatgtgaaaccccatctctgttagaaatacaaaaattaactgggcgtggtggcgggtgcctgtgatcccagctactcaggagactgaggcacgagaatcgcttgaacccgggaggcagaggttgcagtgagctatgaccgcaccactgcactccagcctgggcaacagagcaagaccatttttaaataagaagtggcatatgagaaaaatgtttatgcttttaaaaatagaattcaatgggccaaaatatattcattattaagcttggatatttaaatttaagactaaaaaatattagaagaaatgtttcaccctaaaccagatctgttcagggtagagtcaagctgaaatgtgaagaaagtttatcactttccttagaagtttcaatttgccagttaataacaatgtgcccacgctgccataaacaaaaatgtaagggaaacatttccattctaatttaatcccagtgtacctaggggccaaaacagcttcagagattgaaattatagtgagcagctattgcctgggagagctgttttatagcaaattaaatattaataatttgtcagatatgcccccataagaagagaaatgcaaacaaaaataggtgacaaaaggaaagagaagggaagagacggaaggaagggaggaaaggacaaagggagaaaaggaaggagggaaactgctgactctatatcgtagaaatacaaagtgtccccttgttaagatcggcattaccctctagtgaatcatacttcacagaaaatctacagcactagcctggttaaatcaagtttctcaactaacattctcttgagctacacaaatgatctacctgccccttcccccccacaaaaaaaaaaataccttcctttgattttcttagatcttgaaagtgaagaatcaggtcagtgatgttggtgtatgtactacatgccctctaaaattttataccaaaatagccttttagtgggtgacctacttaatagcccaaagcagaagaacatcctccttgtcatactttgtttttcttcttttgtattagtgactttggcttcttagatatcttatattctgttaaagtcttttggattttatagaactttatactgcagtctgggatttttcagcattatgtaatagaaaagtagtgggtagagctctgaattctatataattgtgggaccttgggcacttaaatatctatgcctcagttttctcatctacataatggagaaaataaaattttctctacatcacatggttggtataattgctttaaaaagcgtaaaatgctacagaaaaaacaatcattattactagacactttcagaaaaactaaactagtatcattcaaaaactctattctcttttcatgtcatacttctccatcttcctttcttctatacgcacattcacagtatcctttaaaacactttctatacaatttttcaggaaacattgttcaaagaaaagttttagcaacatctaggtaaggatagagagttactttcatttattctttttccctctttcaaaaaattgtcataaaaccatcaactcatgattgttttctctgccatttaaggtgttcttactaggccataaattctatgagggaaggactagatttatcttgttcactattatatctccagtgtccaacagagtaactggcacatagtgttggatgaatgaatggatagatggataatgaacaagaacatttcagaagttccactgcaattttgctgtatttccatccagaggcaaaaaagtacctacagttacatgatgtgattattattaaagtacacattttctcaaaggtgtggctttctgcttaagcttattccaatgatccagtgaatttgccgtaatttattttacgaaaataaattttcattaaacaaatgatctaaattaagcaacaacttcaacatgatatttatttatagaaaacattttttaaagacatcaaatgctaaaatacagagatatctatcacctttctcattggttcctaaccagtcttttgataaatttatcatacttcactatacagatcctgattggaatgatagcatttataatccaatcagtattaagttctccctagagatgctcccatcctccaagagtgtattcagctctgtttgagatcatttttatggaaggaaacttctacagtctcccacaaaatgatatttcataccactatctgaggtagaagagcctgttacaccactataacactgtttcctatagatcagattttggcataaattaagtttatattgtactctatatccaatgagtgttaataaaaatgcctcaatgtggtgcaattttaaaatataagcaggtcttcaacatagtgttatatagcataacctcctcatgtcatgatataagttctggttttccctgtgaatattcaaatacataaggtaaatcaaaattctttcaatattttttccccaaacctctttttctttttaactgtttcaacccttgagattacattaggggaaaaattcaattaggtatcaatctgtctttcacatctccatttaatagttaatctaccagagaagcattctaaacttatagatataagaattaacatagaaaaggacagcactagagagagatgaaaccatgaagggttggtagggcacatagagaatatttagagatggtatatcctgaattcaagaattaagagcactttccataagaaggtttaggtgaacaagggtgaatgaaccattggcctgacccaatatagcattcctattactgtgttgtgcttatgaagctctcctcactggtggacagctgccttactcaattcaatgaccaatctaaacattaatttttgaaaaggttgcctctctgggagttatctattctgaagagatcctccaccacagtaatatataccttatggctttgttgcacctttaatgtctattcagagacgcagcataacagcgtttcagagcatggactctggagccagtctgcatggattctgtcacttactatctttgtgacccaaggcaagttattcaattctctgtgcctccattttttcgtagtaaagtgagagtgataactgtactatgatgagttaatatatgcaaaccatttagaaaggtgcctgacacgtagtgtttatatagtgctttgatgccaaagcaaagtgttttcacatagataatctgatttgacacccactataggaggcaggcagagcagataggttttatcccaaatttacagatgataaattgaaacttggagacatttatatgacttgtttaaatgtaaccctctgctcaatcctagtaagtggcagagcaaggataaaactcaagtcttctgattcctcatacagttctcttgcccctacactgcactacctcttttaatttgtaagttactcattaaataaatatttagccaatgccaaaacttggatttggcctgcttatcaggttaaatcttaaaacagttgcaaaacaattagagaagatccaaagaagagcagcaaaaatatgattaaagtgttagaaaatggggcctgtgaggaaaggctaaatgagttgggattgtttagcctggtgaaagagagccaagaggtagtttaatcaccttctcaagtataaagagttatcattaaaagggcactgaccaactgttctgcatgcctaaggacagtaccagagcaaatgagcttaactagactagagagagagtcagtattagaaatgactcattataaaacagagaggaaatgaagacagtaaaatctcaccagttcaggctatatgaaggtgaagccatactgaattagtgaaaagtcagacctagatatgtcttaacattgttttcaagaatatacaaatattccaaattaatcctgtgtgttgacaagtaaatatccttatagaagacttatttaataaatagacttatttaataaatagtattttctaatttgtctattcattatatatctaaaaggctgtccccttaaaaagatttacacattcctccttcagtcttaaccatgtttctctttattccatagaaaatttacagacaagtctcagcatatcctctgcctaaattatagcatgtgctaatctagtggggcccaaaccaatatgtttcaatgttctacctaaaatattatataatgtataatttccccttgagatattccaggctaaaatcacttcatcatggatgatgtgaaggtagcatttcttaaggacagattcctgaagcaggtcaatccttcaggtagatttcatttcagaaaccccggctgtcactttgaatttggtagttttaagaaatgaaagtaagtcagtttcctaaataaaacagtgtaagcaagatgaacaacattaggggcccttctaaattatgagactgtaactcaaaggggagagtgctcacacttcaaaatatgtctagaaattgtggtcactagagcactgttgcctacagctggacctaggacaagtgaagcaaaaatgttatagctacatgcttgctccctgcctcaccctcactcagcagatagtggtactgcccagttcctctccactttgttggtccctttttattccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcagacttcttgataccctcatatcttttgccttattccatagtattccctttcatcctatccgaagtctgaaaaagaagatggtcaggagccatggttaatataaattataaatttggagggacagggatacagaagtaaattactcaaatttttcttcctcttctccacaactactgccacaacttaccctgaagcactaagtctgatcagactcttcaatgctagagtttatctaaaacattttctatacttaggattctaaagttcttctagagacttgctttcagagacatggttgtaagcagagagttaaacagtcttccgccactaaatagtagtggctctatacttcacttaggtctctgtgtcctccatgacattcaaattttatggtgggttgggtactagatgacagacagtacagctatactggagccaccctaaagcaaatcaggatgtcatttctttaccagcctatgtctagtgtgggctggctgagaagtctttcagcatcttcaaaagacaaacacaagtaaaggatatgacagatgttattacctggatttcagaggtcaatctgaggtcatgcccccatgagagaaacaaggagtatacagaaagggatctcttggagtagatgagtaattgcttagctacctaagaaatcactgaatattcaggaggtaattcatatagaagaaggaaggcaaatgggatcagacctccagaatgggcattgaaatttacatggaaactgtcccagacaagagccagccaactgttgtgaggttaagcgtcacacaagggcttatattcagaatactatactaggcactattgggagaaacaaaagttctttctttcttttttaagtatttgtaatagcccttagcaatgcgattcaagtcagagagcagcatcttgacaaatgcaaaataatataacaaaaactaggtatgtaaatgctgatagaatgaaagatattagaaaagcctagaacttatttttgcatacgattgaatcaatcatgaaatgtaaggtgaaagtgttcttagtacctataatatctctccatcttcttctcccaagtgcatattaagtactatatgtaaaagaggagatcccattcctctttgctttccttgcttcccaatttcctaatggcgagcttccagagtagatcaatacatggccaaacaacccactggccttccttcatctcttactgtattttagtaggtggttcccttttttcccctgcctccagccattccaggtgtctctctgtaagttggttgccttattcttccttttcaaggacactttttgttacctaaccaatcatggtgtccaaatcgtggtcactatttcttaatctaatgacatggcaatttgatgctattacttaacacttattgggctacctgaattaatatcttgaagcaataatgcaacccaaactacagaatggtgtcccaaaagcaaaacctatggttggatttcttaaagatgttcattggaaacatggtttcttaagtctaacctagtatctttaggccctaagcaagcgagactctacttgtggtaaaagccttcaacaacatatgttaggtgactttgacactcactgacagccttaaataaacttgttctataaatgcaaagatatttatcctaggagttagtagcagacatcaatattctatatttaggaattttatcttcagcttattaaaaaagatggcacaattctctggtcatacctcacactagactggctagactggctttgtgactgtttagaagcaaatcccctctgggaaaataaagagaaaaaaaaaactttttcaataacattactttgaaacagcaagactcttgtttatttcagatgatagaagctttagggtcaaaaaggaaatgttctacttaatcaacagttccctcctcccattaaacaaaaatctgataaatgtttgattatttcttgtcaggtttggggggttttatttttaaaataaacacaaattcaaattaattttcattagggaactttttgagagtcgttgggatgactgaagacaccttggggttttgtaaagcagagtacagaagccttgaggcaggagagctggattctagccccaagctgtatgagttcaaaaaatcaatctctctacatctccatttcctgaactgtaaaatgaatctatggaatatgatggtcttttccagttccatcaggctatggttcccacagctgtgaaaaacaaggtaggaaatccagttcaagaaatattgattgattcccaacccattttgccacactcaatgctagggtgaggagaaaaggacatgtcttccctgctgaagaagcttgcaatctagtagggcgatatgtcaatgcaataattctagaagtcagaatataataaatatctaaaaatgtgtgaatcaactttcctgctttctcaggtttccaggctggtgaccatcattgatttcttagctgactgacactcttacacacctcaacatcagtgagctttgctgagacttggagacagagatgataggaagattgagataatgtatcttaaggccagggcacagcctggaagtttatcatttacctctatccttagaacacagaacaacaaacgtctgcattaaaaagagtttctggttgatcaaagctgtgccacatatgtatatataaataaatatggcctcagcccttctaggaaatacctagggaaaatccctattaattaagggcttctggtaattggattctgattaactgagatttgtttgtttatcataagcctatcataagttcctcattatatctatattcactgttatcctactactcagatccaacatatagtagattgcaatacagatgtattaaatcaaggccttttctcccaccctttaatgccgcattttagcattaaggctggtatcttattccaaaattataaaaatatggaccaattcaaatagaacaataaaactgatgcaaatatcctctttattttgagttaatcccatcacttaagtcaagtgagatctccaattcatactttaaaaaaaaggaaaggaaacactagccatatatagccatttcatccctccataggcagtgaatatgtttttagtgggcagaggaagaaagagccctaatacctcttacttcatatgacttacactgtgaacactcagttaagcctttgcagacactgagagattaagtcctatgagttagaattactagcttgtaaacattaatgaaatttttaaaatcatcatccagctttattaggaaattttcccagattaagagcaacaaaaatgtagcaattagagtgttcatcacacagctgcatgattacaggagtcttgttctagattctaacagatgctgtaacaaacagttttgtgagggctgcaagaaccatagtttacaaaagcaacacaaaagctagttattgttcaagctcacattgccacaggacccttatgtttaaaataatttacactcttgagctcctctactgagaggcatcaagcatgtaaatagagcaataacaaaaaataaaataaaatgtgcagactcaagttcttcactgcactaacatggaagggcaagggacattaattgatccgtacaaagttctggactttgatgagaccaaatgtgggaatcagccatggactagtttgatgtcattgttaccaagccaccacctggctcgtccagtcaaattaagctcatcctttcagggacagctttacttcagtccagatttggcaaggtcaaactatctctgctcaaaggttatgacaaattgacaagtgaggggcatcactcaatgggcccaggtgggggcttgaggagattggtgacaattagtgttacatcactaggggtggagccaaagtggaagagattcatagccagataccactattacatatatatatttagaaatatatattatatgtagcctcccaaatacaaaccaccaccaccctactctgaaaaagaatagcaactgatcaaatatttcctaaaggactccagtattaagccaacgactagcaatctggctgagttctatctatttcaagatcattgtgtgaccttgcacagccacctcacctttcatcatctcaggaacttcagccataaactataaaaatcctttcttgccttactgggatgacattaggatgaatcaggcaatttctctaaggtattctaagatcctcagagagggcaagtctacaaatacaaggtattataattagaatcactgcacctcatttcttaagggggagaaaatgaataaggaaaggaatgtgtggtcactgagcttgagactcaaaaggcatttaaaagctctttctatcatctgaggtaagtctcaagagagggaaactgatctggtggagtcagagaagagttcagtgaagaacctttgtgccacctgtgaaagtggctaggacatgctcccaggacattagaagccttcctgtttgtctttgacagtataacgttacttcactatgatcaccataaaggtttagatttgtgaataccaccaagagagtggcaagtgctttgattatgatgttgtaggccaaaaaggtcttgccttccgtagtgggattaattgttcataaaagaagaatagtatattcaagctcaagtggtttagctgaaattgttttcatgcctttaattatctcaatagcagaaatcatagctctaggtataactggataattagtggggacagagaaaggaagaatgggatccctttcagagttcagcattgggccagaatgcgcctgctgagcttaagaatggggacacagaaaaaggataactaggtgaacggatttgcaaatcagaacctggggattatgctatctaaaagacatacacatttgcaaggtaaataagagaaaaaccaaaatagagtgtgacctcagtaatactctgtcttggattaagagataaggatctagagacactgaaacaatggactaggtagccaacgagggtactgtagaaagcttcttagtgggcacttttaagtaccttgccatcactatcttttgaacagctctgagggtccttttcagtcctcttgacctatttcaaactactacttgtgcttaacttgaaaacttcctactcaacaaattgttcctcctgcttcctttgaccaacataaaatcaattgttgtttgacagaatactttgttgctgttttctcaaaggtgcaaaggggaaaaaaacaccttatttttgcacacattaacttaatttcagtcttacctactcaagcacaacataatccttcaaactctgaccgaagccccttcaccatttggtgtccatggcaaccgccaccaagccactcagagagttgcaagcagtggcagaaaagtgcatctcccaacagagccattagctcttctgcattaaccccatcaataaaaggtggcagcaggcccagccctgcattttctttcatcagggaggaggaatgttgtccgtgtttccttcccagattgtgagaattgggtgtggctacatctcacacccaacctgttgaaaataaagcattgagggtaaattactgcaactaagtcagaggacgattttcacttgagaaaacttcccactggtatgcttccccaacgactctgtcaactgcagcctccaccacaacactgcttgctaaactacagccagtaatcttaaaccccacaaagacaataaacatgaaatcctagccacttcctgctatggttcttagcactcagtgacctacaggtcatactctttgttacccatgtcaagaatgcatgcgtgacaatttcatgccatcaaactatattttatttatttatttatttattgagacagagtcttgctctgtagctcaggctggagtgcagtggtgtgatcttggctcactggaaccttcgcctcccgggttcaagcaattctcctgcctcagcctcccgagtagctgggattacaggcatgtgccaccacgccgggctaattttttgtatttttagtagagacggggttttaccatactggtcaggctagtgtcgaactcctgacctcgtgatccgcctgcctcggcctcccaaagtgctgggattacaggcgtgagccaccatgcctggccccatcaaactatattttttaatgaaaaagagcaatgttaataatggtctaggtactggaggatttatgagccaatagtaaatggtatggtttctccaaatatagacaaagctgttcagtctacaaactgtttttatgtgttccatattatttgctttgttcagagcttagcttaaaagttgtcagataggaatttccctttactgtactccagaggaagactaggatgtttcatggggatggttctgtcattacaacagaatccaacatatctaacagagatatttttgcataaagagaaccatctcagactaggttctttgtagaaactaaaaaggacctactactcaagtatcttcttcatagaatctacataaataggaataatatttagagtagaaggaacaagtgagtggttttatcttctcaaccgcatgaaaaagaaaacagaaggctattatgcacaatcctttccagtaggtcctctgaaatctaaggaaacaatttcaagctctccataaaaagcaagacatcatgactaatcacactgcctatctctgtagtcctggataaggactagtaaagaaaaagtgaaaaaccaataagacatagttccaggcctcaagaaactcatagttcatagggaagcagccaagtaaacagatgatcatagtctagtgtgataagagcagtggcagaggggaacacagatcttaatggaaatgtagaagaaacatcctaactcagcttgactcagatcaggaaggcctttctcctcaggattggttgaactaagtttccaaggacccattgaagatcatctggtttggaaagggatggaaatgtataattgcataagtatgacaatccccacttatgtgtcagcatgaacgctagtaagaagtgctgattcaaaaattgaaactgactcagatgtcataagacagaacagtaaaacctgatactaataagaatacgggttatactggccagaacacaacttgacctttcatcatgacctttggatcctcaagaaacagacattttccgtctgccagtacactaacatggtatctgaaatgagacgattctgcttaggcattaaaccacctcccttcattttacagtgaagaaactggggtgctgagagagactgacatacataatggccacacaactagtgagtgaaagagcaaggatttaaacacagattttactccagtgctcacactcttggtgccacaccacccaagactatgccattacatggaccaaataagcatctatatatgggttcacctgaataggtcacctgccttcttacccccatttcacatcccacccaactgtctgtaattagcatttagattaagatagcctattcacatgaaagcatactaaaccagagagataaaatttaaagttaatattacttcccacccttcttcccagtttttggagtcctttcctttctcattatccacaaacattaattgtatatctgcatacaggcaactgtactggatgatgtgcactctaagaagtatgaaactggagccctgtcctcaaagacatatcatttaattgggatggtaagacatgtgccctaagttgggtaaataattagtagactgagggaaagatgagaagtagagattatataggaattcacagggggaagtgcactagacaaatgaaccagaatataaggcttcatgagggcagggtgttttgtgttttgttaactgtcataccccttgcatctaaaacagcttggagcttagtaagtactaaataaatatttgttgaattaaataaatatgcttcttgacttgttttaggaaaaaagtcctgatgtttatcatttggagactaactctcagtcctatatgcattccactttgtggattttactcacggtacacacacagcaggagctctctagggagacttgtagaaatgactattcaccctatgatgacttaaacctttgcaaaaccctagcaaagctgtgttctctgctgctccctgccacggatgggtgtttcccagcgatgaaaaacaacagggagccagagctttttgtttgtttatttgttcattatgacctcaagctcttttcagcaaagggcacagaccttagatagcaatgcaattctgggaaatacaactccattatttgcttggctcatctaacaagatagaatgcagactctgatttaaaagcaagctcctttaatgagttttagttagggttgatggataaacagttgttattactgtcagtaggcacaggttgtaaatgtctgttttcaatgcttatattccattacagggaactcagatgggcatcagaatacaatttcctttaaaaggtggaattaaggggaaacaaaaaagcaatttcaaatgtggtcattttgtgtatccccagatggtcaaattcttggtcttccaaggctccacattgcgttatgattttttgtaacttatttcatttttaccattgtacaaattcttattacttttggcttcagggcttggaaagatacggacaattagaatgtatcagaacactgaaaggaaacccaagcattcattaaaaaaaaatgagtgaggctaaacccatccttctctcaccatggcttacactaacctcgcagcaccacagtctgtgccagcaggtaatttcaagtaaaagatctatattaacacaaatggagaaggatctgatttcataacaaacaatgctaaatttgtgtgctctctgatttcctccaaaagcttagaaagccaaaatcgtgttcagttctgtgggtgcatctaagaaattagaatatcacgtaccaccatacaggtattgtgctaaacatattgcccactataatcctttcactttctgagaggtgtagctcagaaggtacctggtttatcacggagtctaaagaaaaaatgagaggccacacctaaagcaggcttatactttaaaaacaaaaatgttttattaggaaactttcctgaactaaagcaagagtaaacactgccttgtagagctttccatatttttcaaagatttttcctgaagtagcttcttcatcctctgaagtagataggactaagagtggggttttttttttcattacatagatgagaaacagacataagaaggttaaataacttgcctaagaccacatggttaaaagcactaaattttaatccttatttcctaaagacctagacctattttatgtaccacatctaaagggatgcatttggaaagacagcaatgaaattcttgttatacaacattaactatgcctgccccaatcagcgccccctgcttttgaaaggtatagctatagctaataacctttactttgggcttggacatttctctttaccccatccccactctatttcctgaaagaacaattaagatccatctgggactaattatagcgattcttgaatttgaactcgcagccattacccaattgaggtcacttattttaaattaacttgcctggtcagaacacaggtttggttatcttcagaacccagtgcagagaggtaccagctcactcagacttttaattaactagctaaataacctgcactgtgacaagctgcctatgatttgatggactcattcatttgcattcagacaaggatcaaaatacattgtcagagcttcagggactgagtcctagaaaccttcacagtctcttgttaaaggctgtgagccacttccctttggttcgctctagttatttttcctgtgcttttgttctgattatccaacattcatcacaagtgcagcttgtgattaaacaatgacaactcatgtcatatgctgatagggaatcgaaaattggagccatgatcatatgaaccaagcacaaagctttgcaaaataattaggggaaaccaaagggaattccctggatgcccagcaacaaaggagaatttccaaagtttcgggccacaactgttccccacttaggtaataatacataataatggtaggtactcagtctttttttaattgaattcatggtgggagctgaccatcccacaatagtagtgacagttgttatcatcaataattattattacagcttccaacatttagttcctgggttcttgagtcagataaatcagattttgacttcaagctctatcattttcagcctgtgaggcatgagacaaattatccaacctctctgtgcctcaatttccttacctggaatataaaatcaataacaatgcctaccttaaaggattgtggtgaagcttcaatgagatgaagtgtgtgaaaaaatcgtttaacaccatgcgttgtacataacaaaagctcagtacattttagctaacgtttgtcttgttacatcccaccaccaggtttttatccagggcatctttccacctgggatcctctcttctccctgccagcaacagttcccctcatcattcaaaacctagtctaaagatccttcttttttctccagtggaaagccttccctggttctatcccctgcatgtaaacttgttcagtgcccatcctttcagtacactttctgcaatacacttttcagattttctattattttaaataggccatcttctactgtttcataggcaatctggacttttcttcaggatgtactattgtttaagacttccagaatatttatatagataacatatacagagagagagaaagcaagagagagagagagaaagacagagagagagagagagagagagagattgagcatctcattcagagacagagagagagagagattgagattgaacatctcattccattgtccaggctggagtggcgcaatcatggctcactgtagccttgacctcctagtctcaagcgatcctccttcctatgcccggcaattttttttttttttttagagatagggtctcactatgttgcccaggctgtgaaacatttactgagaactactccagtgccacacactggggctgtatgctgtggagtacaagagatgagtagagatagggatgggagaatgggaagcagcattggttgaatccccttatattgcagttgttctgttaggaattttaaaagcattttctcatttaggtctcacaataaccctaaaagtaagtgtcctagttactcttaatgtacagatgtggaaactgaggttcagagaggtaaaacgacttgtgaaatatcacctcatcttggaagaggaagaactggtcgatctgactccagagtgcactcttatcattaactatgctttactgcccaactcacagttttgttttgttttatcacttgcagtgttgtatgtcaaagcaatacataaactttaaagtgttacatatgtgacataaggtgattgcagtgtagcagatgctgttggtgccctacccatatcccctcagcactaacctttcctatacctgccaaaagcatcctattgtaggcacatgctgttctcctcttgaagactttctctcagcctgggagtgagacaagtcagaagagtgagggaggaattaatatttcccaaagcagttataagctaatggtgaatgggagttgaaagtcaaagaccccaacttcctggcccttttggtaggtgtattgtccatcacctccagaggtcccagaggtaatttgctgattaatacactgttttgtcacctttcttctccctgtctcatttcctcgctcccctactagttcttcatagaatcacttccaattaaactactggccctcaaatctttgtctcagggtctgccttcaggagagtcctggttaaaacaacaatgtttcagaaattcttttttggctcctttcccaggagtctgggtgaatttcctcatgctgctccctgcctacccaggactcaccatgggtgatccctaagggaccacctcatagactcagtgtgtcccttcctatccactttgatgaggatcccatcattgagggtcctgcttttagattttcaaagtgcatttattatcagatggaaaggtggttcttaaatttcagtgtgcatcagaatcaccaaaggtgagatgttaaaatgcaggctccctggccctaacctagacttgagaattagagtccctggagaggagctcaggtgcttgcattttctagattccccaggtgatccacatagtgtacactttgagaaatactgtcctaagacatccatgtagacttggcctcaagggaatgtagattatgttccttagtgctatctctacctccaaggcctctgtggagtcaagtaagaaagcctggaatagttatgcttccctgctcctataatgaagcacgaataaggccaagagctagatgctactgtcagagtagggcagcccaagacgcctaggcaatgttctacaatgcggaggagatatgcatcttactgactgccaaattattgctctcacctctctcactgcccacccccaacccctattctcccctgtattggaaacactgtgatgactgcacatgcccagttaggttatgacctgtgctcctttgtctctgagtgggagccccccttcacaacacacacacacacacacacacacacacacacacacacacacacacacacacacctccttcccaaacaaggctactgtagagtttgagttcatggttttgatcaatgctaggggcgggagaggatggcgcaggggaaggtggcagtgcgggttactttgttgtcagtttacccccagcttctcttctcttgtcctttttgcactctcagcataaacgcccaaactccaagtacaaacctcaactccttccctccatctccagcccagtgccatcctaaccagtggccccaatactcctctgcacctgagtaatgatgcctttccacggcccccatcccacagcagcaggaaacctcttctctaccttttgagcttggggaacaaaaatcagggaaggcttcttggaggaggttgcatatgacctgcgccttgagggattgatgtgatttctacagagagggatgaagggaagaggcattgaaataaggagtaaggaagggagagcataactaatataggataagcattgggcaatctgttaagaactatagatacattattttatttattcctcactgcaattctatgaaataggtactaatggtagacccattttacaaataatgatactgaaacccagaatatttaagttgattgcccaaagtcatacagcaaagtaggaattctaagccaggcagtctagcctgtactcttgactaccctactctactgcctctcgactattgtaatccttattttacagatagaaaactgaggttgagaggttaggtaacttgcctaaagttacacagcttataactggcaaagctgggatacattgtctttagcagataccattctatttactatctaatcattcataccctctgtaacttagcttttttcaccaatcatttcagtcaccactccaattcttatggagtcagccctggataccatcacaccaaatgcttatagttgctcccaataaaaatctttcccctagtgtgtaagcactgtaaaagagcaaggctcttctgaaatcaagagaaatagccctctaaaacacatctctcttcattttcaaaatagcattctgtttaagttacctgtttgtcaggttcccacttataaaagctacaggaaaaatttctctagatctttagttggagacaaagtactttctatctatagcaaattatgagttaatcattctctcctcagttgtaccttgtacatatttctgttcttgcacttctcccactgggttataattgtctgttaacttggctttctttcccactcgaatgtgagatcctccaggctaaggaccaggttactgtgacctctgtatctccatggtccagccccagaattggcacagagcaggcattcaaaaatgttcattaaaagaagagaataatgaaatgtggttaataaatgcagcccttccatccacttgagattttaatcaatattctttctgaatccagtggtatgctggaaaactggctcccagagagcaaaataaaaagccctgatttgtagtattgttcgatttttgtggtgttagtactctcatcatggctgatttcaagcaaccaatggtttaataactggctcacaaaatttctgaatatttaacaatgggctttcaagagccccctgtatttcgctgaaagtctataattctgcctagggtgcttgaactgttagcgtgtcagtgtgatcagaaaggtggatgagctggcagagtggggaaaataatgccagatgcaaatagcaggagcgaaagaccaaaccaaacatttgtgaattaagagaattctgtgtttgcctcccatgaactaagcctctatcatttgtcatccatttgcaaattgagatccacttaaatgacatggctcccagtagaaagagaaatctgccaagtaagcaactatcctgaaaaatcaaaggcccaaagaacacattaggtttctcagagatatttacttttattcgaaaatataaacatgttcactcacttctttcagcaatcagaaaatctccatagatgaggatatcaagtgctggaagcactgcacagatggaaaatgcatagacgaggcatacctagggagttcaaaaggagaacatcccaccctctacatccccatatgtttctcttccctccccactcggaggctccattgttctaggctggacttggtctctaatacaatatcctaccagccatgcttaaattttgcacacaataatggaactaataagtaaatggcaggatttaaatccagaaccatccgacttcgaggtttatgtctctttctagtacatcacctttaataaataccaatttgtttgcagctttaagggcaactcagataacatttataaagaattttagactcttacaagtttaaacactgtaaggtatcattttaggtgtgacgagttattgatcctaataaaaacctaaagatggagaggtgtgactcttgagccaatgaaggaagtcttgttttatcccacccaccctcaagtagctgtggctggaaataacacacatttgagtaactactcagccatatacccgatggtgccattccttaaaaaataaaaaatcaaagtaatgagttcactggcactctcaagcttgctactcagtacccatacagtgctttcagtatatctgtcagatattcatgattatattgctttgggcccaaatgattttgcaaagtctatagagaacacaaagatacaatttgatatttagaataagggtgtcaatattaaaaccaaacattgttgtgaatgtgaatatagaaatatataaatagttcacagtaaatttcacaaaagaagatatcaggaatgctgtaatttaaaatttactctctaaaataaatttcttgctaatttggggagatagctaatatcagagaagctacagaagtcataaacatggtcgtgttaaagaaaaactaatttccctttgctgtgatactctagattgaatactagttaaaaatcactccaattctgccttccaaaaaaaatctagaatatttccaaatataaacagggtgccatgaaaagtcctctagataaggtactccaagaacagcatttgaaaatgcaacatagcttgataaagcatcattttacaggatgctggctggtggaaagatccaggaatttaaagtatttactgttggacccatgaccaaggactctagctgatcaaagctgcaggcatcctgtgtgggaaaatacatgtaaattgcctcaggaaatggttttgtaagtttccagattttttacacagtcccaggcatcatttgctaccttccgaactctgtccatcattttgctcctttacaatactcaagaagatttgaaagtagatgaagatattcttaaaatttcaaccataaatgggaaactaacctttcatcaggacagggaaacctgatctacattctctcccctaaagatatgatggctttaaggcaatatttcccaccatccctggtggtacacaagaggattttcagtgacacctagatgaatacattctattttcatacagttgtatttattttcttgtattagtgtcattgatattatccctctggacatgactagatttaagtagtgactagctataaaggaaaaaattaagtaaataatagtcatgtgatatgcagataagacaaaaatcattaaggacgtttgtgaaggagtgaaatttgagaaatgctgttttaggattaagacaatgaagtgttcccacaaaggtcaacatgtatttaaatggctgtttatccccaataccaataataatctgttgctcctttaatttattcatggccatttattgcctcttatttgcgttggttctttgcctctcctgctgtttagcattaaatcttccatgtattccattgagtcatgatgaatgcaatgttaaagtctggaaagtgaaacttcccaaagacatgttctttggtgaaatccttgttctctaatcctcacatcctagcattttatttgatgccttattcaattgccttctctctgcataagcttccctgtagatagcataagcattgatgagattcctcggttatacttccgttttccttctttacaaaaagcttcagcctgtctttctccatctgtaccacccccacccccattaccattgggctgactttggtatgggtgattggctcttctctgcctcactaatccagcacatttattcaagtcagatgactgcaatatgaagcattgtcattcggtgataggagagcatgtgtgtgcagattaagattattagaaaataattctaacagaattgacttctggtatgtatttacgaagactcaggcaatttagtaccttgggggttttattcatgaagatgaatgccttttatcatatggaagatttcttctgtaaagtatggcatgttttaaggctgatttctgtagcacacctcttattcaacttccaacatagccaaatgtaaataggatgccataggacaacagtatctttttaaaaaaaaattaactaggagagcaggaaaaaatgaagggggctgaaaaatatcccctctttgaacataaagaatgtggtctaatagctttttcttaaagagaaagtattcatacaataaatgaagaaaacttggtgaattaaaccagcaatcccccacacccacacttctctcctagcccctcagacatttgcaggatgcctaaatcaaagagaaatagagtaaggtgagcatcaaggcatgttgttctgtactcaaagcaagatcaatctttatacatagatccttttttggcgctgatgtagaaaatccaaacaaggagatacttaggtctacaaataacctaatctgcataccagatggatctaagggggaaaaaaacatacacacttctccacacacatatttttttctaaaatgtgagcatagaaaaacagatgcttttgcctcccaacggatctgtgggcctctctcaagtagtcttgtggagcaatttcatttcaaatttctaaaattatgaaaatgtctagattaaacattaaattgaaaaggaaagggcctcttacatagaaaaccaaatgaatattttatgaattatttttaactgctcagtgatacccaacccccagtttcacagatgagtggatatggggagggggccagtaagaggaagtctccccagaatgggttgactatgattcactaacttctttgacaaataatttgatgctatatgcatcactctgtgtgttagtatgtaagagctctttcttctacgaatgaaactctactgataaagcttcagtgaataaggattgtggcatttttttctttcagatcctatatgtgaggattaaaataaatttccttaaaacaataaattttatctatatttcacacatttccccttattacatttaatatatctgctatcatatcaagccatccatcatctccaacaaatcttacaaaagcaaagtgaatacagaacatggatttggaaacttgctatttcttccttaaatttcatggtcgactgtaaaaacagcttttatacttgaagttctgcaactaattcagaaagagctattataattactgtaaaagcaaagttgaatattcttttggttaccagagtcattaagtaactgagggtacaatttatgccttgttcatctataacagatggaaagaacaaagatttagggtgagctgaacaagaaccactcccattaactagttccattatgcatcgcactaagtacaatcctcccatcccaccctattcccataagccctgtaccaaaaattcaaaaaagggaaagatcaagagcaaaacatgacactttttgtggtgagggctcctgtagctcacatcagtaggatcatagctgctccacgtaagtaagatttcaagataactgaaatttactgtcttaagtattgggactttgagcatttcttctggaaaccttccctaaaatatgcatatccctgggtttttcagcagagattactgaacacaataaaccatagcctgatgacttagggaacatccatgattatactgtgcactagtatgatgttgtctcgttttctcatcccttctttctcctttaagtcagtctgtcacttccactgctactaatgtacctctttctaatatcagtccctcccttcacacacaccctttctagtttgcagcttttaatttactgtgaactggaaaaccaagattggtaagaactatatgttaagtaagagttaaggcactgaaagcaaggatgaggaattaattatgggcttcaatacatcagctttgtgacactttaatgttcctatctttagataagcttcctatcccagtttaaagctaaattttgaaagggtgttgttataagacagctaccttcaaataagtaaatttgttctgagcagaccaaagtgggcctgaattaaagcagatatcttgatagctccaagtttttctgaacctgaaaaacaatgtctcaatgaatgaccccttcccacatttatatagcatcacacacttaaataatgcacatttcaaacattttttttttttgagatggagtttcactctcgttgcccaggctggagtgcaatggcacgatctcagctcactgcaacctccgcctcccgggttcaagtgattctcctgcctcagcctcccgagtagctgggattacaggcatctgccaccacgtctggctaattttgtatttttagtagagatggggtttctccatgttgttcaggctggtctcaaactcccaacctcaggtgatccgcctgcctcggcctcccaaagtgctgggattacaggcgtaagccaccgcacccagcctcaaacacttttggagacattatccagtttgatcccagcaacacttctgatataggcagggccagattatagataaggaaatgaaggctcagtaatttgcccacaaacaaacaattagtaaatgacaagactggggtcctgggttctcattcactgttcttttcacaacactgatgtcttctattgctccctctcatcttctctacacacaaaaaaacactaaactctgcctctgatgaaaaagacgtattccttttccttgggattccttccttattcccctctaagcattgccagatgtctttaagaatattgctcatttttctagcagaactcaaaaccctctggttttattatgttgagagttgtcagttaattaaaaattcaacaaatgtatggtcccaacttgccaccaaaagttaacaaatgtcaccggcaaggatgtttctcgcaagcggacactgaagaatacatcccagaagatacctaacagctcattttgtgtcatggaagcatgagaaatcacatcctcaagacatttattaacctttcatttcctctataaataatcagtcagaaatgtggctcataatttaaattaatcaaaaactgctctcttgtcctctctctctctctctcatacacacacacacacacacacacacacacacacacaaacacacacacacacacatacttaaaatgacttgttgaaatgacttgagggcttgtaatgccagcatcatagtcaaatgtatggttccacttctctgggtcaacttaaacattgcctcgtccatgaagccttccctgttcatatcaggccttaaatatctcttcttcctcttgtccaagactttatagcaattactagcatttgctatttagcatatatttagaaaccatgtgaagtactgccaagagtatgggttctagaggcaaatggacccagattccaatcccagctttaccgcttcctagctgtgtggccttggaaaaattacataaactctctctgactgaaattcctcatctgtaaaatgagactaatgatacttaatctgttaaactgttctggggattaaatacatataaagcacttagcaccgtgcctgcatatactaggcactcaaataaggacagttagacttattattattacaatctttcatgtatagttctggtttgatatatgtgcaattttgaggccttctcactttgttctaaaccctttaatagctgcatccagagagaaatttatcataaagcttaagcttaatggcccctcacttgcatagcttctttccaaggccttgttccaaattatgacattcataattttatatttttttaaagaaagatcctaaaattgcattagcttcaggccagtacaaaacctggttccacctctggttgtgtctttaacctctatgttatcctgttccgtccatgggtactcattgtagtactttgtacacagtcagtactcaataaaaatcctcagttagccagagtttttggtgaatttggcttcaaggaaataaacatcaattatttagtcaaaaacttctaacttctaaccaatacatttgattggaaaatattcagcccactcacatattttgagataataaaaatgtacttcgtgaactgtacaaagtacatttttattaatacaaagcctattattagacttggtactaatatagcattattcataaaaattatggtaagaatgatgatactgaggaagggtttctcaaccttagcactactgacattttgggcctgagaattctttatgtgtgggctattccaagcattgtaggatgtctagcgacatccttggccattactcactaaatgctagtagcacccttcccagttgtgacaatcaaaaatgtcaccaggcattgccaagtgtcctcgagaggaatccctcctcagtgccctaaggcatcatgatcagcaccaaaagatgtacaagcgattacaagtctttcaaactaaagcaggaaaaggaagataattattttagaaaagttttcaataagcaaaagcaacctcggttaacctgaaaatcccattaaccccattccttgaatgttctattcccttagcattccagataaaaacaacaaaaaaaaaatactgtacattctattttctactttgtatgcaaagttcagctgattttccatctcaaaagctaagtacagaaatcgagttcatgagtgggggatcttcagcttcatcacttttgccatctattttaagtgacagtgatgctattgacctgaaagtttagggagtttttttccccttgttttgacattttaagtttggtattagcaagtcttcctgttttatctagttgaaagcgaaatgcaacaacaagaaatctgatccaattaactgtgattttcctgtatataaaagctctaacattttgttctagccaccccactgattgtgcaattgaaaatgtccttcttgaataagcaatatgtcttatttcttctttctgcaggttgtgatcctagggaaacactcaagaggttatcactacatgctcgctaacctggtaagaacaagcaagtgtccctgggcaatatatcctatttagtttgaatttttctgtaatcatccaaaaaggaaatacatcaagtacctaatgctttctccagaaacttggagaaatgacttcggtaaataccaaaacctgaatgcaatagccttgctttcaattatgctgtcgttttagctgtgaagcagctatattctttcctaatttaaaaaataatttgatatgattcattacttatttttagattcaatttcggtttgaaatgtaaactattttaattgggtttgaaagataaaccatggaattggggacacaggaaactgactctttcccaattgattcaagtatatgtgcagatcagtactgcatttgtcctttcagaagcagaccactaccaaatctttttgagcagatgtcagagtaggtttcaacacagtacattatatgaccctgccaaagtgtatagccacctttctacttacataaaacacaacttgaatctttactttcaaacttcccatgcctttaaaatttgtgacactgtagaagctagtatttcattaaggttattttatacattttctttctctggaaggacaatttgtttaggaattaacaaaattgcttctaaattagtaatatctgtttggcagaggttctgaataataccatctccatgaaatgaaagagaaatgttaaattatcgctataatactaaaaatctattaagttattacatgagttctaaccccaattttgtttcattagcacaagaaaatcatgatcattgtaaagctcttaagccaaaagaatagaaacaaaggtgaaagattattgtaattatattcttatattttttaatcaaagaaatatctaatatcttattttgttttcataatgaatattttttaaatgaaaaaggaaatgttacttaaacctctttcttaggggtatgtgcattcaaacactttataagatgcagattagagctactgctttcaaatgtagtgtgcatttttctccaataatttgctctaagtggagcacttagtccattttgggaataaatgaatctagtcttttagaagaagaaatcttgattcttaaattacatccatatattttcaatatggtttttaggcaaccaacaaataaaggacttttttaatgcaatggaggttaaactgtggcttgtcaggatatatggatgtcacaacaaggcacctgatacagttattgatgactttttgtcattactttctcaccagaaaatattttgctctccttctttccttcctttctgttttccttccttcctttcttctttccttcttttcttccttcatctctttcccctttccttctcctcttccttcatctctttcccctttccttctcctcttatttgtatgtcctagaaagcagcaaggtttatagcacagtgtttaaaaatgcagggttcaccaatcactgaccatacatgaggtgactttaggtagtatacgcacgcaaacttttttattttaatgaaaatatatttccttactatgtattagaaaaatataaaactagcatatcaaaattgaaattgtatagatactattacttcaaacagggctaaaatagagatataacaaaagtaaaatatgtttttaatgttcaagtaaacaatagcaagggggataaagagatatagcaaaatctgggttttgcctacctggttgttttatacatgaatgactaagtttgagatataacattgaactggggatcagaaagtttgggttgtcaaactgactttgctactagcaaggtaagggaccttgggcaagtcacttcaactctacagacagtgttacaattccattactttaactcaggtgggagtggtggggggcagtcattgatgtgtcggatgggtcatttgaaagcagataataattagaagtgcaagatatttattgggagtaatacctgtgaaagataaaagggaaagggacataagtaggcagggagagcttcagaccacaatacaggtctataccagtaacagaagggaaaaggaagcaagtttaataggaaaagcttcagactgtgctgtagcattgataaaatcttggccaacacaactaggagatcagttcaaaagatagctcatagaggagtcctatgcttcttccaaatggcaaatcatttcatcccgactttgctcagtcattagctggcagcagcccagaaagcacacaccttccacttgaaaaactgaggcagatctgaaggtacctgaagctggaggttgtcagctaacttaattctttgagacagattttgtcttaaagagcgatctgagccgtgcataagaatggctatctcatttggcctaccatgaccgatgatctgtaaaggcctttcccattctataattccaactgggtctccttatttctactgacaaacttttttattttttttatttttgtgggtacatactagatgtatacatctgtgggttatatgagatattttcatacaggcatgcaatgcacaataaccacaccaggataaatagggtacccatcatctcaagaatttatcctttgcctactgacaatcttttaaatcagcttttattgcaattttgagatccagacctgacaaaaattaaagtctatggagtgatagaactgaaagagaaaaatcactaggacaacgttgggaaaaagaatggtaaactgaatcctatacacacaactcagaattatgagactttgggggaatgtctactacaagaacaagcaaagtctgttcctttaaaaataaagtaatgtatagtatgatgtcagtctaagtaatgaaaatgtgacttcctttaccatgctttgagctgccaccctttttcttcctttagtgaccctcttttcatttgaattcagccgtgtaagtccctgtactctatatcaaattgcatttgggtaatagagataggagctgctgttcatctctgatgataataataatgagccaaattatccctactatggtccatggttcccagttttttcaaagcagataaaaattaccccaaatgcctccatcaaagacagacagagagagagagagagagacagagacagagaaccaaaactatttagaagtaagttggatggtcaagaaaaggggaagtggagataagaagatgtttcctttcaagatgagccagctggatgaaagctgagggtggatatctatatacaaaagagcaaagtccaatgtgagtcttggtgttacagacagcacaaaaccactgctttcttctacaaatgtagagtcaagaatatttaagctacttaactaagcttcctggaatcacttcctgcagttccctttgatactgagctctatctggcaaagacatctttgtacatttacatggaacttcccctggtaacaatcctaaagtgagaagacttggatattccatgaatgctttaacgaagacctctcagaggtcaagatgtacatttcagagtggacaatgagctgcagaaaattctagcttgttgaaatcccggaaagaaacagaagatttcaccaggagtacaacccagagatgtgatctactcaggctagaagtggacatcccaatagagcaagtaagtctcttagaaattcttgtatcagttgatgatgtcattttttaggagttgttctgtaattaattgttgttttatcttccaggactctctctaacatggcgctgtttgtcaacgttagtcccagaattagccatcatgtgtacaatctgtcagtcaagcagcctctcaatctctcatggtaaggtcctggatctggatgctttacactgcattgtcaggcatgttatgtaaagtgatttagtttttttcacctatgtcagtaatgatagctcagttactgtgtgtagagccctagagtaatattaggaatagatgcaagggcaggaggcagtgtggtataataataataagaagaaaaaaaagcacgaggctaggaggtaggagtcaggtttgaatcccaagaattcatctaactagctatatagcaaaccaaacccctctgaacctgattatcaatctgtaaaatgcagacgtagacaagatcagtatttcccaaaatgtacatgagatgattttagatactacatagcaaaacttctcttttaacttattagttttgaatgtatattaaatacatattggaaaaacaactatcccagcaattctgtgattttatagataccattccttagaatgaggctaaagtagatatatagataaaagaaactcagtcaatgtaaataaaaatattaagtaaattatagttcggatggtccacctctatggcaaaaaattgaaaaggtggtatactaatgactagaatttggaaaatacaccactgtcgcttctagatctacatttcttccctcttggagttcagtttgggccagggtaggccaggtgaatgctgaggacacaaacagggaagcaaaaccagagccccgttatccttggggatataaagttataaggcagactaaagctttaaaatcagtccaagggggcaaaaaccaagatagatatgagtattcttagccaagttctaagcagagctgaggatctgaaggatcaatcaaaaacagtctagcagattacacagggcaaattggatctggattgaatgatccaacaacagatgttcatcactccccaaataagaccaaaaacaaaaacaaaacaaaacaaaaacccacaaacaattgaagtgcccaggggagaacatgagccatagcagggctcattcagtgttgcaccagttaaccactgccttagaagacctgacattttccctgcctaggttgatactggtaccagagttggagacaattgctgaccctttaagtggaggaatttaggtaatgtctgctgttagcagtagagagctacaggcaatcaaacaggtcattgtgcaagaagagaaaatagaagaaagttcatctatcttatattcctctctgatgtgttagctgttttctttagactttcatttaattttctcagaacttctatgaggagagacttcttgcccacccaccttcctaagccttttacatatcagaaaatggactcagaaaatatatataacttgcccaaagtctcatagctaatccattgccaaactaagttttctatctagattggtaacactcttagtagagcacctcgctcttcccactttacccacccaagcttctcagtgagatagaaagccagcaccacaaaggtcacataaaagcatttgcaaagacacaaatgtaaataaatgaagcacaagctctaaatttatgaggatgaagtgatcagagataaaaagggcttttaaaaacaaggacacgttgggccgggagcgatggctcatgcatgtaatcctagcactttgggaggccgaggtgggtggatcacgaggtcagcagttcaagaccagcctggccaatatgatgaaaccctgtctctacttaaaaaaaaaaaaaaaaaaaaaaaaaacttagccaggcatggtggcatgtgcctgtagtcccagctacttgaggggctgaggcagaagaatcgcttgaacctgggaggtggaggttgcagtgagctgagatcgtgccactgcactccagcctgggtgacggagcaagactctgtctcaaaaaaaaaaaaaaaaaaggacacctttgtgaatctggttttgaaaaaaaccatccaaaagcccaacatgaactgtatcttaacaggcatcaattacatccccatcactccctgctgtctaaccattttccttccctcctctctctctctctctctctctcacacacacacacacacacacacacacacacacacacacacacacattttcattccccttttttcttatgcttcgtcttctctctccctcctcatccaacctcacttatgccagaaaataatgatggaaggggggtactagatgacatctaatttttccaaaattttactaaaacaagagcattactcataagattgaacccaaacaggcagccaggagcttcaacaagcttgaggaagtgaactctgcagctcaccagatctcagaatgtacttgaaaaacagaagggcctattttgcttagagagaaaacaagtttaaataagatttagttatgctgttttgcttgccaataacaactattcccttctctcttccccttccaggtcttcttcttctgttctctactttccctttctttgttccgacattttttatgttctaaataaaaaattcaaatgctcaaagccacgtgttgtgatcactgacacctcagcagatggcatgtaaacacagagctcactgggctggagcctggctttgcaggcaagggaggtgggcttgcaggtaaaaattccccctggtcccaaatgccagggagcccagtcacctctcctggtgcacaacttctctggtagctcaggattcactttcttctccaaatggaaatggtacatagaacaccaagggaatgaggagtggggactgggctggtttccaacttcctgccatgcatttcaaaagccacaggcatttgtcagcttaaagttgcgaactctgagactcctattctctctctcccaaaatgcctttattatagtcaaccactgcactgtgtctctcttctctctctcccctgcctgaaattaacaaggaaagatcatttcctacccaatgttatagcaagatgaattaaaagcattttatcttctccccaaactctcagattatgtcctctaaaacagtgcttcctaaactacctgtgaagaagaaccagtttttccccccaagatcttcatggaccagtaaacatgcaacaaaaataaattacttaaaaaatgaaataagcaaaataagatatataaaatataagttcagtatttttagtattacattcaatagccattatattaccctgtcaagttcctatgaaggttggtaaagacttaccctccatttctttccttatatcatctcagactggtaacaaacaatgaaccagcaccagtctgcacacattttgagtagcactgctctgaaggtctttacagtaagtgtttttttctatatataccactgtatgtccaacaacttgttcacttcacagcaaggaaaacagagtgtattgtccttaagaaccttataattgtattgttcagaccagacttgcatagcttatgataattgccactgagatagaacaggtgctgggacaatgaataaagagaaggcagattgtggaagtcaataccgtggaagtctgcatagtgtagccagagaaggcctttcagaaaaggtgactttgaaaccataatctgaaagaggagaaagattcagctacatgacgaaacagggagagttcatgcatagggaacagtacatgtcaaagtcctgaggcagaaaacagcttgatgtcttccctgaacagtcagaaggcaattttgggtagagcagaatgagtgacaggacagattagatgccaggtggaagagttttacccttttttcaacagcaacagaaggcccattgaagaatttcaagcagggaaggggtatgatctgatttatgcttttttaaaaatccgtgtcaaatggatgagttttatgtgatataaattatacctcaatgaagctgttagtaaaaaaaaaaaagagagagagagagagagagatcagtggctatttccccattaatagaacttatgccacgttgtaattatttatttattcatacaaataacccccactgaactgaagtgccatgagggcaaggaccaagtttgagatggctcgccattgtaacagctagcacttaataggtttctaagtatgtttgttggtcagactagagaataaaatcatgagtgaacaatataagcaacttgtaatcaagtactaatttatatggtgtaattgtcaactctacacattgtatcctcccaggaggatggatctgctttctagaaaaagacttgtgtctctcattagcaatctgacaacttgaatcaccacaattactatgcatttctttactgaagcatcacccagatgaacagtacaaatggcaccaaaggcagagccagtcttcatccaaaatgtgagatagatagttgtctttggcagccttccaaccctcattctactgcttttatctttcctataggcaagccaccttttctcacccataatctatcatcaactcctaaaagtcacccaacttatcttgtctctgttttccccctgtacaaaatgtgccctaataatagtactgtatgaaggaaaactccacatcataccttgaaaataaatgcacttaatgtaagccttggatatatttatttccaactctcaaatatccacacttccaaaagtaaagtgaaattcagtatgtgaaaatcaacaaagatgggataataccaaagtcatttggatctttggaagactgaattgtcgggctattctcaaatcatggatggtctgtgtttggatgacagttgtgtaaccagtgtctatgtgaaagatggctttggagagttaatcaacagaagcttacaagaccctgcatgaactgcttaggcataaaggtcatgttggttttatatagctgcattcagatgtgagcaaacatgcactgatcaaacaaacagacatgatatgattgagaagtggtgcaatttatgaaatatagcagaacctacaaatcaaaatgggtagtttccgtttcagaagaatcacttctggatattatacccatatttctaacaaatatcaccattgttacacagaagcagtcaagtgtacagaaaacttagaacgcagagagtgagaaagcagaatttcaattcaccctatctatgagcagtaggattgcttccaatctgtccctgccttctctcatatcttttaatctcttcccactgcacacaaagattaccgttcaaaccaaagaaaaggatactaacatggctagccaacaaaaccattgattgcaaccaaatagaattggtgaaatgcaaacagcactagaattcgataagtttagtccaagcacacaaaaatcattgaatttgtaatcaacccttaattattaaaatccttatgaaataataagataggcttaacagaaattccatagcacaacaggaaatttgggaccttagagtcacttagcacctatgttgtagagtatacacatatacttattgcacagaaggcatgggaagtcatgcaataataagacaaaaatccataaacagtcatccatatgtacaatagcctatgtaatcattgggaagggggaggataaaggagcacaattagcccccttactacctagtagaagatacagggacaaatttgatatagatgttcttaaccattatttcactaattgaaaatgttagcaaggatgcagaaaaaagggaatgcttgcacattgttagtgggaatgtaaattagtgcagccattatggaaaacagtatggaggttcctcaaaaaactgaaaatagaactaccatatgatccagtaatcccattgctgggcatatatccaaaagaaacaaatcagcatattgaagagttatctgcactttatgtttactgcagcactattcacaataatcaagaagtggaatcaatctaagtgtccatgaacaaatggataaaggaaatgtggtatatgtacacaacggaatactatttagccataaaagggtggaaatcctgtcactgtgacattcatttggatgaatctaaaggacattatgtcaagtgaaataagccaggcacaaaaagacaaataccacgtgatctcacgtatatgtggaatcttaaaacgttgaactcatagaagtagagagcagaatggtggttaccagaggctagggggtgaggagagagggaatgaggagttgttaataaacaggtccaaagtttcagacaggcagtaggaataggttttgagagctattgcacagcagggtgcaataacaatgcatcatatatttcaaactaagagggtaaatttcaaatgtctcaccttaaaaaattgtaggtaagcaaggtgatggatatgtgaattagcttgatctaatcatttcacattgtatatgtatatcaaaacatcacattgtaccccataaatgtacacaattatgatttgtcaatcacaataatattaataattaaaaaagaaagaaaggaaagaaaagaaaatggttcttgaagaatgaaatttcaatagaggcacctaaagttgtaagtaataaagtaggggccctttgtaggcaaagagaacaaagataccaatgttaaaagagtgcatgatgtggctagagcatgaggtctgttgaaggaaatggtgtagatgaggccaggggagcagaagataacagataatggaaatccttgaaaatgaagttaagatatttggctgttaatagaaagtagggactcattgcagtcctttgagaaaggagtcttatacactaactggtattttaggaaggtaaatttattatgtgaagaataaactggagagggaaaaaaaaagaaatcagagcaccaactaggaagctaggacaataatctaggccagtggttctcaaaccctcttgtacttcaaaatcacctgttgaattagatgcttgggcctcatactccgtaagtctaaattagagaaagggatacaaaaagaagagattttaaaggaatgtaatcaccttgctttggggcacattctttttttattttttttaagtgaaagcaagtttattaggaaagtaaaggaacaaagaataggcagagcagcccctagggctgctggttgcccatttttatggttatttcttgattacatgttaaacaaggggtggattattcatgagttttctgggaaagtggtggacaattcccagaactgagggttcctccccattttagaccatagggtaacttcctgacattgccacggcatttgtaaactgtcatggcgctggtgggagtgtagcaatgaggacaaccagaggtcgctctcattgctatcttggttttggtgagatttagcaggcttatcagcaagttctttatgacccatatcttgtgctgacctcctatatcatcctgtgacttagaatgcctaaccacctcggaatgcagcccagtaggtctcagccttattttacccagcccctactcatgatggagttgctcttgttcaaatgcctctgacatttctcctctcccttttataagagaacctttaatcctaagggttctccttcgtagaaggatgaagattcatcttctgtaacttctttaggctgaatagggcaatgatattcccgcttaactattggttcccttgcatttggggtagagaggagctcagtcaaaatgctgacttggtatgtcaagggccatttataactcttgagttccaacaaaaggtgatatctggaaaattattaagtgttcaatttaagagaacattgagtaagcttatcctgcattcctacacgtagagtgtaacagcaatatattccacaacagtaaagcaaaataagccaaattattccaagtaaactaaataagaaggctttccatgaactgggaaactgttggaaccaagctgatatggggttgctagctgactccagtatgtaaggcacattctttttacaacgcacatggaatatgtaagttaatttagtcagcaggtggttagagaagggagttttagagatatgagaaggtttaattggagagtcattggtatcttattcaaagtgaattcaggttgaaaatgccaaaataaaataagaaattaatttgttttacagactctaaagcctcaaaatgtaacaagttcattttctgaggtatttgtgtggtaaatgtcatccttttgaaaaagcagattctcagagcccgactttatgaaaaatcatgagtatccccatagtcaaacactcaaaattaaaaatataaaaaggcaaataaaaaagaacaaaaaattctaatgtctttgggtagacgagaaatgccagaagaaggtacttgttttcaagcagaaaatgaactgctgaagcagtctatgattcagtgaagggagaaagcagttgctgcaaaacagcttaaacaaaaggaaccattgtttctcgcaaaaatatcaagtctactgaaacacattttgttttcggtaaaaatgctattttaaaatatattattttaataccagatgaaattcagtgaggaaatagaattcatgacacagaaatttcctttgaagtcaaacttgttaaaaatgtatcatgtattaaataaaaagatgtgggttctctcttttttttgttttttgttttttgttttttgtttttttgagacagagttttgccctgtcacccaggctggagtgcagtggcgtgatctccactcactgcaacctccgcctcctgggttcaagcaattctgctgcctcaacctcctgagtagctgggattacaggcacccaccaccacatcaggctaatttttgtatttttagtagaaacggagtttcaccatgttggccaggctggtctagaactgctaacctcaggtgatccgactacctcagcctcccaaagtgcacggattacaggcatgagccaccgtgtccagccttctggatgttgtttgtttgtttgtttgttttttctgaatagtcgtcattggatgaggagttcaggtcaagcatttaaaccctgaaacaaaagtcagaacaaactaaaaagacttaagaacatgaaaccaaatgtcaactttgtttgagccaaggacatgaattaaaaagtaaaaacttgtaaaatcgtttatcatgtatttaaactagtaatcatatacttttttctaaagacttggattttctgataataaaaatatctgtctgtgttcacatatattgctgtctggtcactgctctacttctactcacaacagcattcattatacaagggaaaaaatggaatatagggaggaggctgggctgtgggacagagagaagtctgagtgacagtaattggagtgtgtctgataggcagatgcttcatgggactagtcggaactgattggctgagggagctatgtcccactcgtgggtgttattatcagagaggaggagtgagaatggaactttctggaaaaggtcacatgataaagaggaccagtaagaggtagcttcacgaatggagtctgagccagctagctatggagaataatttgacagctggcaggcagacaggtaggatatgtaccttcctctactgctccctaccccttaaaaccccatctctttctgcttttacctctcgggtctgggtattgaaggcctaatgctgtttcattcaatttttacagaagttttaggaaaccagggactctaaattctccgacatggtgaactgtgggtggccatctccaactgctggtgatgccagaaacgaaggcaatggggaaccaggaggcaatacacaccttcctttagctagaagctgtctcctaaaatatctgtctctacatattacccccaccctttccctttccacttttacctaatggctttcaagtgacaaaaactgtgtgggcaattttacaaaagtttcagaaaggccagacatttcaatttctcaaaagagtgaagtggcaagtcccactgtagatcataatacaaaaaaaaaaaaaaaaattggccaagagctaggaaactctaataatttagctaatcatttagccagattatatgagcatttagccagatattcatataatagccatctctacattccttaaccttctcctgatagagattggtgccggatagcaaattctgttacaataattttttggtagggtttaaagaaaacaggggatcaaaattcccaaaagtgcagactttgggtggcaaacatcaagtaaaaattaccaaaagggaaaaaagcaaaaaggagccactaacttttaatatctcccacccttccactctctcctctcctcctttccccttttacttactgtatgtgtgatactcagatctgttgatttaatgtcttaacagaggttttatgtggattcttcctcaattttccaaactcaaggactgcgaattggaagctcacaaaaggaaatgtagcaacatgctatgagcaagaataatcatttaaaataaaaggataggcagaagagagccaagagccaggcaacctctgtcccataggcaaaacatctctcttttttgtaggctagtcaagtgcagcagtgggagtacagaaggcactagaacttttctcttaatacaactatgcctaccattcatcccttttttcccagttgctcagatcctcaattcctgtcgaagattcgctggccagctctgctgaattagtgtctttgctgagatgatagggagcgtctggcctcaattttcaaaatgttgtatgcactgtgcttgtccatgactccaataatgtctagcgatatgtgaaagaaaacagaatatattttaaaacaatagagtagagatggaaggtggactaagagccaggcatgtctgcctctcagccagcaactgtctccgaacttccttctttctactgttattctttacctttttctttgatctgtttacctatttgatctgtatggtggccatttctgctatgttagttgttttacagaggttttagagctacttggcatttatatccaaacttgaggtcagtgtgttatcaactcaaaaaaagaaatctagcaagagttatggataagaaaaatgtcttaaaaataatgagattctaggtgaataaggaccaggaaccagccaacttctgctcttagacaggatccctacattctaccagtgaccttaatccctttattttccttttatcctctaggtgttcagtggacatttccactgcattaatgtctttatagtgttgagtgggacttgggttcagtattcgcacctacaattcgcaagtggtcagctaaagaagtgaaacctaaaaataatttatgaacaaatgaaatgtcttaaagatattgtgataggagccaaaacaggattaggagccagcaaactgctgtccttcatacaaaagtggtcttctaataagcccctttttaacacacacccatcctacttttccttctccctcttacttccaggatatggggtggtcatgctgctgcatcaattacctacatgaaattgttgggagactctaatctcagttttctatacactgctgactgtatttactcatgtcagctacaccatttagcaatatgagatggaaaagacaacatgctttgaatcacattagaaggtacacagggaaaccaagagtaagccaacttctgcccaatagtcagtaccactctcctgccttccttcactctgccaacgaccttcacacatttgtttttcccatttccctttcaggttttcagtggtcacttctgttgcattattttgtttatagagatttcagtggggcttgggaaaatattcccacctgaatctctgcaggtaatcagaagtaaggcctaggaataatgtattttattttattttattttattttaaagggttttttatttttaatttttgtgaatacatcataggtatatatatatgtgtgtgtgcatatgtgtatatatatatgtgtcatatatatatatggtacatgatatattttgatacaggcatgcaatgtataataatcacatcatgaaacattgggtatccatcccctcaagcatttatcttttgtgttacaagccaattatcctcttttagttattttaaaatgtataagtaggtttttattgactacagtcaccttgtcgtgtaatcaaatactaggtcttattcattctaactttttttttattaatcatccttgtcttcctcccacccacccccactacccttcccaacctctgattaccatccttctctatggccatgagttcattgctttgatttttagagcccacaaataagttaaagcatgtgatatttgtctttctgtgcctggcttatttctcttagcataatgacctccagttccatccatgttgttgcaaatgacaggatcttattcttttttatgactgaatagtactccattgtatatatttatcacattttctttatccattcatctgcttgtggacccttaggttgcttccaaatcttggctattgtgaacactgctgcaacaaacatgggagtgcaggtatctctttgagatcctgatttccttacttttgggtatatacccagcagtgggatcgctggatcttatagacgacctattttcagttttttaaggaacctccaaactgttcttcatagcggttgtattaatttacattcccaccaacagtatatgaggattcccttttctccacatcctcaccagtattttttattgtctgcctttgtataaaagccattttaactggggtgagatgatatttcattatagttttgactttgcatttctctgatgatcagtaatgttgatcaccttttcatatgcctgtttgccatttgtatctcttcttttgagaaatatatattcaaatctattgcccatttaaggaattggattagattttttttcctatagagttccttatatgttctgattattaatcccttatcagatgagtagtttgcaaattttttctcccattctgtgggttgtttcttcactttgttggttgtttcctttgctgtgcagaagctttttaacttaatgtgatcccatttgtccatttttgctttagtttcctatgtgtgtagagtgttactcaagaaatttttgcccagaccaacgtccgggagattttccccaatgtttcattgtagtggtttcattataggaggtctcagattcaagtctttaatccattttgatttgatgtttgtataaagtgagagataaagatcacgtttcattattctacatatggatatccagttttcccagcacaatttattgaaaagactgtcttttccccaatatatgttcttggcatctttgttgaaaatgagttaactgtaggtgtgtggatttgtttctgggttctctattctgttacattggtctgtatgtttttatgccagtatcatgctgttttggttactgtagctctgtagtataatttgaagtcaggcaatgtgattcctccagttctgttcttctttctcaggatagctttggctattctgggtcttttgggatttcatataagttttaggattgttttttctatttctatgaaaaatgcctttggtattttgataaggattgtattgaatctgtagatttctttgagtagtatggacattgcaacaatattgattcttccaatccatgaacatggaatatctttccattttttgtgtgtccttgtgaatttctttcatcagagttttatagcgttcattgcagatatcttttacttttttggttaagtcatttcctaggtatgtaactttatttgtggctattataaatggtaatttttaaatttccttttcagattgttcattgttggcatatagaaatgctactgattttcatatgttaattttctatcctgcaactttcttgaattcgtttatcagttctaaagttttttgatgaagtcattagatttttccaaatataagatcatatcatctacaaagataatttggataatttgacttcttcttttccagtttggatggtctttatttcttttttttttcttttttatatttatatatataccttaagttctagggtacatgtgcacaacatgcaggtttgtgccatgttggtgtgctgcacccattaactcatcatttacattaggtatttctcctaatgctatccctcccctagccccccaccccacaacaggccccggtgtgtgatgttccctgccctgtgtccaagtgctctcattgttcaattcccacctatgagtgagaatatgcggtgtttggttttctgtccttgtgatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctactgtgaatagtgccacaataaacatatgtgtgcatgtgtctttatagtagcataatttataatcctttgagtatatacccagtaatgagatggctgggtcaaatggtatttctagttctagatccctgaggaatcgccactgtcttccacagcggttgaactagtttacactcccaccaacagtgtaaaagcattcctatttctccacatcctctccagcacctgttgttttaatgatcgctattctgactggtgtgagatggtatctcattgtggtttggatttgcatttctctgatgaccagtgatgatgagcattttctcatgtgtctgttagctgcataaatgtcttcttttgagaagggtctgttcatatcttttgcccactttttgatggggttgtttggtttttttcttgtaaatttgtttaggttttttgtagattctggatattagccctttgtcagatgagtagattgcaaaaattttctcccattctgtaggttgcctgttcactctgatggtagtttcttttgctgtgcagaaactctttagtttaattagatcccatttgtcaattttggctttcgttgcgattgcttttggtgttttagacatgaagtccttgccgatgcctatgtccttaatggtattgtctaggttttcttctagggtttttatggttttaggtctacaatttaagtctttaatccatctcgaattaatttttgtatagggtgtaaggaagggatccagtttcagctttctacatatggctagccagttttctcagcaccatttattaaacagggaatccttttcccatttcttgattttgtcaggtttgtcaaagatcagatggttgtagatgtgtggtgttacttctgaggcctctgttctgttccattggtctctatctctgttttggtgcaagtaccatgctgttttggttactgtagccttgtagtatagtttgaagtcaggtagcgtgatgcctccagctttgttatttttgcctaggattgtcttggcaatgcaggctcttttttggttccatatgaactttaaagtagttttatccaattctgtgaagaaagttattggtagcttgatggggatggcattgaatctataaattaccttgggcaatatggccattttcacgatattgattcttcctatccatgagcatggaatgttcttccatttgtttgtgtcctcctttatttcgttgagcagtgttttgtagttctccttgaagaggtccttcacatctcttgtaagttggattcctaggtattttattctctttgtagcaattgtgaatgggagttcactcatgatttggctctctgtctgttattggtgtataggaatgcttgtgatttttgcacattgattttgtatcctgagactttgctgaagttgcttatcagcttaaggagattttgggctgagatgatggggttttctaaatatacaatcatgccatctgcaaacagggacaatctgacttcctcgtttcctaactgaataccctttatttatttctcttgcctgattgccctggtcagaacttccaacactatgttgaataggagtggtgagaaaggtggatgctctttatttctttcttttgtctgattgatctaggtaggactttcagtactatgctgaataacaatgaaagtgggcatccttgtcatgttctaagtcttagaggaaatgctttccattttttttccctccattctgtacaatactagctgtgggactgtcatatggcttttattatgttgaggtatgttccttctatacccagtttttttagggtctttatcatgaagggatgttgaactttatcaaatgctttttcaccatctattgaaatgatcatatggtttttgtccttcatcgtgttgatatgatgtaacatattgattaatttgtatatgttgaaccatccttgcatccctgggataaatcccacttggtcttgatgaatgacattgttaacatattgttgaattcagtttgctggtattatgttaaggatttttgcatcaatatttatcagagatattggcctctagctttctttttttgatgtgtctttattgggttttggtatctggttaataccgcccttggagaataagtttgtaagtctagggataatttatgagcaattaaaatgcttttaaatgatacgataggaaaatgagcaggataagaggcagccaacttcactttggcctttttttaaaccctcttaaattctggatatcttttagtgttctctgttatattagttctttgctgtaattgcccaaataatccagtctcagttttctggacctgcagactgtatttgcggatatcacccttagaatctagcaatatgtgatggaaaagtggcatgctttgggccacattagatgggaaatagatgaaccagtaatcagccaactctcaactttagtgagcacttatctcctaactcttctttataccaataacctttgcacatctattttcacctttcatcttctagatgttctgtggtcatgtctgttgtcctattttatttatagagatttcagtcagctcagccagctattcccacctctgagtcttcaagtggtcatctcaagaaatgaaaaactagcaacagtttgtgaataagctaaatgtcttaaagtgttgtcataggcaataaagcaggatcaagagccagccaacctgtaaagtttatggaaaaatggtctcctaatattaacattcctagcataccactgtccccttctttcattctctatcttatgtcctggatattggttactaagctctgccacattagtgtctttacttatgttgtctgaagaatctagtctcactttcctgcaccttgcacactttatttgtgcatgtcaaccatacaatctagaaatatgtgacagaaaaaaaaacaaaatattttaaaatagaatagaagcaagtgaactaggaggcagacaactcctgctattcagaaaaaaaattgggctttcagtgtttgcctcttgccacaacctgcccttttcttatttacacccttacatcctgggtatttggtaggaaaccatcttatattcgtgtctttgctaaagttggcataagaatctagtctcggttttctgtatctgtagactgtgtttgcacatatcatgatagaatctgggaatatatgatagaaaacataatacactttgaaccatgttagaaaggaaactggtgaatgaggagtcagccaactcttgcccatcagccatcccttttctcctaacttctttatttcttccaatgttctgagtttacttttccccttttatctttcaggtatttagtggtcatttctgttgtgttatttatatagagagatcagtagggttgggccaaatattctcacattttggtctgcaagtggtcagctcaagaagtgaaacctgggaagaggttatgaacaagtgaaatgccttcaaatgttgtcataagaggaaagacagcatcaggtgccagccaactcctgcccttttacaaactttgtctcctaatattcctcttcttatcactcccctcttcttttcattcactctttttttttttttttttttgaggcagagtcttgctctgtcgcccaggctggagtgcaatggcgctatctcggctcactggaagctccgcctcccgggttcacgccattctcctgcctcagcctcccgagcagctgggactataggcgcccgccaccatgcccggctaattttttttatatttttagtagagacggggtttcaccgtgttagccaggatggtctcgatctcctgaccttgtgatccgcccgcctcggcctcccaaagtgctggtagtacaggcgtgagccaccgcgcctgtcctcttttcgttcactcttttcccttgtggatatttgttggtcacttctgttatattactttctttgctgaagctttccagaggccgaagtctcttttgtaacttggagtttgtatttgcatatatcaacagttgaatctaacaatttgtggtataaagacatgcttgaacccaaattaaatggaaataggtaaaccatgaaatagccaattccctcccattagttgtaagttccttatttctgtctatgatatttctcattttattttctcctattcccacatggatttttaaaattatctctgtaacattagtatcttttgagagatttgagagagtttccaccttgaagtctgaggtcacaacatcaaacagagaagcttagcaagcattatagaaaagtgaaattccttaaaataattaaataacaagaaagtatgaaccatgagccagccaatttttgtctttgtgccaaactatttatcctaacttccatcatcctttatagcccctccatcatcaccattctattgccttccttatacactctggttgttgtctgggctcttgtctgtgttattgtctttatattggtttcaaggattcacagctcagctttaccaccttgactactgtgggtgtcttgcatgatgaaaaagatttaacaagatagtataaaaatgtgtattcccttaatatttttggattttataaaaagaagttccagaaatcatacacctcctgtcctctatcgagatcctcaatcctaaaataactgtgatcctcagtctccctatttcacttcacttttacatatattctcatgcttgctaaatgtttcatggtcacctctcccccatcagtgtctttgctaagcctgtgggaaaaatcaggcctctgtgttcaatcttgtggactacagtttcttacaatacaaagtagcagtttatgaagaaaaacagcacgtgcattacaaaacttaattcagatggaaggtggtccagatgccagctgacttctaccatttatttaacacctctctcctagcttccatcttctactgctgaccttctttcctctattttcccctttatcgtccaaatgtttaatattcatttttgtagtgctagtgtatttgcaaaggttttagagagactcagtattatcaacttgaggcacttttttttttttttttgagacacagtctcactctgtcacccaggctggagtgcagtggcatgatctcagctcactacaacctccgcctcctgggttcaagctattcttgtgcctcagcctctcaagtagctgggactacaggtgtgcaccaccacacctggttaatttttgtattttagtagagatgagggtttcagcatgttggccaggctgatctcaaactcctgacctcaagtgatctgcccacctccgcctcccaaagtggctgggattacaggcatgagccaccattcctggccaacttgaggaccttttgtggccaactcttaaagagaaatctagcaagagttgtgggcaagtgaaataccttaaaataatgagataataggtgaaaatggaccaagagtcagccaactcctgccctcagccagaacttgtatcccaacttttaatttctataactgcctgtcacctttcttttccccttcactattcagattagtttttttttaatttgtataaatgtatggggtataagtgtaattttgttacatagttaattttaaaactctactgtcaggagtgggattgttgaaggttatttttgttgcattaatcccacctcaaggtctctgtgtagccacttcttgcaagaaatgaattctggcaagagttatgaacaaattaaatgtcttaaaataatcatacaagtggagaaagtaaaccaggagccagccaacttctcccctgaatcagaacatttctcctaacttctatcaccctaccacaaccctccctgccatcaccattttatttccctttttatatactctatgttttatagtgtcctatactgttttagtgcctttacattgatttcagggatacatggcctcaatataaacaccatgagggttttgtgtgtccaatgactaaaatctaacatgctatggaaaagtatggtgccttaaaattcgaaagcaaagaggaccaggagcctgacacctcctgctctttagcccaaaaccatctcttgctctcttctctcttaccactttctccccttctttatttcctgtctacttggtgtatgtttgctggtcagttttgttgcattagttattgtattaaatctgtcgctaaactcaggcctcaattcacaattttgccaactatggttgtacatgacaacagcctctagcaacttgtttttttttttttttttttgtaaaatttatttttttattatactttaagttttagggtacatgtgcacaatgtgcaggtttgttacatatgtatacatgtgccatgttggtgtgctgcacccattaactcgtcatttagcattaggtatatctcctactgctatccctccccctccccccaccccacaacaggccccggtgtgtgatgttccccttcctgtgtccatgtgttctcattgttcaattcccacctatgagtgagaatatgcggtgtttggttttctgtctttgtgatagtttgctcagaatgatggtttccagcttcatccatgtccctacaaaggacatgaactcatccttttttatggctgcatagtattccatggtgtatatgtgtcacattttcttaatccagtctatcactgatggacatttgggttggtttcaagtctttgctattgtgaatagtgccacaataaacatatgtgtgcatgtgtcttcatagcagcacgatttataatcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcccgactttttaatgatcaccattctaactggtgtgagatggtatctcattgtggttttgatttgcatttctctgatggccagtgatgatgagcatttttttcatgtgtcttttggctgcataaatgtcttcttttgagaagggactgttcatatccttcgcccactttttgatggggttgttggtttttttcttgtaaatttgtttaagttctttgtagattctggatattagccctttgtcagacgagtagattgcaaaaattttctcccattctgtaggttgcctgttcactctgatggtagtttcttttgctgtgcagaagctctttagtttaattagatcccatttgtcaattttggctttcattgccattgcttttggtgttttagacatgaagtccttgcccatgcctatgtcctgaattgtattgcctaggttttcttctagggtttttatggttttaggtctaacatttaagtctttaatccatcttgaattaattttcgtatagggtgtaaggaagggatgcagtttcagctttctacatacggctggccagttttcccagcaccatttattaaatagggaatctttccccatttcttgtttttgtcaggtttgtcaaagatcagatagttgtggatatgtggcattatttctgaggggtagcaacttgttttagaagaaaaaaagttccatgtttttaaaaaatgaaatagatgtaagaggttgagagaagccagcaaagtcttcctccttggccatctcttctctctgaacttccatccatctatctatatattttattctcatctcttttatgttagtgtctttagggaggttttaagaaactcagcttcagttttatctccttgaaaactgtgatccaacagcctaaggagaaaatctaacaagaggttatggggtcagtaaaatgccttaaaacaatgacattctgtactaggagaaggaagacaagaagccagccagctcctctaccttagcccacacatctctcctaacctccatcttcctaccactgacccttacctttttatttactccatttttatttctggatattatatcatcacctgtgctgtgtgagtatctttacattggtttggggggaccattggcctgccttagggttataagtgtcataaccataaaaattcatcaaagattattatggaaaggagtaatgtcttaaaatgttaggataagaagtgaaagagacctagaagccaaacaaatcctgcccttgtacagtacctctctcctaatttccatcatccctctctaccttttctcctttcccctcttactgttgaatatcagctctgctgtgttagtgtctctgaagaggctgtggagagaatcagtctttaatttttgcaatatcatggactgtcagtggtcacttaaagagtggaatttagcaatagttgatacaaaaggaaaagtctttataataaaaaaggtatcagaaaaagaaagatgacgaagagtcaacaaactcctgtctttagcttgacaattttccttatatccacctgtctattactcatttcccttctcttttcctcttctacttctttgatacttattaatcagttctgctgcattagtgtttcttcagaaggtttagggaaaaatccagccttgatcatctcaaccttgaggactattggttgctctatctaaatgctgggaaccagagtgacaaacaagtcatagaatctgaagaaagataacaagcaaaatgtacacaaatgggacagagggagaagtaggaccaggatccagttaactcttgccctttagtaacaagatctttcctttcatctccctaaacacctgttaccttctttcttttttcacctcacttctgctctcttcaccttgccaaaggggctgttagtgctttctgtccatatggcctggtaagctgtaatggccctcagtaggagctagtggtgtggaggtcttgccagctaaaaaaaaagcaggttgtgatgacctccccctggtttaatctgtgctgctgtggacacattttatcccatgagcacagccaggctaatgccaatttgcagtgtgccagaactcattcccgggatgtctgtcaaaaaacattagtcgactgagagacttctagttcctcagtgatatggttgaggttgggtatagagataagtgcactgtattcctataaaggtgtttccaaatcacaatgtgtttattggagatcaagacacccaggtgggaatttgtggggtgtatgcggcaggatgaagcttcctgggagcaaggggtggtaatttttgaggtgtatttgaggtggacatctccttttagtttctctgccagaaaaagggtaattaggcaaatcttcaagaaaagagtggtacagtagacaataaccagactgaattgctggctcttaggccttaaggcagaaagtgagatttgggggaccctttctccctcgcttttgctaattctacattgccattttaacatgctatgaatattaggtaaacaggagtatgaagcttatcaaagtgagagatactgctttctagtgcatgctgtgcctattgaccctgaggactgtaatggtggcagaagcattcacaacccctttctctcaagaaagatggctctacttttccagcccaggcttttaagatacaggccaagcacaagagatcccatccttcacccacaacagcaggtcaatgggcagttggtcaattttcttatgtaatatttgttaactgccaaatgtggttaggcatggtaaatgaattaaagctattcattaaagattttaaatgatacatatttgtacatatctgtagggtatatgtgatatattgtcacatgcatagaattgtaatgatcaaatcagtgaatttaggatatccaacaccttgagtatttatcatttctgtgtgttcggaacatttcaagacccctcttctggctactatgaaatacacaatacattgttgttaactataattaccctactctgctattgaacaagagaacttttcccttctatctaactgtatgtttatactcattaaccagcctctcttcatcctgccccctctctcacccttcccagcccctactaactatcattctactctctacttccgtgagatcaaaatttttagctcccagatatgagtgaaaatatacaatatttgtctttctgagcatggcttatttcacttaacataatgacctccagttccatccacgttgctgcaaatgacatgatttcattcttgtttatggccaaatagttgtccattgtgtgtatataccacattttttgaaggccattaaactttttaagttttttttaatcttttttttcaacttttatttttggttcaagggtacatgtgcaggtttgttatataggtaaacttgtatcacaggagtttgttttgtaaattattttgtcacccaggtactaagcctaggacccaatagttattttttctgatcctctccctcctctcagcctccaccctccaataggccccagtgtctgtagttctactctatgtgtccttgtgttctcatcatttctctcccacttataagtgaaaacatgcagtatttggttttctgttcctgtgttagttggctaaggataacggcctccagctccatccatattcctgcaaaagacataatcttcatgttatcactgcatagtattccatggtgtatatgtagcacattttttttatccagtctatcattgatgggcctttaggttgattccatgtctttgctattgtgtagtgctgcaatgaacattcacgtgcatatgtgtttataatgcaacgatttatattcctctggatatatacccagtaattggattgctgggtctaatggtagttctgtttttaagtctgagaaatttccatactgctttccacaatggttgaactaatttacacttccaccaacaatgtataaagtgttcccttttcggccaggcgtggtggctaacgcctgtattcccagcactttgggagaccaaggcgggtggatcacctgaggtcgggagttcgagaccagcctggccaacatggtgaaaccccgtctctactaaaaatacaaaaattagccgggcgtggtgacacacgcctgtaatcccagctacttgggtggctaaggcaggggaatcacttgaacccgggcagcggaggttgcagtaagccgagatcatgccattgcactccagcctgggcaacagagtgagactctgaaaaaaaaaagtgttctcttttctctgcaatcttgtcagcatctgttatttttgactttttaatagccattctgactggtgtgagatggtatctcactgtggttttgatgcatttctctaatgatcagcaatgctgagctttttttcatgtgcttgttggccacacacttgttttcttttgaaaggtgtctgttcgtgtcctttgtcaatttttcaatggggttgtttgagttttttgtgtaaatttgttttaattgcatatagatgctggatattagacctttgtcagatgtatagtttgcaaatagtttctcccattctgtaggttgtctgtttactctgttgatagtttcctttgctgtgcagaagctctttagtttaattaggtcccatttgtcaatttttgctttcgttgggattgcttttggcatcttcctcatgaaatctttgccttttcctatgtcctaaatggtattacctaggttgtcttccagggtttttatagttttgggttttacatttaagtccttaatccatcttgagttgatttttgtatatggtgaaaggaaggggtcccatttcaatcttctgcacatggctagccacttctcctagcaccacttattgaatagggtatcctttcaccattgcttgtttttgtcagttttgctgaagatcagatggttgtaggtgtgcaaccttatttctgggtaacctattctgctccattagtctatgtactaatatcatgccgttttggttacggtatccctgtagtatagtttgaagttgagtagtgtgatacctccagctttgttctttttgcttaggattgccttggctatttgggctccttttttggttccataggaattttaaaataatttttatctagttctgtgaagaatgtcatttgcagtttgatgggaatagcattgaatctataaattgctttgggcattatggccattttaatgatatagattcttcctaaccatgagcatgggatgtttttccatttgtttgtgtcatctctgatttctttgagcagtgttttgtaattctcattgtacagatctttcaccttcctggttggctgtattcctaggtattttattctttctctgcctattgtcaatgggattgcattcctgatttggttcttggcttggctgttgttggttatatattttctttatccacttgttcattgatgaacacacttaggttgattccatatctttgttattgttaatagtgctgcaatatacataggagtgcaggtattccttagatatactgatttcttttcctgtggataaatactcagtagtgggattgctggatcatatggtagttctatttttagttttttcataaatcttcacactgttttccatagtggctatactaatttacattcacaacagtgtacatgagttcccttttctcctcatccttgccagcatctggttgttgttgtttttgtttgtttttgtctttttaatagtagccattctaaccaaggtaagattttttgtgtggttttaatttgtatttcccatttgattagtgatgttgagcattttttcatacacctattggcaatctgtatgtcttattttaagaaatttctattcatgttctttgcccactttttaacgggattatttgtttttgtttttgtttttgttttttattgagttgtttgagttccttgtatattctggatattagtcccttgttggatgaatagtttacaaatattttctgccattcaacaggttgtctcttcactctgttgattgtttcctttactgtgcagaagctttttggtttaatatagtctcacttgtctgtttttgtttttgttgcctgtgcttttgaagtcttagccataaaatctttgcctacactaatgtcctgaagtgcttcccctatgttttcttctagtaggtttatagtttcgagtcttatgtttaggtcttcaatccatctggagttcatttttgtatatgatgaaaaataggagtccagtttcatccttccgaatatggatatctaattttcccagcaccatttattgaagagggtgccctttccccagtgtatgtccttagaaatttttttgaaaataagttggctgtaaatatgtggatttatttctgggttcactattctgtcccattcatctatgtgtctgcctttatatgaatactgtgtcattttgattactatagcctggtgacacatcttgaagtcaggtagtatgatgcctccagctttgttctttttgctcagggttgctttggctacttggactctttattcattccaagtgaattttaggatttttttttctattttctgtgaaatatgacattggtattttgacaggaattgcatgaaatctgtagattgttttgagtagtatggtcattttaacaatattaattctttcaatccatgagcgtggggtgtctttccatttgtgtcctcttcaatacctttcatcagagatttccttgtaaaggtctttcacctccttggttaagtttattcctagatatttcagtagctactgtaaatgggattgccttcttgatttctctctcagctagatcaatattggtgcataaaaacactactgatttctgtacgttgattttatatcctgcaattttactgtatttaatgatcagatctaagaatttcttggtggagtctttaggtttgtcttgatataagctcatgacatatgcaaagaaggacaatttgacttccccctttccagtatggacctttctttttcctacttggttgctctgggtacgacttccagtaatacattgaataggagtgatgaaagtgtgcatccttgtcttgttccatttctcagaggaaaggttttcagcattttcccattcagtctgatttcagctgtgggtttgtcatacatagccttcattatgtcgaggtacaatccttctatgcctagtttgttgagagtttttattatgaagggatgctgacttttacccagtgatttttctgcgtctattgagatgatcatacagatttggtgttcattctgttgatgcaatgtattacatttattgatttgcatatgttgaaccattcttgcatccctgggataaatcccacttgatcatggtgtatcttttggatagattgtaggatacagattgctagtattttgttgaggacttttgcatctatgttcatcatggatatttgcctgtagttttttgttgttgttgcatccttgtctggttttgctgtcagagtaatgctggcatcatagaatgagttagggagaattccctccccttgatatttttggaatagtttgaggagaattggtattagttcttctttgtgagtttggtagaattcagcagtgaagcattcagtcctagacttttatttgttgaaatactttttattactgattcaatctcattactcattattggtctgtttaggttttcaatttcttcctgattaaattttggtaggttgcatgcctccaggaatttatccattttctcaaggttttccagtttgttatcatccagttgttcataacagtctctgatgatctttcatttttttcttttttgagacagggcctcactctgtcacccaggctggagtacagtggttcactcttggctcactgcaacctctgtttcctgggttcaagcaattatcctgcctcagcctcccgagtagatgggattataggtgtgtgccaccacacccagctaatttttgtattttcaatagagacaagagtttcaccatgttgccctggctggtcttgaactcctgacctcaaatggtccacccgccttggcctcccaaagtgtgggattacaggaatgagccaccgtgccaggccgatttttcatatttctgtggtatcaattgtaatgtctcctttcttatttctgattttatttatttagattttctctcttttttggttcatctagctagtggtttattgattttatcttttgaaaaaatttattttgttgttcttttgtgtttttctttagtctgtttcatttagttctgctctgatcttcattattgctttccttctactaatttgggctttggtttgctcttgcttttctagttctttgaggtgcatcattagattgtttatttgacatccttctacttttttgatattggcagttatttctataaacttccctcttaacattgctttttctgtttcccacagattttggtatgttttgtttcaatttcatttgtgtcaagaattttttaaatttcctccttaatttcttctttgacccaatggtcattcgggagcatgttgtttaatttccaggtatttgtatagtttccaaagttcctcttgttattgatttctaattaaactcctttgtggcctgagaagatatttgatatgattttgatattctaaatttttttgagacttgttttgtatcctaatgtataatctatcctggagaatgttccatgtgctgatgagaagaatgtgtattctatagctgttggatgaaatgttctataaatctctgttatgtacatttggtctcaagtgaagtttaaattcagtgtttctttgttaatcttccctctagatcatctgtctaatactgacagtagggtgttcaagttctcacctattttcgtactggagtctatctctctgtttagttgtaatagtatttgtcttggtgctttggtgtcagaagcatatatgtttagaattgctatatagtactattagattaatccctttatcattatgtaatgaccttctttgtctcctttcactgtttttgacttaagtctgtttttttctgacataagtatagctactcctgcttgctttaaatttttgtttgcacagaatgtctttttccatccctttactttgaccctatatgtacatttacatctgaggtgagtttcttgtaggcagcatatagctggatcattttttaaatccattcagccagtctatatttttcttttgtttttgttgttgttgttgttgttgttgttgttgttttattgaaacaaagtctcgctctgttgcccaggctggagtgcagtagtgcgaactcagctcactgcaagctccacctcctgggttcgccattctcctggctcagcctcccaagtagctgggactacagacacccgccaccacgcccggctaatttttttgtatttttagtagagacgaagtttcaccatgttagccaggatggtctcgatctcctgacctcgtgatcctcctgccttggcctcccaaagtgctgggattacaggcatgagccaccgcgcctggcccagtctatatcttttaagtagaaagtttaatctatttatattcaaagttattattaatatttgaaggctcatttctgtcattttattaattgatttctgcttattttgcatatactttgcttctttcttcctctcttactgcttatcattgtggtttgatggttttctgtagtggaaacatttgagtcccttctcttcctcatttgtgtgtttgctctatcagtgggttttatactttcatgtattttcattatggtatatactctcctttttcttccaggtgtaagactcccttaagcattttttatatggctagtctagcagctattaattatttcagcttttgttatttctccttcatttatgaaaggcaactttcttcagtatagtatccttggttgccaggtgtttttttgttttgttttgttttgttttgttttttcagaactttgagtttagcagcccattctctcctggcctataacatttctgctgagaaattcactgtcagtctaatgggaactcccatcagactaagtgactagatgcttttctcttgctatttttagaattatctttgacttttgacagtttgactacaatgtgccatggagaagacctttataaagatttagggatctctgagcttcctgtatttgtatgtctaaatcttttgctacatctggaaagttttcagctattattttgttaaataggttttttatcactttcattttctcttcaccttctgggacactaaaaattcacattattggatcactttacagtgtcctatatgtcatagactttgtttattcttttttagtattttttcatttttgtctgactgggttatttcaatgacttgtcttcaacttctaaaattatttcttctgcttgatctagtctagtgttgaatctttcaaatgtattttatatttcattcaatgaattattcagctttagaatttctatgtgtttttctttttattttagctatctctttggtaaatttctcactcatatcctgcattgtttttctgatttatttgtattgttgttctgatttctgtgttctcttgtatctcactaaacttctttagtatcattattgtgaatttttctgggatttcataaatttctttttgattgggatctattgctggagaagtattgtgttcctttggaggcaatgtattttttttactttttcgtactttttgtgtccttgcattgatatctgcacatttgatgtaacagttacttcttctaatattttaaatttgcttttgtaggggaggactttttcctgaagatttacctatggtgttggttgggtaggacactttggctttgattctcggtatgtgcaataatatagtctccatgatgatttatctggctgtaaacagcatcagtagtatttgtgatttccttggtggtataaggtgcagttgttggtggaggctgtggtgaagtttttctggggatggggacatcagatgggccagttcttgggcaccagtggtagtagcaacaggtcaaacatacctgtccatgggcctcagggaagtgtacatgggcaccagtgttagtgggtctagtcaggctgattcttgggccctccaggcagcttgctcagatgccagcagcggcagtggtgggccggatgggtgggtgggtccttggagccctagcaattgggcatagcataggcaatggttgtagcagaggcaacacaatcctctgactcccaagtgctttgtcctggtgatgatggtggctgcaataggctaggccagccattcttgaggcctgtaggtagcacatgcaggtgagtcccagccatggtggtagtgacaagctaagtcagcctgtcctcaggttcccaggaggagtgctaagttccaacggtggtgaatggggcagagcaatctccaggcccctggacagtttactcaggcactgggaattgaggggagtagagccaggccatctggtggtgcacgtgggtgctggctgtggtaggcaggggcgaggtgatccctagatccccagtagaatgctcaggttggggctgaagtggctgtgctgcagccctactgctggagaaggcatggttgctttcagtggcagcagccataaacaggtagcttgggagcatgtgctttggccctgatataagcaggggagcctttcctcagggctcttttaaatatgtagcagcactgctactaggagtgacagggtcactgccaatgactcgtgtttcgccctggcagcagcagccaacaataaagcccagccctgcattcaaggtattcaaccccattgatggggttccaaggatgtggaaatgcaggggctgttgggcccctggtcaggatgtagtctgatgggggctgggctctcaaaatggcaccctgctgtggctgcttaggactctggggtatgcaggaaccactcaagctccctctctagagaaatgccattatacaatctctaggcaactccttcaaagcccatgtgggttgagggctctcccagggctaggattgcaggagtccacattgagaatatggactgctaggggtctctcacttgtcctttacccatgctggggcacctcttcaggcttccagatgatcccagccaagcaggctaccttacttctttctcattccttgagtcagatgtttcctgtcacttctctattgaattccagcattctctcttaggaaatatattcaaagtgtgattatctactcactattttatttcttctttgtatgggaggtgagttctggatgcctctattcagccatcttgaggcccctttcattggagttttatcctcagcattttatttgaatataagtttaaggagtgagaatggagagttgggtaacagttaggcttaaaccccaatggtagcctctgctagactttctacacaagtgaggctctctgctgaatttattacagggggaataaaatgggagaaaacactgagtcttattttccctcatgaagaaagcctttgggagaaaactcatcatgatgaattaatgttaatttttaaaatactttgtggttatcagaatgaaggagtgattcccagtgatgtaaactatttgactctttgtccagtctcattgactcataccccacttatgaaaagaagaggaaggggctgtaagtaataactgaaaaagctgtttcactaaaatgttttctaagactgtcttgttatccatggtaaagaaatgtaaaattaagagaagcacggatggaggtgctgactctacagatattgtttatgtttagtttgtgaataaattcaccaagctatacacgtaaagatatgtgcacttctctatacaattattacacttcaataaaaccttttttagactgttaaaaaagagaggaaacattaaagaatggatatggatttgggtaataaaggtgtatgcatttatcaaaactcatcaagtacatttcattgatgtaaattttacctcaaaaaatgaagaaagaaaaagaactgtaaacaaacactgaattttagttaatgacctgcatgctgaaatctttaagggtgaagtatactaatgtctccaacttactttgaaatgaaccccaaagtgaaatggtttgatagatgagtagaaaaataattgtagaatctgagtgtgactatgtgggtattcactgtataattctttctatttttctgtatgtttgatcatttttatattaaaatgttggagggttctaaagaagggaggaagaattctacccatctgtttatgaatagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagccaggcaaagggtgggggcagtgggaacaggtaaggaagactgatagtctgaaacagaaaattagattttacattatttatgtgattgctttgttttaataagttccatgaatctcagtacacccaagtgaattagggtctaataaagagtgtacattgcctatatgtatattgaatggaaatgttttcctgcctgctaaagtatcttagaaaataattaaattacctagattgctcattttcacaaaatcaagataagaatattaaaagcagaaagtcatggttaaaaatgcacatttttcatgtgttcccctatggctagaaatcctattatttaaaaaccaggaattaaacagataaattaggggaaagttattcatgctacacaaaggacccttcaaatatatttttaagtaaatcgttccctcagtgcattgattcaaatatgaaactgactttaaattcttcctgatatagtgaaagtatgtaccatagctgtggtacgaaataggggatcaaaatagagtcaagaccctttcctagaaaaggaaaaggggaaaagatcttcctcattgtttcaagatactcatcctcacatccttcctccctggcaagaatagaataggggataacaggccgggcatggtagcatgcgcctgtaatcccagacacttgggtggcggaggcaggagaatggcttgaacccgtgcagcagaggttgcagtgagccgagatcatgccactgcactccagcctgggctggactccatctcaaaataataataataataataataataataataataataataataatgatgataagggagaacagtaggcaacacagaccagaaaaaagatatagagatacattctgtaccatctatgcagctccaccttaaatgggttacgtcagaacataatacaagtgaaatcttactttatgcaattggtgtgttctagaaaagttatgggttaaacatacttttttcgttcagttaagccacttactagttaaatggtaccctgtggttgtagcgattatgcctgccagatttttccaagatagtcttattttaaaacattctgttttagggtccgatcaagtgtcctaatttgctttagtaaatatggtcacaatccctatgatgaatcctttgtaatcaaaaaaatttttaatgtactaaactgatatttactggaaaataatcccaagtgaattaggctctaatacagagtgtatgttgcctacacatatattgaatggaaatgttttcctgcttgctaaagtatttttgaaaataattagattacctaagttgcccattttcatagaaatcaagataaaaatatcaaaagcataaagtcatggttcaaatgcatattgcattacatttaggtgagcttattcaaatttagatttttcataaaactgcctacccacactgctttatgatctttagatttaccaggtaataggtagaagagagaaattcatttattcaatattttagtgggttagtagtctggcacctacaatgtgccagacactgtgttaggcatgagaaaatgagtaatggtaagaagtatgaaaagggtactgaagagtagtttatgcctgtgctgaagttgcagagccatacaaaagagaaggaagccaatctcagctctggactattcattgataacacttggtgtgtataatgtaaagttctagaacccactgagaagaaatgttcatgcttataagtaaaaccctttaaataactttaaaaaattgaatatttgaatagatgttacaacttacagattacttttgcttagtattggtcattatagaaccttgcacaatatcaatcaaaccaaaagcccactttaaaaattgatgtataatatttttgattaggaaataaaattgtctacagattaaaaatcctgataatttactctataaacattttcttttagggcttgggagggtattctcacccattggtaagtagaaactgaataaagcaaaaattaaatagctcctttggcatggtttggaaaggactacattaagattgctgacaatttatgcagtcagctgaaaaaatcatcaccatgttggcttcatgtattgcaaagatgtgcagacacaaagatttttcttcatgaaagaacatatgtcccctgttacagtcacacttgatgatttgcttctgaaagacaagtaacgtgagaaaagtcagaaaagctaattgatagttgtagaggcaataatctattcactcccaattgtatttggacatactgtactagagagagagaactccccctgggacattttgctacatttttaaaaagtcaacaacattctacattctaccagtatttgtcacccctgcaaaacaggggccagcttattttaaccatagtttgttatgttaattcatttaatgaaaaagcatccaccatttcaaattgcagataatcaaatcccttgtatttagtgactgacctcatccctagtagagcatatcaatatatccaaggaatagaaagtgttcttgcctgcaagaggtggcatcatgaagtattgcctatgaattgtcaacattatcagatttaaaactcaataataattgaaattttctacaattgaaaaacagctttggtttttgctacccccaggaaacaaaaactcatttattgctggccagaagtcccacctcgccagaaacatggtccagacagaaatgattaatgttctcctccaaattaatttcaagctgtctaacttagctatttccattttcccctaagtaaacaccagatctctacaaacagcagtaacccagtcttgctttaggatgtgctgtttcctctccagtctatacatgccatcctttaacttcacacatatttcttcctctataaaggacacagccttttggtagtcactaactcagtataaaaaagaaacagtattgagagcaagagagagattgccttgagccatttgattgtaataattgtaacacatgcacacatgaggtaagaactatcactgtagaatgaatcgaattcaggcttgcccagagagatctcttaaataaataggggggtgactgcatagaacaataggtagaaatgaatgaaaattataagaaacaaggcaaattttgagggtatcatttatcatgatatcttgtttttcatgcatccatttcagtatacatctgcattgacacacgacgcaatactggtcatagcagaagctttccgctacctgaggaggcagcgagtagatgtgtcccggagaggaagtgctggagactgcttagcaaatcctgctgtgccctggagtcaaggaattgatattgagagagctctgaaaatggtaaagaccacaatgggttattggggtggaagaaacttataaagacataaaaaagatgagaccttgatcttgagagaagacatactaaaaggaataggaccagattatgtagaatctcagagtatgcaaagaggataagtatagccatttctataaatcatccaaacctagaaatctaaaagttggaggtcatttcttgaagcttgaaaaaaaaagagataaatttagggcaaatgaatttttggttatgcactatactatggctagtaaatgaaacttagtactctcaaaagttacagattgaatatataaatagcttcaaaaaattcaaagctttcaaacatatgacattctttagggagattagaatattttataagatgttcctaacttcaagatagacattacaaaggacagcatcctctggctcatcagacaaatgattagcctagacaggctgtggaacttagccagtgtgatagtatttctgttgtcaaaaagaacactcatgctattctacaggatgaaatgcaggaacatgatacatttctaggtctacttaagaagcttttgcctaatgctgcaaagaaaaagcctaaagaaaagtaaaaggaatcaatggatagacagtcaaataggtcacttgtttttagtatttgctgggtaggagatcatttaaggcttcaagcaatgtcctttgaacagatttcattatttataccagaagtagcatcacccattcattgcagttttccaagcaagagctctgtcctgaatattttgctttatgctacatgtgcctgcatgtattaaaatgagctttcaagagtacaagaatctcttatttctacttatttagttatcctgatgtttgggacatccaaatcaacaaagagatgggcaaagataagataattctgtgtgcaacccagcaaggaagaacttgtaacggcctcataacatacatcattttgtgtagctggctctcttattgatgccttaaatttgccaagttggaagcattcaatcaaaaggggttagtagcccttgtgtctctcttcaagaaagagatatgactcattttcccatcatgcagatttttatgtcattatgtcagttccttaacaaatgccctaagtgtagttttatggaggtagcactgtacaattttgaagagcagttaattaaattcaaccttcatagcagttacaagatttgtattgtcaggtgaaacataatgatgagtgaaatataaaactccctcagagtgaatcaaaaggagtttccatcaacaaaacctcaaggggcaagagccagcatctccaattgactccctattcatgacacaaataactaccttcccaaatagaaaactggctatcagaatgaaggataagataccaattgggctaggaaaaaaaaatagattgatcatactactgcacagaaaagtttctgcatgtctacctcactgataaagctcaagttataagccaggtaaccttcctccccaggccctaatgaccagacactcaaccaaaacaatacattacctttctataggacaatctctattgctccagagaggctggaaggcatctattttttccaaaagtagacagtgcctcagtaaaactgctctactcagagggactgtaagggaggctagtctgaagtactaaatgttttactacattaaaagaaatcccattttatttgaattaattaaaattgagactgcataatgtaaagcatccctcattgtgactagcacatagttgtttctcaataaattattctcttccttcaaaagaaatctggcaaacaaaatcattgcctggcagaggctcctaaggggcctgttttaatgaataaataagcacaacattcattcagtaaatatttattgagcacccatgactatgtatcaggctccatattagtatgcaagcaagaaataagatgaggagtgcacacatttaaattgttaatatgtaaacaaatgctttaaaatatcttaaagccacttgcaaattgggtaatcattctcctcacaatctgcaaataatgcaaagatcagcccagcacagtctactgacatatctgtcacagattctaagtctttgagacttgttcaatcaacatttattaaggatctgctctatcccaggcacaacattagttgctgagaacagaggtaaaaaaatgtctctcatctcgagatgctcctaatccagtaggaaagttagaaacacatagattataaaaatgttatgtctaagtcttgcacaggatgctatgaattaaagaagggatcccagacgggatgcggggaaactgtcactaacattcaatactggaccacatccttaaaaatagatttctctgagtggtagtccaattctacttctggtcaccaaacgttcaaatcatgcgtctggaatctgttggactatgccttgactattctccagttcatatatcatattcagataggttgggtctttagaaatagacaactcttaatgagacttaaagccctagctattttcactaatgaaggctttccttaataagttcctattgcccttgtctctgccctgtctaactcttctatcagaattcagtgctcaaaatagagtataaagagcccttcatgctcacattatgtatcagtctcatcccactggataagtaatttctatctcaacaaaggtcttttctctaactagaagtgtgatgccaccttctctgcaagcctaagctaacaatagtgcttaggtttgttggatcagttggacaatcatcttgttttcagttcatcagattggagcattttcctttcaacaggaattccacagtctcctactggtggtgaacaagcccctttccctttaaaaaatgttccctaatatttgacaacatttttctttctgcaacacaaacccactgccacctctgacttgtttgacagcttgtcattttccataagtgatgaaaaacaattccattctttcatactaggaaaatgagatatattctttctctttgaagcaaagtctttgacctttacttgccagatgagtaatgcaagtggttagcaacaattatttatatttgtagagggtatttcatccagtgtccctgcactgtaaaataggtaaagaatctatctaccctgaagagatggcctcttgctaattcataatactgagcccaggcccaggaaaaattgttccatacatgaaatcggcatttggcatcccaaacaagtgttctggcttccagtacttctacatttcttgtctagtgctccatactcctgaccccttaggcttaataaatttcatcagtctttggattatccctctatggcttagctctcttgtctgttacctgtctgtagctgagtgtgggttaaataagagggaaagctcatccctgtcactgtagtagctggcaaatgtgtaaccctctcaagaaacagaactaaatccattttggttaataataattaatatagctagcatgtattctgatgcttaatagatgccacatactgttctaaacattacgtttatatgtgtgtgtgtatatatatatatatatatatcttctctaatcttcccaataactctgaaagatagatactactaggattttcaatcttacagattaagacactggggtaaaaaagcattaagaacatgccgaaggtcattcaattaataattgaagctacgatatgagtccaggtgtaacagtgcccatgctgctgaaaccagattatgttcagatatgggaaatattaagataagacacagccatggcccccaaggaactcagtttagaatacattaccctagttaagggggtagcctgcagagtatttttaggaaggggctagtggaaatttcaggtccttgaaaaagtggcggtagagccctcattatattatataagtaacagcatcttacacctactcaatgcttcaaaactaaaaggcatgccaagaaaatactgtggaggaaatgaagatcttgtatagactcgatctggtggatagagctcaatgacttgcaataataattcttcaagattccaagatctgtcagcagacctcatcccagagacttagaaggcaataatgccgtgctatttttaaattttaaattttccctttctaccaggtgcaagtacaaggaatgactggaaatattcaatttgacacttatggacgtaggacaaattataccatcgatgtgtatgaaatgaaagtcagtggctctcgaaaagtaagtaaccaaaacagacatttaaagaaaaggactcttgaaagaggacagcatttggatgtaagaaaataagtattattattttacaaaatatcagtaaggatgagtgggagatgggaacctccaggatgaaggaatagcacacctatgtgtcagtgttgggggtcctggtgggaattacaagacccggggagacaggatgtcaatccttatagagctcaagaaagttttgttccacaacagcacttcaatttcatgcagtacttttctgagggaaaaataggcatccaggtcaaatgtcttctctttctaggctggctactggaatgagtatgaaaggtttgtgcctttctcagatcagcaaatcagcaatgacagtgcatcctcagagaatcggaccatagtagtgactaccattctggtaagtgtgaacagaaggtaggtgggctttctgtccagcaagacttccgttttctgaaaagtatttttccaccagtagaaaagacctcaagttcaaacagtaaaaacttccaacagggaagctcaggaaactctcaaagtatcttgccatgatgatgaacagaatgtcatttaacaaaaagagagaaagaaaaagaataggaatttagaacagttttagattatcattttcctctttctccccgcctccatgcccgcccgcataggactgatgcttcatctggacttgaaacctaattcttcattgtgggggaagcagcattgtgtggaggagagagtacattaggattctaaaattaggtctaccactaacctgtaaaactgtgcaagtcacaacttctctgagcctcaggttgttgtttcttcatttatgaaaggggtataataataatcacctacccatgtcataagcccgtttcaaggcacagttcactacacgaagaagttttctgcaaaactcaaagcacttaaaatgtgagatggtattctcatttagttttaaaacacttttctagaagctggtttgtttttactgaatgaagtacaaacctgggttaaaaacaaatacatctctaggtgtgaaagtatgactaactgaatggagactaggctgaagtttgcctttcatctaagcatacatatcaaatactccctttgtcttaagtactatactaggccctggagatataaaaatgtaaatgccacggacgctgacctcacagggatcacaatgcttccccagggctttgcctcaactacctgcaattcctacataataaatcttgagaaatgaaaggcacttcaccatcatgtaactaagtctgccaaatttgatgaaatcaaagacttgataggtgaaaactgggccatctttcaaactctcaaaaagaactgaaatccttctctgcttccttaaattaccagttaaggactccccctaccaaaaaaaaaaaaaaaaaagtgacccaatgaatactcaattaaagctcttctgtttactaagtaacaatttaaaggcctttttcacataccaaacctcaatagtcacagaggggaaaaattattgcatttatcttctcttagaaaaatgtataggagtaatccttttatcttgcttctggtcccaaaggaatcaccatatgtaatgtacaagaagaaccatgagcaactggaaggaaatgaacgatatgaaggctattgtgtagacctagcctatgaaatagccaaacatgtaaggatcaaatacaaattgtccatcgttggtgacgggaaatatggtgcaagggatccagagactaaaatatggaacggcatggttggggaacttgtctatggggtgagttttttccaattctgttttcatttattctgtgctttccaattaacaaagaagagagaagatttaattttcaagtgcagtgtttatccaattgtatagtttacatatagtctacaagaaaaatatattcttctacagttgcgctctgtaaaggtaggttgtcagtagtatcctttggacaacaggattattttactaaaaggaaaatagaattgggggattttatttggcaacattaagcacagcctgccctctatttaaaatctgttccttctgtgttctctagctcaggcagcagaattaccacccacatagttgcctaagcaactttgcctaagcaacctcatcatctttcctcattgttcccctcttatctagtcagtcaccatgtcctatgaattctacttttaagtctctcaaatctagacacactcttcacccccaccatcgtcaccttaattagggttcttaacatctatcagtcatttaacttgttaccctgcgtctgttcttaccctggcaaattagatctccacattactgtaatttcccactttaacaatcaggatgaaattcaaattccttcacatggcaaataaggcactttataatctagcacccgcctacctctctagcttcatcctgtactctttccccctcacacccaatgttccagctatagaaaagtaagtgttgttccctgaaggtgctgagctctcacttagtataagcctggaagtacttttgtgtctcttcagcagctaataccacctactagtcctctgaaacacagcagtgatacttgtttcagaaaaccttctctattcgcatctacttgcctgcagtctgggttaggtacccctgctttttgcttccttcctttccatattcatatagtacttctaagtctgtattgtaatgatccatttacaagttccactgttctactagactatgaactcctcgaggacagaagatgtagctgattcatttcaatatcacacagtctgaaacatagacattcaataaatccttgctgaattaatgaatgaaaaatgaacagaatggctctgccaggggcttatctatagtccaactgcaaaagaattaatatgggcaattagggcttttaagaaaggtacagtgatatcttcagagctcctggttcacttagtattaaatggttttggcctctgattgtgaatgacagatcttgggcagcttaatgaggcacatgtaaataagcagaactggacagaaaaactgcccatgcagtaaaccggtcactagagaactaacccaagtgcagtgggtggtggcaaaggtttagttctaacaaacaaagattacctgtaataataactctctgtctagacaatatctacactaagtaaggggaagacagaggaatctaggaggtagagatactgagaagccccagctggcaagaagcaaacaaccaggttatttatttattggactgaggttcaggagaaggactctagtgcttgggatggaaaccagcaagaataaggtatagctctccaatcatatgagagtactggggtcactaaataagttcttggaacaggcctttgggaggaaccacaaagtcggaagctcatttctaaaaataagggcacagaaaggtaacaaaagcaaagctggaccccagatataaaaactggagcaccatcctctagtcagatgaacagcaaggcaacttgaacctcagcctccatctacgggcctggagccatcatctcctgtcttgggtcaagatcggtcctgggaactgaggcagggctaagtggcagatgagattcaagtgaatccagcagtaagaaagagaagaatttccaacaccagtgcagagagggctgaacaagggtcagagcacccagtcatgatttctgaggaccctgagaagctctgaaccatcttgacatggctctaatcttttactttccaagttgttgataaggttttcttctctttcctgttcctcatctccccaacacttaggcttcaagaggtcttgtcttgcttacagctcacccttgctcttggcacattacctgatacatagtaaatgctcactttttgctttaatgaatcaatgcctggcatacagtaatgcctaagccagtattcattaaattgagttcatggtgggatataatcttgtaatatcattactatttctattactactactactattaccactactattactactactactgccattattagctaccatttgttgcatatttactggctgccagatactgtactaagtgcttttatatgtaatttaatcctcacaacacgcctctggggaaggtgccattattaaactctttctacatgtgagaaaattgaagcctagagaggtgaagtcacatgctaaagaccaaacagtttacagtgactatcttagtttgtttggactgctataataaaacaccataaactgggtcacttataaacaacaggaatttgtttttcacagttctggaggctgggaagtccaagatcaagggagattcattgtctcgtgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtcccagatcaaatggcttacagaccacaagtttttatggcttccaaataccatatgttttgagggcacttaaaaacagcattttttgctagcagggctcttaaacatccttaatcctaccttaccattcattttttacaaatgcatatggggaccagccaagatcagacatcagaactgcccctcaggtaatcaggaatccaaagcctgataaaggacacaggtacagcagtggcagcaggattggacaaagtcacaaaatcccacaacttggcaacacaggttttgtgactcatggtctagtgctctgtccactgggtcacactggctcagttcactaaacttgtgagattatggaaatattggtgttgtatcaatcagatacagcatccccacctggctctaaggggcttacaatctagttggattataaacttttccatctaagatacttattttgctatttttcatccaagatactcatcctgcttatttatggcctccaggataatgtaatccacatttctagttatcactcgaaatatttgaaaacccaatatagacagctgggggttctgcccttagagaggagatatgatctaagggaaaaagagagtcaggagaaaggctaaaaggaaattgaggccccaattaacagaacacctcccagtgggcaactgccatgttccttatgttcctagcagttacaactaaggataaagaagaagggggttgctttgggaaaggcttgacaagctgctgcttaaattgcttcttctgacttagaagatagcagagagcctgggggtagtaatggggctgcagggatggttgattataggtcatattccctgggtgtccccagactccttcacgctcccaggacacatggcaactttacagatactatttgcactgacattgctctgcctagaagaaattatctcttaggtcgtcactatcctaagctggattcattttccattaagaaaggcagagagtcgatttgtccttccagctaaaaggcagagaagcaagggtccagtaacagatgccagatattcttcaggtgattatactgggctttggcagaagggctgatgatttgataaaagtcccccctccttcaaatgatgcatgtaacctccaggaaggagcattaaggacacatgaagtatgccattcgaagcagaaagagtggggaaaatatttccagctaaacgtagtctcacaaggccttcatccagctacagagacacttttttatcttgatattgtctttaactctctcagctccccaaggacaaggagccctaatcaatagatccagtcggggatacctgttctggataaagaaattaggatattctgttgtgacactgcttgttgttgcacagatttaaataagcctcattcttttctccagatcttaacaattgcagacagtaaacatcccatagagtactgccaataaatcagtttaagtcttgtcccccagcacacagcaattatattcctattgtctagcttgattctgccccactcctgttttcaacacatatcaactttccaaaggaaatgtctgccaaaggcaactagagccctgtggttgatacagggacaaagggtcaggtcatgtctgcttcttctcttggataacatatagtacattatgattacacatcaatacattgtctacttcctctctcctgtccccttccctgctttcagaaagtgttttaaaatggtgtctgacaagctcctgctcattcgtagtctcatggtgggttacaagttttgtatcagataatcagatgaaaattcttaaagatataacaagcttgcaatctcaaagagattaaaattacgtttaaagtcagtgtcatctctggctaaaacctgtcagattcttaagtgcatcagccctacacatatgagtttgttggtttttaagttttataacatttacaactttggcaacccacctatgaaaaggattataaatcccctcaagctaaatcctctccaataatgcagttgctccatgtttgcaactggtgagtggaaaattcaaacctaattcagtgtgtttactgagcccacacagccacatttaggctgcttgattaaaatcctttaagtagtcaagatgcaagcaaaagtactagtaaactcttactctgtgctctttccatttgcttgattttgtctgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcacaacaacttattttaacatttattttacgttcaggggtacatgtgcaggtttgtaatataagtaaattgcatatcacaggggtttggtggacaaaaaacaaccccataaaaaagtgggcaaaggacatgaacagacacttttcaaaagaaaacttacatgcggccaaaaactgcctgtgggaatagtggtgatagagggcaagggctttgccaaggctggctctgagctgacatgagttctgctgcttggtttcttaccaaacatacaagaaaggagaagagttgctaagtctcctaccaatagaagggaagggagctacagattctgcctcaagctgtccttgagccttcttccacctgccttcttccacctgctttttgctattcccttgcctttttccatctgtaataggtattttttaaggttcatcatggggaattctccttttggagtcaggtctacatcagtgaggtacaactgagcacagatttaatgccattcttgattgggagagcaccctccaaaacatagacaaattccacattttttgaaaaatctccttagaaagaaacaatccagaaaaaaaaaatacagaaatgccaggctgaggaaaaaaaaaggcagtgcctaagggaagcagatgattcttcctgttgtcttttgtgatttcagaagtacttcaaactaggaatggccttctttgggaatctgttcttttgatgaatgttcctgggaatcagacaacaaaaagtcctgctttatccatctggccacgtcttgttagtatttagtggtgcttaccatgtagtaggtgtttcaattaccaagtagggtttttttaaaggggtcaagattctcaaactcctttctgtaccttctagaaaagaccccaaattccttaaattcattccaaaataattttctcatgtgaatgccttcttatttcttttttctaaaacaaacaagtaacaatttctcctagaactatcttttagacttaaaagatgaaaaatactggttaaattaagtaattaaattcaaatgaaatcaagtgagaaatgatactagaggggtatttgcatgctctgagcaggagacagacatgttggcaaagagaggaagtggctttatctgtgaattctcttggcatgacaagactctttctaactgattcagactctctctgccaaaaaaaaaaaaaaaaaaaaaaaaaaaaaaaaaaaaaacactctgctagctttctggccaactcattctcctcagtacccttttttactatgaccaggtctagcttcaggcaaaagggtaaaatagatgaaaatttgtctttggctcccctctagttagtaacgtggaactggaaattcagaagttagccacgatgagatgagagttgaaaccacaggtaacaatactgagggatgaaagtgaaggacagaaccttaaagaacaaaccttcattgattatctcctaagacaagcactctgaatagtcccttggggtacaaaggtgcaccttaattgagagagcagaactaggaaggaaagtcaaagaaggaacattcagaaaggtaggaggagaacctgtagtctttcataacagagagctaaggaaagcacgtacatagtgcaaaaggccaatggcatcacacaagcagttaatgtctgaaggaagatatttgaatttagtagccaagtatataattcaagaaacaatttcagtaatttggaggggctggaaattaagtctcaggggtataaggagaaagtggtgttgatatcaagacagtaaagctgtcttttttcaataatactggtggtgttagggagggatgtaatgtggttaagaaggcagcaggatcaaaaggtgggaggagtgttttctgtttcatttttgtctgttagtaaataggattacctgaaaatgattttaagtgaataaaacagatcaatgattttcaaattatagcaagcattacaacaaactggaaggccacatgagtctcacgcctccacaatttctcatcccatacatctggggtggagcccgagaactggcatttctttttctttttcttttttattttttttattatactttaagttctagggtacacgtgcacaacgtgcaggtttgttacataggtatacatgtgccatgttggtttgctgcaccaatcaacacgtcatttacgttaggcattttttcctaatgctatccctcccccagccccccacccccgacaggccccagtgtgtggtgttcccccacctgtgaccatgtgttctcattgttcaactcccacctatgagtgagaacatgtggtgtttggttttctgtccttttgatagtttgctgagaatgatggcttccagcttcatccatgtccctgcaaaggacatgaactcatccttttttatggatgcatagtattccatggtgtatatgtgccacattttcttaatccagtctatcattgatggacatttgggttggttccaagtctttgctattgtgaatagtgccgcaataaacatacatgtgcatgtgtctttatagtagcatgacttataatcctttagatacatacccagtaatgggatcactgggtcaaatggtatttctagttctatattcttgaagaattgccacactgtcttccacgatggttgaactaatttacactcccaacaacagtgtaaaagcgttcctatttctccacatcctctccagcatctgttgtttcctgactttttaatgatcgccattctaactgtgtgagatggtatctcattgtggttttgatttgcatttctctgacgaccagtgatgatgagcattttttcatgtgtctgttgaactggcatttctaacaagttcccaggtgactcttttgctgctaatctaggacccatactttaagagccaccggaatagattagtggagaagggaaaaattaaagatgtaaaagagatagtagatagagctgggttttaagaagcgacagagaaatatagaatgcatggaataagttgatcaaatcttagaaagtgtcactttctgtgagatggaaacacacagaagaaatgtataaagatgctgcaatatgttgacaaagttgggggagggggaactgagatgatagagcttatatcaaatggcttccatcttctcagtaaagaaagaggcaagatcatctgcagagaggataggactgataaggattaggaactgggaaaagtttgaaataagcatcatccacagacacagaggagaatctacttttggggggatagatgggttaaattttagaaatgatgagtttgaaatggtggtgagcctccaaggtagatttgatcagtaggcagttggcttcaataaacccatgctttctgcaacttccactaggatgtaaaggatgtaggatgccctccatgcaggtaagtatttttgtctgttttgtctgtcttgttcactgcttcattcctagcacctagaatagtgcttggcacagaataaagactcaaatttgcattggaatgaacctaagaggggttggctaaggttgataattgcatataaaagtagtgtatagtagaaacctgcaagtatctatggagttagaacattatgttcattaagcaactgggttctggaatctgaagaccagggttctaatcccagcctctctgtgctttagtttctccatctccaacatgggaatggtgattgtaccaatatcaaggttactgtgagaattaaatgacatagtaagtgtaatgtgcttagcaaagtgcctcatatagaataagcactcaataaatgttagctagctgtttatcatctgcagttccctttcaactaattaaggagtattcctcaactggtttatcatatgtaattcaaaggagtaaaatttcatttctttgaaaatatactctatatcagacttccctacctctgccctttggtaggggtattgaggcattactgttctgaacatagaaaaaaaatgatcaaaacttgtgttttcacttcatatatgatataccatccaaaagcctttccttagtcagaaggatttttctttgtgtgcattttaaggcctggcttcagactatgacttactactgttggaaaggaacaattacagaaaacaaaagaaataaatgtagaaaatcctagtgcctattttcaagggattaatataaaaaacattgcctgcctttgcctaagttaattgtgcagtgcactactgacatttattttattgattcaatccatgtgagtgctacactgatattatcactagaaaatatagcttactacataaattgtgttctgacaactgttttacccttgttattgcccaggcaaaattctttcatgtttgcatatgtcatatacagtaatcaacaacttattttttaggcatctacagtttctttagtttagaatctgttgcagtgatacatacaaaaatagaagattgagtctctgccttcaaaaaacctgttttaaaagatatgctttcaaaaaaattcaagaataacataagacagcaaacacctaagaattaaactgctgtggccctgtgtggcacctcatggtgtagagtgaagcagatataagaagtataggatattatgcctgctccacaagaattttcagtcaagtgagggagataagacataagaacacgaaaattaaaataagaaaacgagagttaaatagtgacatgtcacaaggcagtacaagttgtattataaggtagcaaaaacacactattaggaaaagaaagcagagtcggttgctctaagccaatgtgtctcagaagacaaaaggccagcaccctttctttaatttaccatcaagttaaagcactttagaacccactgaatgctaccacttttctaacctaagcattgataattcaattggttgtaaagatttaggacttgatattttcaccaaagaagtatattaagcgacaaataactgattaaagactgtctctaaaagtcatatatgttttcttttttttcttttttttcagagagctgatatagctgttgctccactcactataacattggtccgtgaagaagtcatagatttttcaaagccattcatgagcctgggcatctccatcatgataaagaagcctcagaaatcaaaaccaggcgtattctcatttctggatcccctggcttatgaaatctggatgtgcattgtctttgcttacattggagtcagcgtagttcttttcctagtcagcaggttcagtccttatgaatggcacttggaagacaacaatgaagaacctcgtgacccacaaagtcctcctgatcctccaaatgaatttggaatatttaacagtctttggttttccttgggtgcctttatgcagcaaggatgtgatatttctccaaggtttgtttttgtggcatactcaatgcctcattgcattttatggtcatactccattcatgtacatatggtattcatccatctcaactccagatttttttcatttaacattccatcaaatgacagattatcatcaagccattgtgtttgcttatgtccatgaagtgagtgtgtcattggtgttgctttgaatgtctttcatgcatttctatggtattgtatatacattaaaacaaacatttgaactctggataaaggcaacattgccactaatattaatattattcagataaagtaaatactaaatcttcatcagatcaaacagacatggtttcctaattaattgtactgaagtgttttctcatttctaaagagattggatccagacaaaatttaaaagaacatagaactcttctttaaatccctcctaccttctcctttcaatgccctccctttttcattttgctctcagactgcctacaactatccattatagtatcccacccaagttttctagttaaaactataaaacttctcaaagaaaacataggagaatatctgttttaccttggtttggacaaagtgctcttagataagacacaaaaagcacaatccattaaaaatttgataaactggacttcatcaaaattcaaaaccttgcatttaaaaagacgtattaagaaaatgaaaaaaaaacccgactgggagaaaacattagtaaatcatgtgtctgataaaggacttgcatccagaatatataacacctcttacaactcaataaaaagaagacaatccaattttttaatggacaaaagatttgaatggacatttccccaaagaagatatataaatggctaataagcacaacaaaagatactcaacattgttggccattagggaaatgcaaattaaaaccacaatgagatgcttccatacatcctctagaatggctgcaatcaaaaagataggcaataccaagtgctgatgacaatgtagaacaactggaactttcatccactagtagtgggaatgcaaaatgctacagccacattggaaaatagcttggcagtttcttatcaagtaagataaatacttaaaatataacacagcaattctattcttagctatttacctaagagaaaggaaaacatattcacacaaaaagttatacacaaatgttcatagtaactttataatattaaaaaagtagaaacaacccaaatgtctatcaactcgtgaataaataaacaaaatattttatatctatatagtggaatactattcaccaattaaaaagaacagactactgacacatctataacatggatgaaccttaaaaatgttatgctgggccgggcgcggtgattcatgcctgttatcccagcactttgggaggccaaggcaggtggatcacctgaggtcaggatttcaagaccagcctggccaacatggtgaaaccccgtctctactaaaaatacaaaaaattagctgggcatggtggtgggcacttgtaatcccagctacatgagaggctgaggcagcagaatcacttgaacctgggaggcggagattgcagtgagccgaggttgcgccattgcactccagcctgggcaacaagagcaaaactcagtctcaaaaaaaaaaaaaaaaagttatgctaagtgaaataagccagatgcaaaaggccacatatcatgccatttgaatcccatttattgaatatctcatattgtatgattctatttgtccagaataggcagtctacagagacagaaagtacgttagttgttgccaagggcttgcagggagcagagaggggataatcagggccagtatcagggtgaggcaagtgagcctgagtaaagcaagtacagggatcacatccaagctttatttaaaattttgatattatgcattaattttttaaatattggactaaaattctatttatcttgattaatgagattttgatgcccctttaaactttgcgtgtggggaagttgcctcacttgcctcatcctagtcctaggcctgccaggattaactgcaaatgagcatgaaggaactttttagggtgataaaaatgctctaaaattggatcgtgatgatagttgcacaactctacgtttactaaaatcactgatcgtacacttgtattggtgaattttatggtatgcaaattttatctaagaaaagcaaaatattgaacatgaatgtcctgagcctcacaaacttagtctaaacctaaacaaatatggcggtgaattcttaatcataatacattgtaggtgactgtaacatctttatattttgagacaaaaaagctgtaggttttggtaaacttgaacattaatccagatactgaccagagtcaattatacaaacacattagggattttcatgtgaaatataaagactcagaagagtcctaccatgtttttacagcatacttcattttgagattatccacttggaccataaaacatttaaaaagaagctttgcagcataactaattggtaaccatattcagcagctttttaaaatagtctgtatggggtatgcctcatttatcgaagtcacactttttttggcttttctcaatctgcttgattacattctccaaattatttcactccctgttccttttgtgcttagaatgtatgtcattttttgtattatctgggagtttattttgctagtttctttattttttgaaatgttcacttcaagagactatggtttctgaatgatcctataattaaatgatttttaacatggctggtaatctatgttgagacaatactaaagagtcattaaggctcaagattttattggtttctgtaagtgaattttcagaactaagtttgtggtatccccattggagtgctgcatactactctgcatactcaaaaagcactcttctcatttttagaagaatttatatatatattgattcattaagtaataacttaaagattatggcctgaaaatgacaagttgaacaggtttgttaatgtcttatagtagaatgtaagctgtggctcttctttggcactgagatatatcaaatgctttttttcaaagtatgtattttattatactaaactagacactgtcataaagagcaatggctttcaaaattttttttaccatgacccacagtaagaagtaaattttccatcacaactcagtatacacatatgtatataaccaaaggttcaccatactttacccttacaatgtgcaatgcactccgatattttctattgtgtcattttttttttaattctggttacaattcaacccagaaatagggcacacaacctacagaataacactagcctagagtaacaaatattattcttactatacttttaagtaataaattattgcctttatgagctctatgttttccaccatatgggtgatccctcctccaatattgtcttttgtgtgtctttcgaaataaattatacctttaagcattttaataaaatgttatgcttcttagcatatttctgatatatactagtgaagaggaaacatgtttctccttgtcttgagagctctattcattatatgtttgtgctcaattgtataacagcaatcactgtgatgtttctagaactattaacagatttagaaatttctgataataacacagttgttactctaagatttgtggttgccttgactacaaacaccagcagtatactttatttctgtttaatggccacagttggaatgcaaactcttcagaaagcccagaatgtgagcatgcattatacactctgacttttctcaaaattgaagcaattcaagaaattatgagaccacattttaaagtagaatttaagtattagagcaggagaaaatgtcagacataaattagcccaactgcttccatttactgggggcagagggacaacaaccaccttccctcagctcccactgtgtataggcactttacctccattatcaggtggattttaatcctcaaaacaccactgcagcgtgggcattatacttatttttaagttgaagaaggtgatagtcagattaaataatttgcccagccacacagctaatggcagagcctgagtacaaaccaagctccaattccaaaacatgctctttccacttcatgctgctttttccaatatcacagacaagggaacagcacccgaaggatgatgtgatgaaatccaaggtcatggaggttttcagaggcaacagtatgattatttccactactgcacactgcctcctactaccaacctgaagttgcactgtttgttccattcctctcctcatgctcaggcataagagctgttttccattctttcaacctctaaagaaactctaccttttttctggtttgcaatgaaagaaggcagtgagcatttaaaatattatcgagagtgtgtatgctcaaagtaagagactgggaaatcagaaacaagacatcatgagaaaaactgatggcatcattacatttccaccaaattattcacagctacctagaagcttaaagagtctatgtcaatattaggtttgaactaccataattgttcagagtgaataagtttgttctacatgaagctggaggctgagctaactctagagaaggtaatcaatataataacctgaggttttgtccacatacaaactgatttattaggaggagtcggtggaaggtacgaggagattcaattcaacctttttccccctgagtggggaaggagaagacaggcaatgggtacaggcagatggaagaagcatagtggttaagcacgtgggcactggagttagcctcactagattcacaatctgcttagcagttgtgtaacctggggcaaatcactaaaccttgctaagcctcagttcttcatctgtgaaataaaaagcacagtgcctagcatgtaagttctcaataaataatagctattgtcattattaaattggctgcacataatcatgctagtttcacaaatactaacagctaatataacatttgcattttagttcctaaaactccttgggaatacagttgaaataccagttagtatcaaagagctgacctctgatgagaaataaccagcaacactccttcttgaacttgcttttgttaaagattacaactcttgcaaatatttttattgtattattctactatgtcttactgatattggctggaagttgtaactttatttttaatacgaaatttatttcctttgtaaaacttggatagaaccactaagcagtccagagtccaagtccttccagacaaatgctccccctgctgactttctgtgcagctgcagggacatctgagggctagacaaattgaagacatgagagttgggggaattattacagagaaaatggaaagaacagatgaacttgaacctgattactgtgtatagatgtttccaaaggtgttactctcctgttaagttttcaagatatgaagtactttgttgaagagggcagggggtctgtccagattagttgacacgtagatcctcctttaaaatgtaaagtatgtgcagaataataaaagacatgaagggtataaaataaatgagatcaaagacaataggatttttggctatattttaagcataccctttcctctgctgatgtatgaccactgtctttatcttactgcaaattcacttcaaagtagtagtgatgtaataataaattaatgaggtaatagcagaatttttattacaactacttcatggcttttctggctaaaagctgtagttttcagtctttgggacatggttacttattcccatcagagaagactgtaagaaccaaagattgattctgcacattttttaaaaatctgccacagacatggcattaaatggagtatagaaatgatgcatactttggaagaaagaagagaaaaaaaggaatgataaagagtttgtacaatagagaagcagttttcagtcccagctcttcatcttgtaaagctagtaaagtgaagattataaaatttacttacaagatgaaggttatagcacatagctcacttttattatcatttcaaaggtcataaaatatattttattattaactcagaaaatctagttctttattattacagataacaagagcattgtatattatttgatgtacgtattttgcagtgctttttatatgtctgttttcctcttgttgctaatttactttcattaacttcacgcctcctcttacatttcctcaaaaggtatgatacgcttcttataatgcacttttataaacactaaatgtgcagcattttacagccatttcattacgctaaccttgaaatctgtcttgtgcaacaaaactatttgaaatgaatgttaaacattttgtagctgcattaatggagggaaagatactggaaaatgacaggtctttttaactcaactataaagtcttgtcttattttaatagatcctttataaaatgtgatgggattgacccatcagtcactttttatataacctccatgtgaaatgtgagtttaagtggctatagtttccctaatgagaaaaggtaaatgtaaaaatgcctatggagcttcttccctgtaggttccactgcactttttctcagtgaaaggattgaggcgcttatgctaaacaagggaataaagtggtggaaattccatcaaatcttttgtctaagctactactgttttgaggcgagaatgttgaatgcaagcttgtgcattccacactgattccactgaagctccttttctatctctgctgaggtatgcaggtactgttatagcatttttatgtgggtaatcacccaaattctccatgatcataggtatatcatgacattaaccacaaaattgccaaagtcaataaccatgtagacaagaggccatgaaaatgaccattttgcatttagatttattttcagtcatgtcaacaaccaacagctgagtcattcagatcaaccacatgatgatctgagtcagtactaaagtggccaaaataaccagattatgatgtgcaggcttgattttagatcagactgacacagccacagtccattagcctcaatacaatggcacagtgtaatttccataaattactgtatttttctccacattgtcaagtagacaatgcataaactaccattagtattcacagcagcaaaatatacctctttccatatcaaactgtgattctggaattactccaaagtcagttttctccttggtctggcaaaacctcatcattccaaataaaaatgacagtcacagttctgtcccaaatgaacaacagataataaacaataattatacaaatatgtttggttttcatgccactatatttctcagtgtttggagaaaatttgtaccttctataacttgcacaccattttggattttcttatacaaaatacgggtattttatactacaaaaatgtgggtatttctctcctagtgtataagtttaaatgttttattttctattctgcctctctgtgcctcagtttctttatctgtaaaatacctctgtttgcttatctttaaaatagtacctaaccatagggatagagaattaaaatagttggcacaggtaaagcaattagaacagagtctggcacacaagaagtgctcaataagtattagctataattgttatcatttttcttcctctattactatggatgtttctttggaatgttaatcttttatatagcaaaattatttctagagtcagatcagttcagaataaattaaatgtatgtggcaacaatgaagaaagactctgaaaggtctaaatgcataatcaaaacaccctgtatacttttagcattcagaagtgtgccacattcttttctgactcatccagatgtttttacttctgattaaaagagaaatgttcccagatgaaatcctgagatagtgtaactgttagaaaaatctactgcaaagcagattttcaaattcaaaaagctaaaagtgatcatgttcaggaaataaatacgggttgtctcaggaatccagggacgaacaggaactacagatttaaaaaaaatcaagtcagtttgttatagttaaccaataataaatatttatcaaaatacctgccaaaattattcagagtgtagcatctaaaacaactgagttttccagaggccagaaaaaggttaccttgggacacaggaatttaaatttgctttaaagtggtgaaatgctggtacagacagagaagagcttgatttgccggctctcagcccagaactaccctcttcccacagagcctggagatatgccaggctcctacgcctattcttgactttatgacagagtgggttctcttcctgtgagtttttctgggcatgggagaacatagcgtaactaggatggagctctgccacacagcagaattatcctaaggatgatgtggcaatgttttataaaacctagggagcagattttcatttctgcagacagagccagccttcagcaacactgtgaaggagatgaagtttcctgagtacaagccattacccatcactgagcattcaattccctcacactgtccaataacttcttatggtccctgtctctgaggaacactcatgatgcaggaccaaacttgcaaccctgtctgcaccttgagagttttataaagtgctgctgcttagtcccaacccccagggttatgatttaattggtcttgaagcctaggcaaggttttttgtctttttgtgttgacgtgttttgactgaagctccctagatgatattgatatgcaggcagaactgagaatcactgatgtagaagaacaatgtttctcagtttggtctgcagaccacttgcagcagaatcacctgtgatgcttaagaagtgcagattcttgggcattcagctattctgaatctgcattttaacaaacacctcaggtaatgctgatgcacagtaacatttaagaacaaaaatttccccttattaaaacttacccatcttctttcccattccctactaactgaataaacagtgggtgctgttgaagtaatgtgttacattttgatcaagcctcctgaaaacaacacagagcgtgattccaatagaatttctccatcagaccaggaggatgattttgttttcgttttctgtgtgtgggggtggaagggggtgtggaggaagcaagccttttgatgcctctaatcccactatacaggtagtttcctacttcacttggagtctgccctgagtggttaaggcttagttgtcaaaggagaaagtttctaatctcctgggccccaaaagctatttatatgaagatgatgagaaatattatcatctagctccttgccttatggatgaccaactccacaaaatagcaatgtctttgttaaatttattaaactcaaagtgaatagtgctcattttccagcacctacccatttatcttcaagtgagaagaggtttttgactatgtttctctcatgacattaccttgtagcagtggttttcaaccttggttgcactttgtaatcacctggtgagctttaaaaaatttaaatgtctgcgtcctacctcccaagttctgatttaattggtgggcctgggcatgagtttttttttaagatcctaggtgattttaatgtggagccaaggctgaaaaccatttgcttctacaggtgtgcccagcaaacttcacaggaagagaactcaataagttaaattattacctgtggaagcaggagatggtaaaaaaaatatatattttttcctgtaattaaaaggaaaaatcctgctaggagtgcacttgtagtcccagctattcaggaggctgaagctggaagatagctagagcccaggagttcaagtccagtctgggcaacatagagagacctgacctcattttttaaaaagaaaatcctgctttgaaacgtgtataggcctgacaagtattatgcatgcaccatcatagtatgccatcatgacatggggtattgttgttaacatgtgacctttgtttaatgttttaattccctcacatcatctatttccctccttcatcagctatactgaaaccactcctctttccagaaataaagaaaaggatttcttaaacttagatctggcccctctgggtctggatttgtttttgttttgttttatagatcactctccgggcgcattgttggaggggtttggtggttcttcaccctgatcataatttcttcctatactgccaatctcgctgctttcctgactgtggagaggatggtttctcccatagagagtgctgaagacttagctaaacagactgaaattgcatatgggaccctggactccggttcaacaaaagaatttttcagagtaagtgctctgcagttaattgagcctgctgatatttattttatcatcttctcacaaaggcaagttcacagtgcttttaagggagagttgggaaagagtgggaatgttatcaaaggagagcatcttaaatactgggctgcttggttggtgatctacttcattgtcgtttagaaccaagacttgagtaagacataacaagctgcatgtcaagggcactgagtttggactcccaggtttgaatcccaaccctgccacaaagtgattgtttgtccttgggcaagccatttaacttctaccagcttcagtcccctcacttgaataatgaggggattgaactaaataatatatattctgctttctagcttttacaaaagcagtgcttttatgtctcagaggttcacagaagttaggcaattgactctaagactgatgagtaatggactataagaaattacatattctattttaaatgttagttgtctattgagatgtattacaattgtatcaagtatttgtgtacatggtgataatttcattttcaggacagctgataattgttttaatttcttgggtagacgtattccctcagctcctcataggcaaaatcttattgaggaaacagtaaattgttcattagcaaaagttaataaagctatgtaaagtctgtcaagaggaaagatgaaaggagattgaagcaggaaatgatagaaggataatatgagggacaaaccactttcacataaaccatcaagatctttattctgtggtaactggactattaaggaagaatactagtagagtttttaagaactaaaatgttttttcagttaccccaacaagaaaaatatgctaatttagattagaaaatggacacattctataatattactactgcctgctactgtaaccacagtaactagttgtagcaatgatccagaagccacttgggtagtaggtggagtagttagtcactctctccaaccaataatcaagttattggatgacagatataattgctgatttttcctcaaaggcccagagtaaacagatggtggttctaaacctcctttttaaataatcaataagaaatacatttctacatgtattatcatgagatttgtccaattacttcacagtaaaccaggaagagtacatttcttgacattacagcaattaactacaaacagttttcactccctgaaagagaatgtattagtcctgggaccctttcaagaattctcattgattcaagatatccatatctcacctataccacctgtttactgaccagatcataatccccaactgggaggaggggtccaatgttggtccaatgaagaccctctggaactaatctggccttgaccctcactactatggcagtcccagaagcttatttagaaacaattttctgcccccatgaaatcactcacatttatcggggctagaagccagggatttccatctgatgagtagtcaacacataaccagctccatggaaatctggtttgatatcaaccttcaacagagcttatgataaccatcccaataggcatgaagtttctatatgaagtaattaaccacttaggatatcaagacaccagaagcttctatatgaagtaattaaccacttaggatatcaagacaccagacttgaaccctcagataagagatacttgttccactggaaagcatttttctttcaaaaacaattagaggttagaaagttgtgctttaaatggtaatcaataaacggcatcaattcccattaggctttcaaaggccattcatccatattgcaggcaaaaggaggctctctggaaagatgaagagatttattagcccagaggcagaaagtgtgaccaaatattcattgccctcatgcccagaccccatctcccacttattctgtgtctttctcaaaaactaggaaagcatctactaaatcattcaatcatgatttcattaaagggcatcatattaccagagctgatttgaatcaacatttaattctgagcaaagctattgccacattctgattggtttgtggtttctaatgctcatcaattcctagccaatgagtaattcatatggaaattgagctgttttgaaaatctgattacacagggagctggatatttctaagtataaggaagtacaaatcattttctagttctggcatgccactttttctgtttccccaaatggtcactggtggcatcattaaggacttggtggggtggttcttcagggcagcacacgaatgttgattatctaaaagtggaactataaaagcagcatagaaaaaccaactcctttaacctgcttatactgaaaatgttatctagacccaacaaagactatctttgatattcgtgcaatacagggttgtggggccggcagccaattggtctccaagccatttaaatccaatggggcaaagaaggcagccagcaagagcacatcatcctttatttagggacttgactgccacagtcatgtcacttccccttcattcttcagtgatgtcaagtcataaaggcaattttaaaaactaactcctggccaggtgtagtggctcacacctgtagtcccagcactttgggaggccgaggcaggcagatcacgagctcaggagattgagaccagcctggtcaacacggtaaaaccctgtctctactaaaaatacaaaaattagctgagtgtggtggtgcatgcctgtaattccagctactcgggaggctgaggcaggagaatcgcttgaaccagggattcagaggttgcagtgagctgagatcttgccacaacactacagcctggcaatagagtgagactctgtctcaaaaacaaaaacaaaacaaaacaaaacaaaaaacagtaactcacatacacacacacacacacacacacacacacacattggggatctctgatagcatgccttatgaacttcagaggatgaaacaagatcacatgcaacatttacaaacataatatgaactcatttcttcccgtgctcactctatactaatactacagggaccaaattgtaataacataagacagcctagggccagccctctagtccttccactaagagataggaataaataaaataaaattcttttctaattgccctgcagacatttttacttgtcctgagtaaagctgccattaaaatgatggtatttttaaatgattcatttgtttctctcattttctgagctttccctagctgtcatcttacaatcccatgatcagtggaacagagggacctgttccgtcaggaaaggcagggagcagaatgcatgctgctagaagagacacctggaatattactatcaactctcttgatttgaaaactgatttccttagacagcagctccaaaactatatatcccaaccagacgtagaagcacatatgccaaaaaaacaagtggacggctttattgttgttgcccagagaaatgctacaatgatttggaaagctgcactgaaatgaccattctccactaggttttggaaatttaacctgatacagattcatgttaaaaggtggcactggaagaaaaagtaattccaaagttctctctgcctgcagacctttaaaagtattagaaaataaccaggatgctggatttctttttttgtgaaaattgatattaatattttattaagatgcattcaaataattatttatacatttatatgcataaacacccaaaacattttatacatggaatcatataacatagtattctcttgccattatttgtttgttttttaaaactcaaataagtatagatttacttttttttttacttcatagtatttaactttacttcaactctattatttcctttatcaatttcctcttgataaatgtttaaccttttgaaaatattttggtgttaacagtggttcaataaacattattttccattgatgtaatagaattattttaaaatgtttttaaatatttgcccttcagttagatcccttaaagcacttagcctgtgatgtgacataagccatgtaatgcccagctgcagacaaagctggcttcacaaagttacagaatgtagtaggcacctggctaaggaaaactctaccccacaaaatatttagcccccagtaggcactttaacaggaatcacattttttcccctttttacattaaatgtctgatggtggaagaaggggacatgtttgttctaaagttaatcctaatggaaaagttaatggtccaatattttatttataccataatggacaatttttctctttctcatttgctgaactttatgcaaggctcttgtgtttatttgggcacaactccagaggccttcattcttattctcacctgactggatggcccagccaggtcatgtataacctgtgatatgcctgtgcatatacctgtgtgcgtaggctgctgaggccctggtatttggtttagtttgttgcttactttgccgttgcttggtttcctgattctctaaaagaatataaggcagaaaaatcccagagagatgtttcagagtttcagaacagtaccgttgaagatactagtcacactgaagtttacaaaagttacatataagagaacaaagacttctttcatcatttagacagagttggtttgacaaaggttttcagcaaatcacatcaccaaataagaaactaaacttgctgacttagcctattgcactaaccactaaactcagcttcctcccttagctacacagggaagaaacacaggggggaaaaatgccaccctttttgaaacaagcaaacttttggaaaatggccaggtctggaggctgacttgtatagtgcatcattttatgagatgtataccacacccagaaaccttgcagaaatcatcatgacagagatgagataatctcaaaactttctgattttatgtggcgatcatttgccatgctggtagaaggttttatgagaacttaaatgctctcttctggaaataggcagtaattctagaatcccagaaaatttaaatccatgtcaatttgatatgtttggacagttgacagggaaatagtactgttttaattccatgtatatagggcataaagacacatattaaaataagaaataaggaccagatcagaatgaagcaccataatgttaatgaaagcaataagttcaagggataattttataaaactgtcattagagtatttgccaaagagagagttgcattatctctatcatatctctcatttcactataccagagcctgcataactgcagtgattattttaggacttaagacaaatactttatttattctaagaacacattgatatacaacttatatatcacatataagaagtcaattgtctctttttgtattagttttgatcagttagctgatgaagtctttgagtcttaccccaatgccggatgccagatttcttttccagatacttggccatatccccattacagaaagtttgggggataaaaggaattcttttttaaaaatgaaatgtttaacattaatttaaacctctttaagaaagtaaatataaaagaagaggagtagagagagtggtgacttgctccagtgccctaggcaaggcagaagaattgaactttattaggagaccactaaggggactgtcctgcctcgtgagttacaggtattgtaagccctgtgaagcacagctgaattactcatgaagaatgttttgtctcaacacaagactctgattattgtcttggtcattatagtttttcattttttttaagcacaggcagcgaaaggaggggttctgccatgctgatttgaaaaggagtccctgctaatagcatttcgattctgcttacacattcacaaccacacacatacacaaagcattttcaactgggtctacatttcttcaatatttattggctatctataacagggcttttgaagtatatgcaggaagggagaaaaatctttccacaagcgcacctatgcagggtatgctgacattttgacataatccagaaaatcaaccattaatctttaagctttattataattgagctatgtacacaacagacctccctgacaccttaatccatccccttgccttaggaaacacatcaaaatgtaaaaatcttttgttaaaaatttttctcaccaaacaccatggtgaatttaagatcttaacagacaatatacctggaaagctgcagccaaattttatttgtttgaagacacatataatgtgaccaaatgtttgaggatacatccaaaccatgcactaggggaacacataacagcaacagcaacagatgagttgacactaagggtagtaggtcagggacatctgctgtacatactacttggcagtttaaaaaaaagaaaactgtctttcaattttgacatggctgttttgatgctgtcttatttttttttaagtcttactttcctatgttatataatacacagcaagagccatagaccttataggtcaagactggagacagagcaacagccacaggtgaggatgctgaggcctggccaaaaaggcctctggaaaagggaaagatgcagtaagaccaccgttggcttttcccatccttcagcagctaggaatctgtggctccatagctcttcctttcaggcaagtctcaggctggctggaaaggacaatctccaagaaagtagaggttgacctgacaactatgcacgcaactgaaaacacatctaatatctgcctccaagagaaaggaaagcatttagcaataaagacaagctaataatatgcctgatattccattatttattcagcagtctttcagtaacttttgagccaagcttcatgctaagcactgacgatcatacatcttataaacaaaattaaattcctatcttttgccaaattacctgaaaatacctagacaggctttttcaccatatttggagacagattaacttaaaatataggtatctcacataactagatgactttccctccagggaagctggtggtgtttatttctatggagctacttcccagcatgggccaatctctgggtatgctccatggtgacttagcagcagggttaatgattccctgtaacctcagtaggaagatcagctagtttatgaatgaaacagaaatggcctctaccctcttggagctcacaatctagtggaccattaattttcaacacacattcacatacattactacacaatccacacaacaatcctggggcagccagaacaagtatcattacacctgtttcatagaggagacaaatgaggtacatgacattgtgatttgctgaatgtcactcagctcaatggagaaaagctggcactaggatcctgatgctctgagtctctaatgcagcacatgttaaggcatctgtatcatctcccggttgatctatgtttttattccccttgatagatcaattagaaaaggaaatctatgcctacttttaaaagacacttcccatgctctgacaacttcaaagggttccaagataagaaggcaaagaaaggcatctataaagctagagtgaatgccataaatggagcaaacctctattattacatggcttgttatagtttctgacgtgctaagggttatgtcatgtgtgtagatgaaactagaaagaacaagagaaagatgaattgtttctagttccacatccactgatgactttcttatttttctttgggtaaagaatatttggtctcagtttcttcatttatcagggagaatattccttgctctactgtccttatggggttggtgagaggctaatatcacaaaagctctttaaaagtatgaaggtgtctacaagtcccaagaaacattaggaaaagggcccagcaatagagcaattaaaacctaaagactcagggggagggagagcatcaggataaatagctaatgtatgcagggtataatacttaggtgatgggttgataggtgcagcaaaccaccatggcacaagtttacctatgttataaacctgcacgtcctgcacatgtatcctggaacttaaataaaataaaataaacctaaagactctccagacacagttctgtagagatgtgaggggtacttcacaaaaataaaataagataatctctctgctttcttgatggaagagatgtgggtttgttttttgtttttgtttgtttgtttgtttgtttttctggctttgggaagagaaagaaagctcattcaatattttccccatcctcttgatcccacttctacccttaaatataaaatattactattgtgctcatctcctagttgattcatctttagctattcctttgtggcctgcagattcaacaacttcaatatgcacaatttagagctgcccttgaagaccatctagaaactttaggtgcttccaaggtggcctgccggccatctgcccaaagtaaccaaccatatggattttattaaactatctccattagtcctccaaggtaacctacttgtttatgagagcgtttcacagcccagaaagcctaagggggttaagtctccattctttctgaggctgccaactctcacagacagcatcagggtaattaacatcacacaggacccccagatctttgtgagaactctgaaactctgtttcctagaagaactcatctaaggatctcactttcttttcttatctgacacagtcaaatcatctaatagccttccagttaaaggaatgaggcccatctcttcaattagactttacttgagttcacctggcaagcctgtgtaggttaattatttacagtcctccttcatgcagaagcctaaaaacttgaccgtaaggatcaagtaaaattcgacttacgaaaactcaactaacaaggacaattaactggaatgcttggttgcactccacttttgaaaggaaaaggcaacttagacacacaaaaccttgataagaattttttccccaaaagcctactagatgatgtcctgcagtcagattcattctagtcttcaacatcattcacactttggtcagagagtaaatgtattgaatgtttatcatagcaatttaggcaccaggtatacagtacaggaaacattgacagaacccttaccttcaaggagcttgcattctgttggaaggagacaaaccataaacacataaaaaatagatgtatagaataattccaggtacggataggtgctccaggatgctataataaagaatgacttagggttagaaaaatattttaaactgggagcttgggttggatggagggtttagggaaagactcattaaggaggtaacattttattagagacttaaatgataagaagaggcagctatgtgaaaatctgatggaaaagtattccaaacagaagtcatgcgaagtacaaaggtcctggggcagaaacaatcctggaatgtttaaaggaaggaagaaaaccactgtggctgaagaatagtagcctacattagaattatagtgatggagactgtgtgaaggaatcagatttatgattcattttcgaggtagagtcacagaatttgctgatggattggataacatttatgagcaaaaggaaagagccaaggatgactctcagattttgggcctacatcccttttcagtaatcacttatgaaatctatagtcacaagggctgaaaaggtatactaggactggttaagaaattttccaaagcgttggagaacgttagctgtctgaagggaagattgccgttgttataactgttttacacacatctattgagatataattcatatatcacacaattcatccatttaaagggtataatggttttgttatatcacattattagtttttttaagttgtgataaaatatatttaacaaaacttgccattttaaccacttttaagcacacaattcagtggcactaattgcatccacaatgttatgcaaccatcattactaattccaaaatattttcatcacttcaaatagaaactctataaccattaatcaacttctcattccctcttctcccaggtcctggaaacttctaatctatttcctgtctctatgaatccacctatctaagtacctcatataaatggaacaatatgtccttttgtgtctggcatatttcacttagcataatgtcttcaagcttcatacatgttatagagcttcattcctttttaaaggctgaataatattccactgtatgtatatgccacattttgcttatctattcatctgttgatgaatacgtgactatttgtgaataatgctgctataaacattggcatacaaacatctgttcaaatccctgctttcaattctttggatatacacctaggagtaaaattgctggatcatatgtcaattctatgtttatctgctataacttttttttttccaagatggagtcttgctctgtcacccaggctggagtgcagtggcacaatctcagctcactgaaacctctgcctcctgggttcaagcaattatcctgcctcagcctcccaagtagctgggattacaggcgcatgccaccacgcccaactaatttttgtatttttagtagagatgtgtttttaccatgttggcccctgacctcgtgatctgcctgcctcagcctcccaaagtgctgggattacaggcgtgagccaccgcacccgatctgctataactttctaaaagtctattttgaaataaaatagatgagggcatcttctgttctgttttcttctcattcctgtttaaacaatctcagtcttgaggcaatagatgtttctgcttcagtaggaagagggatgctggataactggtgttgggggcagatctgtagttaatatcacaaagtttcatcttgatatcatgaatgaagttgaggaggaggtatatgtatgtatgcatgtgtcaaaaaagatctaaagccttgtctacaccacacatttatacaaagccttggacattttagttagtggccccgacttttagcaaaaacttaggggagcatgcttcccttttctgtgtttgggttgcaactctggtgcctcagcaggattgcactagcatgcaggcaaaggatgataaaaatggaactcattgtcctccctctgttttaaatggtttagaatgttacctgttggaagagaggggcttggatagagataatctattgcatttctctccagtcctgattgcatgaatctatctataagctgccctcaaaactgatcttctatctgtatactctgtggtgacctaatgaagatgtccctgaacgtggttaacttctatgcctagagaaatctgaattccagaactgagtcttaattcccagttttatcaaaattcttatgtgtttatagcctgatttatttgactctcaactttacttcctttgagtctggtctgggttacagactattatttttatgagaaatattttattttgtttttttttttaattaaggtatgttacaaataaaacttacatatcctgtcattcttggcaatatgaattcaccttgagggcattatgctaagagaaataagtcaggtattgaatgaattatctaatacctaaatccaataagcaaaaatagtctgttagttatctctctgttaggggtatgcttgttacactcaactcatattcttgttcttttttttttatttattttcattttaggtttgtgaaggtttgttatataggtaaatttgtgtcaaaggggtttgttgtatagattatttcatcacccaggtattaagtccagtacccaatagttatcttttctcctctcctctccctcttccaacctttcatcctcaagtagaccccaatgcctgttgttcccttctatgtgttcatgtgtgctgatcatttagctgccacttataagtgggaacacatggtatgtggttttctgttcctgcatcagtttgctaaggataatagcctccagctccatccatgttcccacaaaagacatgatctcgttcttttttatggctgcatagtattccatcgtgtatctgtaccacattttctttatccaattggtcattgacgggcatttaagttgattccatgcctttgctattgtgaatagtgctgcagtaaacattcatgttcatgtgtctttatggtagaatgatttatattcctctgggtatacacccagtaatgggattgtggagtcaaatggtagttttgcttttagctctttgaggaattgctacactgctttccacaatggttgaactaatttacactcccaacaacagtgtataagtgttcccgtttctctgcaacctcaccagcatctactattttttgactttttaataacagtcattctgactggtgtgagatggtatctcattgtggttttgatttgcatttctctaattatcagtgatgttgagctttctttcatatgcttgttggccgcatatatgtcttctttcgaaaagtgtcttttcatggcctttgcccactttttaatagggttatttttctcttataaatttgtttaactgccttatagatgctgggttaatacctttgccagatgaatactttagaaatattttcttccattctgtaggttgtctgtttgttgacagtttcttttgctgtgcagaaactctttaagtttaattagatcccatttgtcaatttttgcttttgttgtgattgcttctggtgtgtttgtcacaaaatctttgcctgttcctatgtccaggatggtattgcctaggttgtctatcagggtttttatagttttgggtttcacatttaacagactatttcttgtatcagtcagtaacattgattttccaacccactgggtaaagaagtctgtcctggacactctgggaataaaggaaatgccattcatactgagcccagtatgcagaaaataaagaagacaggtgatttcatcaggaacagtttctaaaaaagagggcaatttaaaattatttggagggagaaaagaattcaaaaatagttcaagggggatgtgagaatatttttgtggccaagaaagaaaaacaatgaacaataagaccatggctttatatcacattaaaccatggccactattgactaaggtagttagttttctctagtgttcacattaagatttgtttgtgagaaatagcatatgtatataaatttgggggagaaggatttaggagagataaaaacaattagtttctgagaaagaaattattgctttggaacaactgtatcatagtagaaatcaatatatagactgccaagggtaaactgggaatcattcctagagatcaaggtgctctggacatggtcttatttctaattttaaaacttacattttgcatgtgaaggtgaggttcattaaaaatgtgctctccaaagaatactttgctttcctttaaatgagcttcgggaatcaatgttgaaaagcaaaatccatctacacttttggcatacaatatcaaatgaaagaggattttatagcaaatctttcatatttaaaagcaacctcattacattagacattgtttcaaataaaataaacagcccctttcctgaacatgctagtatgaataagataatcataaaaagagtcaaattaaagcccctttgccaagaagtttgaagtttgatttccaaatgtttgtattcgccaccttcctctgaacacacacacacacacacacacacaattaagtacttatgattagcatattattgaagtttattatatatgaaagtcagagagaataaactgccccaccagccagattcttaaaaacacttttgctccattttcttggcctgggatttcagccaactgtacaaacaggaaggttgggaacaccatggtcaataaccaaggaaaaatataaataaattcaaggagacttggataaattcatacaatacggatacgtggaaagttgttaaagttaagggacaggtacttgaaggacactttcacgaaggacactttcacttttagagttgacatccagaagacaaccatggcttcccatagtccatagtcctgtcttaaaacattcttatctggaactgcccaaagagcagacctatagggactagcctataattttttacaagattgtttacaaacacagttgtttctcagttcgcaagaattgagactatttagcctgaagaagatatgtagcagcagaatatattagaattgtcttcaaaaatttgaagggtagacattttaaagatcgactggactgttccgtggggccccaagggacagaacaaagatcaaagagtggatattacagggatagagattttagatcaatgtaagaagaacattctaatatagcaatccatagataaaatgagctatattcatagatagtgaggtgttcatcattgaagggactcaagaataggccacttatcagagatgttgaatagaggactcagtaatctgatgaatgactgtactcgaccagtgttttccaacactgtgtatataaaatcatttggggcactattttaaaacatagactactgggtctcatgccccacctcaagatgctaattccatgcatctgtgtttttccaataatctgtgtttttgaagcagcatcctaaatgattacaacacaggtaaccaagagccactctttgatgaatatttgacgattttctgctttgcttttttttttttttccctatgcaaaggatgcagcggggaggctggaagttgggcctgtggtgtagagagaagcctgagtagaagtagctggggcctgtctgacatgaagtggtgtcttgagagtgatcacagctgactggctgaggtcaagccacccgctctctgtgttcctgtcagggattgagaaaaaggaaaaacctttcctctaatcaacagggaccagtgggagataattgtttcaggggctggaatctgaggtcgaattggcactgtcgcattgatgctttgccaaaggtttagggagccccaaatgaagatctctatagggaagctcaagtaatggtatctggctgaagactatgaacaataacacaccctgaaaactaaaagtaagagcaaaattaaactgcaaagagagaaatcatggccaaaagccttgaaaggtttacaattttgatcttcttctcctctgatccagataatgcccttccttttccactgcccatttactgggtgagtcttgagtgaccaggactgttgtatttatgtctttatggatctttcagagagccccctgattcctatcctagaggactgcaggtggccaggtccaagtgctggttatcagtggagatcttcaattagtatgacctaggtaaaggctgtgggtaaaaggaacttcttagaaaaatatggagcagatgacaaatatatatcaggagcctggaaactcctgccctttggagagaagctctctcctactttcctttacccgacccttacttccttttctctttccttcctttacctgctgggtcttgggtattcaggactgttatgttagtgtctgtacagaggcttcagggaaactccccacaagcactcctacctgaaagaatttagatgaatagccatagatattagtcagcatgggaaaataagagccacagaacctggaaagaagtagggacataagcaacttcataaaaagaaagaagaaaatggagtagaggagcagactggtcaggagcttggcaacttatgccaacctaaagaagctgtcccactggccctttctgagacctaagggtctcaggtggtgaggacttctatgttggtgtttttacagaggttttaggatggacaaaaagaagagctacccttcacaaaggaaagttcattaaaatatggttggaagctatgggcaagagaaaggtccttaaaaatgaaaagggacagaatgagagattgcaccaagagctttgaacccttaacctttagccaaagatctctcctactatcatgttatccctcctccccctccctccttctttgtccttacacttgccttttatgatgaggcagctctactatgtgactgcattttggaggcttcagagagcctcatgcctccaagttcccaatctagaggactgtagctgggtagacataaacctggttaccaagaagagctcaaaattaggaggatgtaaatgttatcaggaaaagaaacagattttaaaactgatacagaaggaaaagaaccaggagccaggaaattcctgccctgtagccagaagcacaaccctaatgcacaactccttattccttactccctttctctttgcctatttgacctgctgggtgtgggcattgggtaatcaatgcagttgcattcatttacaaaggcactgaggagaccaggggtccaaccttccccacacagaagacttgtgggtggacagccccaagtgactgaatggcagggtgaagcctcctgagagtaagtggaggtgatctgtgaggagaatatgagctgcataccctcctttagtatctttaccagcgagagttagtgagggcacatctttaagaaaagagtggtatggtagatagtacccagactgaagtgctagctcttaggcctaaaagaaagaagtaggatttctgtaatcctttctccctccctctcttcttccctcccttttgttaattctacattgccattgccattttaacctgctatgggtattaggcaaacagaagtgtgatcatattcaaaggcacctatccatggagtgggcataaggtatcttttgaatacaggcaccggggtggcgataggagagttccaattctcaagcaggagagaaatgttttccagcccagagggcagattgcccagcctttatctacatcagcagttgggcacagttgatcaattttcgaatcagtgcaggctttgctgattaaggctatattatggacattgctcagcttcatatgtggttaagctggacctgttaacaaggtacatagagtatttccaccacaaattatttggatatctgatggatatttaagaggagccatcccttctttctaactttctttggagtgccatcatctcccaaacatacggatcctggcttctgcagaaaagagaactctgcccttcccctccctggaaagtaatactccgccttttatgaagaccagatcagtttttataaggctagggttcaatattttttcactcttttctactaggacccttgctattaccatggatacctattttgccccttgacactttggagatgcagtacagtatccattgtaccaggatctcccaccttgaagctctttttactggttttttgttgttgttgtttgcttgtttgtttgttttgtcttccaggcaatttccaggcttgcctatcttccagaccaaagattaccaaaagctagttaaaaatatttgttatctttaaggctttccctttcttccaaaatctttgactatacaacacagcaggaccctgccttaagtaatccattaatcagacaattcacaactgatgaaagcaataaatagtaattactcacattggaaacataatcttccctagaaaacagagatcccttagtgcatttagtgcatttgggtgctaacagatcattaactacttgtcagagaaacctaggaggagggctttcagaaataaacataaaacaacctatgcatcaatagaaaaataaaatttgattttcaaaaacgaatctaatttatggcacagcttttttctaggaattcccctgttatataacggaagacatactattttctaggcaaagcagcacaaatcagggaaaggaacatttaaaagtgttggaaaacttacttgcctatgttgagccaatctatgtaggtatggttacatcattctagaagtctggtagtcaatctcggagtctcctttacacacactggtcattttttcaatacttttggatccatgtcttcctaatgctgggctaaatattcagcatgtgccatgttgctaaaacagaaacaatgagaaacctaaatgttctgcattccttgattttgagtttaaatttgtaacgttattaatattgcattaataacctattttgcatatctgtttgattgtaccatcttaaacattcatttaaacctggggaggtcagcatgactcctacctgcttctcactaataacatgcttttcagcgagtagataatgagtgacctggatagaaatcagtggaaatgcagattgccttcaggtggagaaacaggcaggaaatccactttctccacaacactgacaagcagttttgaggctgaaggtagagaaagtaagcctcaaagagagatgactgtttaggaaggctcttaatcaaatattctgttgtctttacatgtggtagtatgaaggaaaagtcatcctaatggaaattaaatcttgcaagtgactttaaaaatcttgggttaatagaaataagtgatttaattatggagagaaaaacagataactcttggctactgattatcctaatgggttacaggcctgaataagcattccttagttcgttgaattaactactgttagtggcacacaggtaaggataggggtgggaagtagtgggcagtcaaaggtctgccattgattgatcagagctgggatagaaggcaatcaggtgagtcttaaaggagaaccacataattttttttaagtattaatggcccactccacttttctggaataacaaaatatattaataataatgcccttgctcaagatatagagggcctgtttttcaagttactgtatttctttggtaataacgtactggcacagaaacagggacttatgtgaaatgtatttcaaaccaatgtctgctaataaattatcccacaggccataggtttcacaggtattagaaaatgcatgagatttgggccggatgcagtggctcatgcctgtaatcccagcattttgggaggccaaggctggcagatcacttgaggttaggagtttgagaccagcctggccaacatggtgaaatcccatctctactacaaatacaaaaattagccgggcatggtggtgcacacctgtaattccagctgtctcaaaaacaaaacaaaacaaaaaaaaacacaacaaacaaaaaataatacatgagatttggaaatgcaacctgggctttcagtttctctcttctaagttctttacgattcaacatggcttccttctgcagtttgactatttatcttcactgaataaaggtgatagctgtatcagaaactcaagtcaaaccaaataatggtgtgatttgtttactttggagggttttcagactttggttttgtttctgttcgacggtggtaataaaaacataggtctgaatataaaacaacctagttttctacttgattcttgaaaaagaaaaaaaactttgcttcagctcatgagtctgtttcttattttttgttttctaatggagtttgacttgcaaatctgcaatttggcagcatttatttctgtttggggcttttggtatagcttggctcaagtccctggttactgtatgacagcaaccaagccaaatggctgtaacattcaatctgcccaattaaaaagcgttggttccatgccccctttggtgactcagatcaggcaaatttactgttgttttaatcttgattgtactcaattattcaacccatctctcagagctgatacagataactattttttaaaaaccttggggaattgtgagtgttgtcacctggctgctcactccttttggaattcttcccttggaaataagagtcagagagagtaggtctaaacaacttaatgtagcaactcacagagccagaaaaagataatcaggctacgtagaaacttaaggagtgcaccttttgttttttccacaaatattttcttctatctgctctttttgaaataaagtatggttcttaaataagaacagcaagaatattcttccatggaatacctagactcaggagttcatttattttcaattttacacaattaggataaatgtaaaggaaacagtttctgcacgtgcctaaggaattcttgcccatacaaataacacagcttacctttctctagagaggcttccatgagcacaggctgggggagctattccagagctacatactagctctgaatagagcagaagttaattccccaacctacccccctgtctctcaacccagatgatagccagccctccaaatggtgcaggcaggatgtccatttgatgtagtcatcacctccataatcagagtaaactagaaaaatattataaaatagggaaagtggttcttggtgctgttttctgccttttagttcctctctgcttttccttaagctgtagacctatactgtccaatatggtacccactagccacgtgtaactatttaaattgaaaataactaaaattaaaagtaaatttaaaattcagtatttcggtagcactagccacatttcaagtgctcaatagacatgtgtggctagaagctaccatattggagagcagagatatagaacatttcagaaagttctatgagatgttgcttccaactattagttcttttagcttcttgagcataaggaacatgttttccacatctccattccttacagcaggtaccacaattcctgatacaactatggaattggggagaaactaagtgcttactatgttgtcgtgagctatgtcaaattcattataagcaatctctcatttcattacctcaagaacactataaggtgggtcctattaccatccccatttttcagaggaggaaactgagtctcagtgaggttgaattatttgcccaaagtcacacagttaataagtacctaaaccaggtctttataacttcaggacctatactcttaacaactgctgtgtacaccaaaagaaaactgcacataactacaaatttcaacatgggacagacaggccccttccagagcattggtgactaggtggcttctccacagcactcatgctggccaaggcagaataaagacaatttgagatcagggcctgagcatgaagattggggacttaaataagtgtgctgatttgtgtttgcatatggctatcagattaagtggctatctgactacttctctaatgaaatagcagcaaattagtagttttatctgccattttgcatatggagaccattgccttgaccccaatggtaaagattagtggaacctaatcatttcatgaagtcaacctcacttgctgcacttatcagaagcttctgtaacttgagcttccatggcgtgcagtttatgccaggacacgcaaatgccagaaaatcaattttcctgcagctttcacagtcagtgtgtttgccagacaaaactgcagccagccaccttttttaaatcagcatagcacctttagaaataatacttaccagaacgctcctaacacagcaaggaggaaaagacttaaatctaaacccaactgttcaaaatcgagagccacaggagaaggtgaaatatgaatatattgaaagtgaacattttagtggccccatttggcactgtaaagtattctctgccaagcatctgttgagttaactttaattctaatctgtgccacagtaggactgaaaacacttaatatgataccatacttcctgtcacccacatgtgcccaggccctcacgtgcccctgacatatcggggtggcactccacattgcctgcctgccccaagacctatcttgattcttcttcctctggtattcttctggcacacattctcaaataaaccaaaccacacaaaggcagtggatgtggggtcatgttaccttcccatttgccatgagtgcataatctactttattgaagacttactacttgccaagaactgttatgggtgctttacatgaattatctcatttagtagtctatctccatttcagagataattattagagtcttagagaaatttaagtaacttgaccaagtcaaacagaaggcatgatctctaatggtagcatttagggcctgtgacaagctagtgagttatcatattggtgccttttacctcggagcatcttgcacaggtttcaaagctgaaccaagaaagaagatcaaggttatataaaatcatgtcaaaacaacaggtcaaagaagtaaacttcactcaattcactagttttggtcaatgtagctactaacgatctttccactgggaggcagtgcagagtagtagaaaaaaacaacacaggtttttgaaagccagcacacctggatttgaatactaattctgtccccctgcatctatgcaaacttggaattataactttacctctctaaactctggaagagagaagaaggagaatatagactttggtgtcaaatgagctgggtttaaatctcagctacgcatttattcattcagttaatatttattaagtacatgctatatgacagccattgttgtaagggctcaaaaccaaagtccttgtaatcactgtagtgggtgagacaaaattaaacaaattctgtaaataacatatatgtttctgttggtgttaagtgcaatgaagacaaaaagctggtgaagagacaaaatgttggtgtggaggtgctatttcatcttggctgattgtggaaggcctttctgacatttgatcagacaccctgaatgaaaggaaggagcaggccatgaaagtatgaggtggagttgcgtggagagaaaagcattccagatggaatagcgttagcaaaggccctgacatgggaatacacttggtaggtttgaggaagaaggtccatgtgctagagtgaagtaagtgagggaaagagtggtaagagatgagagcagtgaagaagacaaaccgtggtaaaaattctggattatattctgtttgacagaaagtcacttagccgactttgagcagaggaatgacatgatctaatctatgtgtaaaaggatcaatcagactgctatgtcagggcaaaagttgagaagcagggagacagaccacttaagaagtgattgtaggccgggcatggtggcttatgccaataattccagcactttgggaggccaaggcatgaggaacacttgagcccagaagttcaagaccagcctcagcaaaatagtgagatctccatctctacaaagaaatttttaaaaaattagctggatgaggtggcacatgcttgtagtaccagttactcaagaggctgaggtgggaggatccctgagcctaggaattcgaagctgcagtaagctaggatcacacaagtgcacgccagcctggacaacagagagagactctgtctctaaaaaaaaaaaaaaaaaaaaaaaaaaaaaaaaaaattaattcaatttaaaaaagaagcaattgcaatatttcaggtgaacaatgattagcttgaattaggaggagggtagggagaagtggttgcattttgaatatagattgagctgacaaggtgtggaatgtgaggccaaagagaggagtcaaggatgactaaaaggattttgacctgagcaactggacaaattggaaggtgctgccattttctctgatggagaaccctagaggagtagcaagcaggggtgggggagaatcaagagatccattttggccatgctaagttggagatacctatgagatatctaagtggagatatcagttaggtagatggataaatgaatctaaactttagtgaggtcagagctaaaaatttaaccagctgtatcaccttggagaagtaaaataacttctataagtattagttaacttctcagtaaaatggagataatattggtttcacaaggttgttttaagaattagcaatcatgtatataatgcacgaagcaccattcctgttgcatgtaagtgcttaataaatggtagccctctcattgtcagtatttatgcactaattggtagctagttgttgcagctgtaggaccattgttgattattctaaacacatcgttgaatattagaatcacttaggaagcattatttacaatgttggccccgcctcaggccaattaaaccagaatcacagaagcagtcatcagtagcttcccaggtacatagtatttcctgctgacaagctggctttaacagaacttctcttcagattagttccagctcaccttttaggaaactaacactccccccccaaaaaaaaaaaactctaaatggaaaatttgggctcttttggataaccccaagcaaattgcttcttcttttcttcattgcttttttctccccttagtaagaaaataattctccagggacctggaagtaacagccacagtggaaacaaaacattgcaatttcaggatagatttttcttcttaatagaagaacattttcccgctcatttcctaggacctgtattgtcaggtttggcctccacactacaattaattgattcaagaataacaatagtattgaacttctcttttgaatatcttagtaatagaaaataaaaatacatttaatccaattggtcaatggtaattggctttggattgctggagatgccgtttcattgaaaaatagaactctagaaggctgagggaagtgaccttggagtgttcaatagtgatagcagtcctagaagcaatccttgattgagagtcagggaatttgaggctttgctctagttagtagtgaaagggtgtggcagacacactttctttgtgacccattctctgtcttgaaaataggttctgcaacttttacactgttggtgggactgtaactagttcaaccattgtggaagaagtcagtgtggcgattcctcaaggatctagaactagaaataccatttgagccagccatcccattactgggtatatacccaaaggattataaatcatgctgctataaagacacatgcacatgtatgtttattgcgacactattcacaatagcaaagacttggaaccaacccaaatgtccatcaatgatagactggattaagaaaatgtggcacatatacaccatggaatactacgcagccataaaaaaggatgagttcatgtcctttgtagggacatggttgaagctggaaaccatcattctgagcaaactatcaaaaggacagaaaaccaaacaccacatgttctcactcatagatgggaattgaacaaagagaacacttggacacaggaaggggaacatcacacaccggggcctgtcgtggggtggggggagaggggagggatagcattaggagatatacctaatgtaaatgatgagttaatgggtgcagcacaccaacatggcacatgtatacatatgtaacaaacctgcacgttgtgcacatgtaccctagaactgaaagtataataaaaaataaaaaataataaaaaaagaaaataggttctgcaatctaaaggtgaaggtacatagcaaagtcaggttttcaacacacacacacacacacacacacacacacaaacttctcctccatacccaattaatgtgtccaccattaggctatcattcctttagctgtggtttgatcctgtgaggagatcacacttttgtatattgttcatcatttctacctcagtgtgaatgtttccaattcttttctgagcacaggatggggtggggagggcatcttttacctgataaggcaaatgaaagagaggtggtactacccacgcaggggagtggaaaatgaggagcatctgtgaaaataaaagttgactcacagtcttggcttataacagccatataagttcaatacataacgttatactccttatatattttcattctcaaaataaggagaaaaaaataatttgtcaacttctggtttaaaaggtagggttttcatgtggactaagggtaagacactttagtctccaatcctacatttcagggagggaataatagaaatatcatgccccttgaaatgatgctaaagtataagcatcatttcaatcagaaagcagaatttctgtgaagtcatcccaaccctaccacatggcttaacctatctaggaatagtgtactgtttgagagcagactctggagcctgaatgagttcccagatccaccacataccagctgtgtggcattaagcaaactacttaactcctctgtgcctctgtttctgcatgtttaaatggggtaatatataatagtataatctatttcatagagttgttgtgagaattacatgagttaacacatgtaaaacccttgaaatggacctggaacaaaaagtatgtattcaattaaatgttagttatgatgggttttcttacttaaagatggcttaatcaaagtccatatagcagagtttctcaaccttagcaccattgacatttggggccggataattactggtggtgggggctgtcctgtgcattgtaagacatttaacagctccgctggcttctacccactagataccagtagcactcctctccccaagttgtgacaatgaaaagttgttgccaaacgtctcctgagaggcaaagttgttgcttactgagagacacaggggtagagggtactgtttcccttcctccattctcccagaatagagcaatggtaccttagaaacattttctgaaagaatgtgttgactctagctttcaaagtcacatggccactggcactattttcaacccattggaatatgcttagtctgactcagcaagagaagcagaagattaatcagaacagtaatctgactttgcataccagagagggacactagaaaggtctcaggaaacttagctgattgtcacctgcacctttggaaaggagacatcagaaatagcccttcttgaagtggaaggaaacatgtccctggacttgtgaacacagtttgaaactgttaagcaaagtcatttacatttgagggcaaaacttaatgtctaggcgaaaggtgacctccaactccaatgaagttatctaaaagcccagccctcaaaataactcagtcaggctcataacacacaagtagaaaaactaagaatagaaaccagaatttctttcccttcctttcccctgtgttcaccaatacacagtctcatgacagctgctgattgtctgaagcaaaaggacacagacaagcagtacttctctgaatgttaaaaatgtgcaaacctaagtgaaggaagaaagtgaaattggggttttggccatgcttagaaatgatatcatttgttgtgtgccttgctccaaatcaaaatggaaactatttcctttactttagggggaaaactgtaaaaatcaatgattcctttttccaaatgcaccttattagagctattgacttcttcaaaacataagtggaagaaaaaaatgtgtccgatgcatttggcaacccagatgtatttttcttcttttgcctcaaattgctctgatcactttacatggtgaagtatggacactaagggcctatagcagggttacaatgagtgacaagaatgttcactaattccagtgccttagtgagaggggatttggagttaatttacaatttaccccaacttcaaaaaaagcttggacaagaagcaaaaaatgtttttggaggtgagttgccctctttcatcaaaaaggatattgtcagtgctaaagcaagcaaaagaggctggggttatcacggggaaagatctatctgaaacctttctagttgacttggatagtgtcccagccttgttcctcattagctgtgtgacctaagataagtagttgagtcaatggcaaatctttgaatttctgtattggagactcttcaaggtggagttctggttaggccttatttggaaactgcttagcaagcacacagcttttttcaggcttgatttatactgagggggtagattcatggaaatgagtgagtaggctaaagcccactatggcacctcttggcattgccactgcacttaccctcccttaccctcagttccatcttttataaaatgggaattcattctttcattcaatatatatttatggggcactactgggcacacacactgttctcagtgctggggagtaagcagtgaaaaaacaatagctactgcacccacctcacagggctgctgtggggtttaaatgagatggtgtgtgttaaatcaccctggcacccagaaagctttatggaaatataaagtttaaagatattcagctatctcctgcttctagtcatgacaaatctaaggcctctctgaataagggagtatttgaaaagttgtatggcaggtaattctcaccacaaaaatctcctcttcatgagtctaaaccaagtgcttgagatttccacagttggagtcttaacttaaagaacttaatttctgtagacctgagacttgtgactacattaaagaacttcagaatgggcccaccccagccacaccttacccctcccttatagtcctaccccacccaccctagtaggacatgcaagcacattgtcctcttccaatcccatcaaacattagaagaggcaaagaagaaaggaggaaaagagggggaggtcaggagctctccagagctgtggcatcattggccttctttccttctagcaccttgccttgtaaggatcacctatgcatatcctagtattggtcaattctgtgaggcaacatttgctcctgaatgttagagaaggcacacaaggcacacaggggtcctgtaagtgttccgttcaggcagatggaggcccaaagccacccttttgaatttttaccacctagacacctgagcctttaataaaagcagaaattacagaggacgctaaataattcagaagaaaaagcagattgtagtttataattatattatcttaaagatacaatctaaagaaaaaatggaccaaattgtcaagcaagaagtagtccacaataaacttagagacagcaaaatgagtgaggaaaagtcatttttgtttgaaactcttgccatatttccctttcttagtgtctcatacacaaggcagccttctccagcccttgaaaggcaccttttataatgccaagaagcccactctcctttttggggtacgaatcccctattcaaatcaaaatgaccccttgctcaggggtaacagaagccattatactgttagtgaacacctctatgaggaccatgactgctgataccagaaaaggggtacaagttatatctctgagggaggcagacagtgaaacagggagaaagtggtagaagatgagcaccccaaagtcaaatctagcccctttgacatgtatgtacaaggctagtcctgtacatacaatgatggaaatggacaacataggcatggtggcaacagtgttcaaaaaaataattacatgcataaagctggcccattttcctttgaggaacactggaatacaaagtgcctaaaagtatcttccccgacctctccttcattacatgttggggaatagagatgttacaaacaccaatactgtctttacaaattatgtaatactttgtctgcattctgacagtaaattaatagcataaatgaatagcatattatgcttctgttgataaacatgcttccaatttattagtccattttggtaattcagttaattctgcactatcaacatatgggaaagtggatgttgaaccctgtcaaattgaggaattgtgctcatgtcaagaccacgagaagagatggttccattgtcctttatgttaatgtcactatatcaagcatattgtgctcaatttgggaggccacattttaggagggactttaaaaaaatgaaaaggtatctagaagattgtgaccagaaaaggtgagttgaatggaatttgtgtcataaaagtaacaaatgaaggcccttaaaatgtttagcctgcaaacaaggcaattaacaagtgacactgtggcagtagattccaggctgtacatcgtgtcgggaagagagcatactgattctctattgctacaaagagaaaaattaggaccagtaggtgacacttcaattttaatattcactcattccaccgacacatagtgagagtttactgtgtgccaggcatcatgctacacacccgtggtgcggtgacaaaaaaagacatgatccctactctcaaggggctcagatttggctggggataaccattgcaaagcaaaataatcagtactccctacaatggagaaatggaaacagagaggacgtactgcccaattcaagcaggagacagaagtaggattggagaggagaggctttcattaagaatatcagccaaaccaaaggaactttctatcaacttgaattgtcccaccatggaataagctacttcctatgcctcctctgagctagggagtgcctcttcaccagaagcatttaagcaagaagctatcacttcaccgggtgagaggctcaacaaaatggtttttaaggcgccttctagctctaaaattctgttattctactgactccaagtggatatactattgaccaagtggatatcctattttatctcacaggaaagcagaaaattttattcaccaagtttccccagtagcagtgttctggttaatgaggattttaatgtataagcctcaacttaactgcaaaacataaatgtaaaaggaaaagttgccatcctgcccattctcctacaccaacaaaatttttaaaatccaatttcaaatgatagtaatttttgttgatggcagaccctggtcattcaccaggcatatgtctggagatccaaatatacaaataatacttaagcatgtgatttctcccataaaatgaagtaatgattccgtaaatatggcactgaagtaatttataataccattaaaataaattctgtcagtaaaacaaattatactttctttattataaagatatataatgtttttcccacttcctgtgtttcagggattcttctaagtatgtattaacccatttaatttctcccaataaacctttgaagtatacacttaaaaaatcatcccattttatgggtgaggaaattgagacacatagatgctagataatttatgtacttagcaagtgtgattcaaacccaagcagtctgactacatgttcttaagcactgcactatatagttactttgaacttacataaagaatagttttatcactagagagctactatatgcacaatgactaggagtgaacaacaccgttgcaaagagacacaaggtctaagtggtaggcttctgtgtaccagactcacagggcccaagattcaaatcttcacatcaacaaaaagacagatttcttcatatatttgaccttcatgatgtattacgaatagttagagctacaactgttgaatccattaatgctaaggctctaccatatctgctatttgggattaatctgttccttctccatttatgtatttctcctttggattttggttgctaattatctagcagtgcttgagaatttcttatggcctttctttataaccattgtttgttcctttttaggtacaaaatggtgctctgtgggatgaatgaaatgaatggtggtgggttggagaaaaatgaacttgttattacacatcctgcccataaattgtttaacttctcccagatgacagagctaagattcagtcccttttattgccttctttatttcatccaaaataagacagaatgcaaaaaaaaaaaggaaagaaaaaaagaggaaatgctagttttctttcttctttatggtctgaatgttatactgacacttaaatactagttggaaagataaacgtttcagcttaatttctcctacttatgagtcatttcttttcccccttctaatctttttgagaattcagtcatcaaaaagagtccaatcatttctgccactaactgacttgtcatttaatgcattcattaatatctgccacatgtacaccatgtgcatttaaagggcctgcttcaagcactgctatttattctcctagaaatgcatcattacctaaaggaataaaccttttaacctgtatcagcaatcaaagagctcaagtaaatgatgaagtaaatgagtccaaattatagtgcacttggatcagaattcatggacccctttgcccttggcttataaatttatctttggaagcaatggcctgtttgcaaatagtgtaaaagacaaatatgtctgaagtctccccttcctggacccccactttgtattcaggtctggttgggccaagatgaagaacacaaaacagctctttataaatgcacaaaaatgcatacccactacagggttttctataatgccaaaaataatggaaattatctaagagcccttcaaaaggggttgggtaaataaaacatagtgtgttcgtagattgaagagctatgcagccattataaaggaaatatgcttattctagtaaaagtataaaaaggtgcaagggaatagtaaaggctaaattcagtatcgtggttacttttggcgagtagagaagaatatgtatttagggaggggtagataagcagactttaactaacttcataatgtttaatttgttaagctttatggcaggtacacaggtgtttttacattatttttatatctttctgtgtatcgaattattgattattttttaattccttgggtaactaactaggaaatgtctactgaaataaagtccttgacaatgtatttcattacaatgcttaaaaattgtcttatgtgtcaaaagaggataatgtaatatggaatgagcataaatgactatgggtgagattttaatcttagaaggccttgattgttagggattatttggggggaagttattgatgtgggcatcaaaggcagactaagtagcatttaaaaagaggattgaaaagcatatatccaaattggtttagcaaggtactcagtgatttttagaaaaatttcagctctagaattctacagtgctataaagatagtgctggtagccatttttacctgaacttctgatatctttgaccagcaatctggtcgtcaccatggtcaagcctaagcttcagttattaagaaaacttatctttagtctgtcatgtatagagtaatttgctggctgccaagagggctagcaaaattaataaggtatggactttgtcctcaagaaacactcaagtaacaggggaagacagacacatagtcaactcaccctactgcaattaagctctatagcaaaggtatgagcaaatggctttgggaggacacccaaagaagcacttcgtgggggcaggaaagggttaggaaagacttcacagaagacatgacatctgctctggatcttgtagatgaataaggtaatttaagcagaagcaaaagcataaccaaaggcataagacatggaagtggcttatttcagtgaccagtgaatagcccagcatgacctaatcacaggagagtgtaaccaagatcataagcactcttgaatatcatacataagagtttggatttttttttcctgtaggtattagggaactagccgaggattttaaagaatgaagtaacttgattaagtttgcattttggaagaatcactagaggataaattgaagagagagatgaagcagggagactagttaggaagcaagatagtctagacaaaacaacgatggagcctgaccaagggagggcaatggtaatgagaatgaaaagaagatgagaggacagattttaaagtcattactatattagaaaaaacatggcagaatgagggagtgagggaaaagtaaaaccaaaccctttagcttggaggttaggtggtttactgatagaatgtagaaggaaacccaggctttacaaggtatataatatagatttagttgggaaaagtttaatctgaaaatgtctacaggaccatcaggtggagatgtccatcatcagggcttgtttgctatcttcccaaaacacatctggaatccagccttttctttctacctccattgctcccaccctagtccaagccacagtcatctctcctctggaatatcagaatagcctcctaactaatttccctttcttccactctgacccaactcatagtctattctccatatggcagtgagagtaatctttaaaaatttaagtaagatcttatcacacccctcctcaaaatcttccaatagtctcctataacaggtagaataaatccaaactttttaccatgacctacagggccctacaagatctggcctctgattatccacctaagctcatttcctacgactctccctttttctcatttaatttcagccacagtggcttcctttgctataatttgtgcaaaccaaatgtgttcccatctcagtgaagagtttcactgactctgtgagggcttccatgagggtctgattgccataaacacaatgcttaatgtccctggtgatccagctgggcgaggtggctcaggccggtaatcccagcactttgccaggtgaaggtgggaggattgcttgaggccagcaatttgagtccatggtgatagttctggaagttccagccccccctggaattatttgggcaggtccaagcaggccccaagaaagatgcaacacagccggccaaagtctagagaagagcaactaaataaataatcaagaaagttggggtgggggccaggaaaccccacaaaaagacatttgaaaacatggtatatgtttatggtttctgccatgctatctcgacctctggtcaagtatcaccttagaatttttttctaggattttcattcctaaggacctagctcccaagtcaattggaagtttttgagtcattgagtctacaattcttttatagtctccagaatgactaacatagggctagaggcacagtaagcatttaatatatgttctagggaccacctgaattgaaatgaaatttaatgggattatatgcaaaattcaaaaaggtaaagatgaaggagacttgacttggcagaaagaactaagttttggtttgacctcaacctgagttgatggaaagactctattgactctattatattcttccagtgcttctcaataaaaaaaaattttgttgaaaggatagaggaatgactaaatatattaatgcaaattcaaacagcattggtagaaaataatgctccaggtcaggtgctcacgcctgtaatcccaacactttgggaggctgaggagggagattcacttgagcccaggagtttgagaccagcctaggaaacatagtgagacctcgtctctacaaaaaaataaacaaaattagctgggcttggtggtgcacacttgtagtcccaggtattcaggaggctgatgcaggaggatcacttgagcctgggaggtcaaggctgcagtgaactaagatcacagcactgcactccagtctgggtgacagagtgagacgaaagaagcgaaggaaggaaggaaggaaggaaggaagggagggagggagggagggagggagggagggagggaaagaaagaaagaaagaaagaaagaaagaaagaaagaaagaaagaaagaaagaaagaaagaaagaaagaaagagagagaaagaaagaagaaagaaagaaagaaagaaagagaaagaagagagagaaagaaagaaaaagagagaaagaaagaagagaaagaaagaaaaagaaagagaaagaaagaagaaagagagagaaagaaaaagaaagagaaagaaagaaagaaagagagaaaccaaacagaaaagaatgctctaaaataagaagcaaaagtttgttgttgttgttttttcattctgttctggtcatttatttggggtaccgtgtctatttctatacactctaaatagagacagacattaccaactacaatgtgcctacgagtggaaaaccaaagttgtgagagttctggaaacaatatcagtcagagtttcacctgatgaagagatgagaaggggacataataaaggcctttcaataattaaagaaccgttgtacattaaaaaaaagaaccgttgtaaaaagggacagaattattttacatagctctaggggatagtaccgggggtgggggtgtggattaaaatactacctattgaatacaatattcacaaactaggtggcaggatccgtactccataccttagcatcacacaatattcctatgtaacacatctgcaaatgtaccccctgtgtctaaaataaaagttgaaattgtaaaaaggaatgggagttatagaaaaacaaagatcatctcagaataaggaggtactttcttacaataattgatatctcatgctggactgggctgactaaaatagctgtacactaccttataatggtctttgattaggcatatcctgctacgattagataaacatagcaggatattgtagaggagattttttcattgagaggaaggttgaactaacaaagtgtttttcaaataagattgcaaccaattagtggggccatgaaatccatttagtgggtcctgagcaacattatttaaaatgaattagaatagaatagaaaatatcagagagcatcacacatagcaaggatgagtgtggttttgagaacttgttttggaaacaatgtttacgtatgtatgaacgtgcctactaggttgcagtgtaacgtgttttttattactgtggattgcaattaaaaaaaaaaaactactgcactaaccctcctccagactgaatatctggcagctctaagaattcttatctctttggtgcagagatccaaaattgctgtgtacgagaaaatgtggtcttacatgaaatcagcggagccatctgtgtttaccaaaacaacagcagacggagtggcccgagtgcgaaagtccaagggaaagttcgccttcctgctggagtcaaccatgaatgagtacattgagcagagaaaaccatgtgatacgatgaaagttggtggaaatctggattccaaaggctatggtgtggcaacccctaaaggctcagcattaaggtgggtggaataatataacaatatccgtgttgttatagtattccacctaccctgatgcattttgttgtcattttctttcttgtggattttgaggtaacttttaaaagtttaaaatctacaatattccatggagttaaataagacggtaaattatggtttcatctatttaatgcatccattttttttaatgttctctctctgtgttgtcctctctgactgtttgttgctgttttaattttacagttcaacggctttttcaatttaaatggtaaaagccaagttatggtgccatatgtgacgaatgttaattgcatggatgtggtgttcttgttactttttttctcaaagacaatttccccatcccgcacacttcagttttgagcaaatgttatcctccatgccaccttccaatatttaaccctgtatttgctgtacagacatttttatagctccacgttctgtgaaatttagccaatttgtcctcttgtgctcctttttatacgttaacgatttcctaagcatttgtgcattttcttacaagttatgttttatcgtttcaagaaatgctgttaacctggcagtattaaaactgaatgagcaaggcctcttggacaaattgaaaaacaaatggtggtacgacaaaggagagtgcggcagcgggggcggtgactccaaggtcagcctcaatgtcaccacaaccgggtacccttagtgacgagtaatcggcaagactgttatcttattattgaggagagagcacaagactcacacataaagtggaatgaccaggttattcccctgcctggcagctttgggaaccaaaaagactttagggcactgcccacatttttgatctaacttgggtcccttcttcaactcccagacagaggctccaaccacaccctttcccttcctttacccaccagtttggttgccttatgaaagccatgatgtgggtttcaatgccctaggctttcaagagtccaaggctttcctgtgagactgtccccgcctgcctcagttgagtggtatgaaaaatcagatccatctactgaaaaatcagggcatagccttttgttttctaggttgtgatggttgctcacagaggttggttggttgagtaagggtggcttcttcaattatgtgtctgagtgatgagatgttgttctctatatgtgatagcccatttaagcaggccccacttaacttgaaagccaaataacaagctcggtttcaagttaaatggggtctttcttcaataggccaccccatatagagactttgcagagacattttgtgtatttaagcaagtgcgtcgcctaactgtgatactatatgtgtgtatgaatccctgatttagcttctccttagccatgttcttggttcaggtaggtctaattgttatccaggctgccatcatgagaaaacccatcttacttggcattcctttgacttctaatgctctttggagctagaatgaatgaatagccatcatccaagcaacaagaaataggggcaagctcagaagccgcgatacaaagtcatggaaacacacttcgggtaagtacaggagaggacctgaaaatagaatcctccttggcccaaggggcatgagaattatattgaagcatgtaaactcacctcttgtacgaccaagatcccatgggcatcttaaggtgaagaacagtgtttcccaaccacagaccaacagacaggcaagccaaaacttttcttcttcagagacaatggttgcacttctgctcctctctttccctctctatccctcaggatcctgatggaaaagttagtttgccagtctgcaaatataatatgggtttggaaacactgatccagaacactttcaaagaaatcaattttaaaagaactttcttcagcaaataatcttaccaggcattggcatggccttttatcgtaaaaccttgattaaccagaactcacctaaccagtaccccaactaactgaattgccccttcagtacttcacattgatgagaaagcagcaatagtattccaaaaaagaagactgcaaggaattgatttttttaaaaaatacttaccaagagatgacctatggttgggtcacattcggctctttctcctctatcttctctccatctggattgaccctcaaacgttagaggctgcttccctgaggcgagaaagtagatagaagcattttaagaaaaactgttattagccaacaatgaacaaaatggttgttcttattgaaaattccattcatcccttatggattccaattaatcaaggttttactatgtgtcaaaaagcagtaactttctttcccaccaatgtgaactgatgacactgacaatttagccaagcttttggctcatttcatatttacaatggccaacttgatggccaaagtatttagcacctgtctttttctcatgttatttgcacggagaacctaattgtatcattgaagtgagttgcagaatgaaaattgagctggattggatgcattgctctcacgaattcatcattcatactcatcatggttaaaaaggagccatggactgtaacaagatgactctaaaacatccacatgatgccaagtgcccagaagttttcagataaccagacgtttgatgttatataaacaaacaaaaaaatctgcacatatttggctgactttttacttttcacccagatgttttggtacatgaagaccccaaaactttagaccagctattttttcattacaaccagcaatcaagctttttttccctcagctagtactgctgcaaagttttttatcaagtaactttattgacagctcacgatttccagattatctgaattttgatatgcaaatagaaaaatatttcagtagatcctaaatgttttcaacttctctaaccatagtgctacctgccaggcatctttcaaatcgctttccttggtcattcctacagccagtcttttgaaataagtcaacccttttctcaactatggataatagtatgatcgatcagtgctgcatacccaacgattgcttattccatttctggattaccaagaagcttgcctttgtcttcttccttcttgctacctgctgttttctgagagtgagcaagagaaggggcaagagatgaacgtgaatctggttaccactacgtattagtgatgcaaaaaaaaaaaatcaatggagaaggaggtagaaatagcagtaaaacctcattaatttgaagccctctaattaataatttgtgataaactagacagggaccagtctacaagttaactttatattatcaggcatgaggacaagaaaggtttgttaagcaaatgaagagtttagactggaatgtcagttgaattttttcttaagagaacaaacccttttcaaatgttagaagcacttattagatataatcatattcgttacatatctataggctaaagtagctctcacgaggatctccactaaggcaatgttttatagtcagtttgaattacaaaatagacttaaagtaataaaattgtcattctttaaacctattttgtaatgcaggacttgctttactcattcagacaatcctttccctctgttcctccaaatcagtgaggttttactgtattagcaaaatggcttgagatttacatctcttcattgtgtcccatctcgttaacatgaaaattgactgttgaatataccatcatttcacagagaaagtgcgatccagagatggtgatgactttgagaaggtcacacagctaatgctgtcataaatctctgctgactttcagagtcacctcttgtgataatattgcagatggcaatttagcactaccacctatccaatgagcaatgtgaatctgattgcaagcgatatgtttccataagaatcaggttcattcgcaactaccttggttactaggcaaaaggcatatttaagctgttccagccctcagtactgattactaaaaatgacaataatcacaacgcctgacatttataagtgcttttactttttcaaaaacactttcagacctattatctctgaaaccagaagagggagaaatacctgtatcacttatctttctgtctctctctctctctccaacctttaactaatgataaatgggcaattatattaagtcattgactttttcttccctggcatgagacattacacattctgagattagtctagaaaagttaccatactatggaaagaaacagcaaattttcaggctgtcgtaaatgtgcatgagcttaaactaataaaactaatgttttattattttattttatttttatggatacagggaattaaaaacaaggtcagtctctgaggcagcccctgaaccatacctacaagctgaaaccagaatactccttggctttcccaatttcccaaacctgagctaataggacctaaacaaaacagacttgatcatttcttgatgaactgtaaatgcacatgcaaggatcatgtaaattagaactgtgctttgggaatttttaacctgcaaatcacccttttgtgttcatgctttattacaatgtgtgtgcagatgcagtaattaagagccagtaggttgtttcagtgataaacccagatcaccagggatttgtgacatagccagtgaaagtctatcattgtaaatcacagcagaatggaggatttatgtacagaactaccacataggcacatcagcctccttctgcagctgcctgtcccctcaaaagtttatgttcttatccaccctacttcattcccttaatcttgggtaaagggcaccagcttcgctttcccatctagccttaccttacaagatagggtagggtcagtgaaacgagctatttgtgactgaggtggaaagttattaacaaaccctacccaacctcaccacagaattataccagactttagtcctctctagggattaaaatagactcccagtttccatatattccaagatgaaaatcagcacatgtgtgctcttgggaacattgtaacaatatttaaagggaccattctgagccccttgactgcaatgataattgtaggataggtgggtgccttaacttgagaggcatataaggaaatgagggaggaggatgggatgtgcaattgaacctccattatttaaataaatggtaagatgctcattatgacttatagaatattgatagagaaatgcagttttactatatcttcaaaaatatataggaactagaataaactgaccaatgtgatgctaggaaaaaacatagggaatttgtttaaatcgtttcaaaaaatgcctgcaattaaaatcagtggtgtttcctttcacatgggtgctcttaaggtacctaaaaagagtttgttctctgaagaaattaaaacatgttcctcctccctatcactagctatctttgtttttttaaatcccatgcatttgcttagcaagtcttctcttcaaagatagtaaaaagttacactctcggacagcccatttccaaaatccctcagcttcatatttggtggcacatagatgaatgaggttatactgtatttcccattggtatacatgagatcttcagttttgtgtgtatttcttcttcttccatgtatgtctacaattctcctctcctatgccaccgtctcttaaccacttctcttccacacccagaattctttgactttcttgggccgtgggtaatggatatgaatctgcatctgcctttgcctgcaacaaaatggaccttttattggcaggagccatccctaaaggttgacatttcggatactcagggttaagatggatcccaatgactctttattgacactgttatgtgtgtaggcaagaatcattacagatcgatggcacttcctgggtcttagcagaagttcctgtgaatcctcaagactctggtttgggatcgaggagtagggtgagtatattgtgctcttcgttggtttgcatgattctatgctggtactgcctcctggaagtatgaagaacctgacagttttctttcctggtagtcactaaatttgctccttgaacttactcaggtcttcctcccaagagcaaatcctcactttctctcaagtgactgcttcaagcaagggacctgttgccttaagaactgaaccagtccaatggctgccaaaaccattgattttgccaaatgatattaaagaataaattctaccaccggaaaaaaatgtaatccagaaagaaaacacttttaaaaaataattccattctaatgattttttaaaaaatgaactatggccttaacatggtttctatgattaggacattattatttgcctttggtgttatcctgataacatgaatgtgtttcttattgacaaataatgaccaaatgtccaacaccagagctacagaaagagccacaggaatgaaaagcctgaaggtaagaatgctgttatacaattgccaagaggaaagatgccattgcagtggcagacagtgaaatggtgtatgtttattccctttctgccctttgaagaccaaatcatttggtttcctttcatttgaagagaaggttatacacaatctctgaaaggtaggacagccatggaaaagaaacatgaaaaatttgatgcaattgaaatatatttggtgagggtgggagttggggttggtggaacagggtgggggcaaatttcttttacgaacaattgaattccattctcttttgactttctagagagcggtatagcattcggcccttggcacatgaggctgatccccattgatcagaagtggcaaaagtgtagtccaagtgctggattcacctnnnnnnnnnnnnnnnnnnnntgctaatagagggtggtatatgccctggcatggcaaacagatctgatttcagatctgatatatagacttcacttgttgcaatctagctaaaactgattatttttctatgagtcatggtcaagggatggctattggagaataaagaggatgttggcacccatcagattgaactctcaatgcatattttgtctaggatcaggggaatgagttaaatgtcttcagaaacatacatcatgtgagtttctggtaccgatctgtttctctcttctcattctatgcttctctaggtgccattggaatgaactaaagaaaacacacttatatatgataaaacccaataaaatttgatagtttgatctttcaaaggatcttaaaccagagttttcaagtgaatcatgccaattatgtatttgagaaagtgtctatggccatattttgttcaaaacttagcattttccctgagccccttctctctgtcagggataaattgagtaagaggtcttcccagactattgggttcaactactagatggagaagttgaacagaggtccagtttggcagtttagtagaaatctatcagtgaaatacacaacctatggaatcaaggggtctactgctctgtatttgagaggttgtaatttagaaatgtcactggctttacccatgtgtgtaagagttgcttctggggctgctgctgcagcatagatgctcatcaataggtttcaatcactagcattgttaggcccttagtgaaatgactcacagctttcaactcttaatgttatatgcacgcattattgaattttctctttgcacttatattaaattattatcccaatagcaaggagttaaataggtttgagctatatttgtgaactacatgaatataaatactctctcagagatggtttctagcagctaagcactgcataactgcaaatcattgtagctgcccttgttaaatgaggattatttaggttgccagagttcagtaatgccagcagccatatatgcacatgctcccacgttgtacagaaagcccaggctgatccaaggatagaaggattgaaataaaatcctcattttcctggaatcctacattcaggaacccctgtgaaaacaaagggatagagatttgttttaaaggacttcagacactggtgtactcaagggcatattctgaactgccatggccttaaacagctgctatatggagagataaatcccttcattatacatatcccaggttaatctacagaaaagaatgtaaagtaccacatagtaaattctttaatacagcaaatattcttcttttgcttgatcatcaattggcttcagctaaataaagcaagaccaacctgggcagagatgtctgtgactgcctgcctgtacatgcctgttatgtcctgggtgatgctggggcttttccagagaatgctagagaagcaagtgagtgattgggaaagatgctttgccatcatgaaaacctgaaacatcttcagtaaaagagttagcaaaagagaggatggctgttctccctccattgggccaaagacatttctaaaaagttgttcccaaaagatcactagataccaagaagcaggtgttagtaacttagagcaagggtttggttaagggatagggtgagggaggggcttccagcttaggccgtgataagtttccattctcgtcatccagataatgtgttatcagagcagatttctaattgactatgcaaatgcaccacccttgctcatacatttcttttacttctctgtgatctctttgtctttctccataacctacatatttacacatatatctatctctcctaagggcaccattgaggatcttctggaataattaattaaacagacatttgctctttaggtgtccctgctctgaaaggagaagtgaagccatttatagtagtatatatcccatagtatttcaggggactaaatcatactacaacctgggttctgatatttttcaggcccagaaccatattgacagtatagattcctctctttacccttccaggatcaccagattatttcacagaatcaacttggtaattaattgacaagacccaattttccttcttttcccctaagctcagcaccctcatatcactctcttcaccatttctttgttcatgataaggaatccaacctggttctaagctactatttgctatttactattttaggtatttcctgaaattaaaactttaaaataaattaagcagttcttttgaaatacatcaaaagttttatttattttgttttttaaaaaaattaagttttggctgggcgtggtggctcacacctgtaatcccagcactttgggaggctgaggtgggcggatcacaaggtcaagagattgagaccatcctggccaacatggtgaaaccccatctctacgaaaaatataaaaaattagctggacatggtggcatgtgcctgtagtctcagctacttgggaggctgaggcaggaggatcacttgaacccgggaggcggaggttgcagtgagccgagatcatgccactgcactccagcctggcaacagagcgagactctgtctcaaaaataaataattaataaaaatttaaaaaaaaaataagtttctactttcacagaaaaaaaaatcaatggcattcttatcctaaagctgtctccatatgtaaggttggccatcactaagataacattgattctttaaaatggctggttggtacaacccaggaactgagcctggaatccaggagaccaccagctggcaggtggaggccttggattgtgagcagtcttagtagctgagttagtggcaggtgtggatggtagagataagcagaaatttttataatccaataatgttttcttcaaaaaatgaactcattatcaaagtattatgaattacattactatcctccatataaaaaacagacagatgtaattccatgactgttccccacactcaggaatcatcactgagacacaattcagcattaacttcacatacttttaaatgactatctaattcccatttctctcactctctccatctgatcagcaatccatatgcatttttatgacttacatgccacaaaatgttttcttaggggaaccttacactcttccaccccacctcaaacatttttttagacaaaatagaacaaagagttgtagtttataaatatttactctttgtttcatttcccatttctcagaaggatttgtattttaacaaatcatgtcacttgaagatgtgaaattctcacagtggaatttcagctgccagtgagataaatatttttggatggagggatgttcccagtccccatgaaattatgtcacaaagcactcctgttttttccctaagcctgctgactcatgtctttgtcttaagacggctctactcagcaaaaagttcatagcaagcccttcagaggggagagtgcctgactaatttccacgataggaatctgacctactttgtttaattctttctgttctctattgaggtgagtacaataaatatttctgacttataattctcttaggtaccagttaagggcctgcagtaattgctgtgaaacattacactggagacattgctgcaccacagtaaaaggccccagctgcaaaatacacccttgctagattgatagttatttggagtatgggggtccctaaaggaaaataaagtcatcacaaatatctaagcttgaagagcaaaaataaagagggatgctacccttttgtgtattccattggagaatgtacagaacacagctcaatgtatattaattggcctcttgacccaccccataagttgctgcacaggtttgtgcaaattgcttaacctatctgtgcctcaatttctttttgtattaaatagacaccataaatctaccttcttagggtgatcattaaacctgaacaataattataatcataataataagtatgtaaatatactagattgaaaaacaaaatactaaaagagttattgatttgacaagtatttattaagaaaaatatcctaaatggagatacaaatacatgagccatattccctgcccttgagaagcacacagtgtagtgggagacataagacataggcataaataataaggcaaggtagaagtcatggaagagacagaaaacattgaagagcaaaaatggcttcatggagaaaatgacattcaaaatgatcaaatgcccacctatttccacttccttcaaaatacctatgtgtaagagtgtgtgtgtgtgttggggagagggtgtcaataccttcagttggttaggattgggctaggtaacacatctaataaggtacagtaagaaagaaaactatgtggacaaaagcagttttcctctgccgtctcagaaatttagtctaccccacagcaacatagagttctaggagatttggattttaaagtactttcttttcttggcatctattgtaaccttgttaagtggtattatctgtgatttctgattacagcttttatgtttgttggctgtgctgctgcttgaaatgtttgtttttctccctcatttttatttagaagttcccaaaagcacattggttccctgccaggtttcataaaccctgtgattatttttccgatccaaggctaaacttctaagagtaggtcatttgtcaaaattctctaaagtcctgtggtatctcacaggaggtctggatactcaaaggcagcatttgttgcctgtagcatctcccggccccgacccaggtgtgacaacaaaaaatgactccagacattgccaaatgtcccctggaggacaaaatggcctctggttgaaaactattgctctaaagtaacctacactgtaatggtttaagccatgggagtgaaaagcagttactagccagttcgtggaagccactagatggcctaaggcagggataagccattgttcagaagtaggatgctaagtcaccgatgtactgagcctgggttttggcaagagtggacagtggcagcccagcatggacccctagcacaagaatagccttccctcctccaaaacctgtttctgaaatgctttgtcccaggacttctctacattcttaaaaatgattaagaatcccaaatagattttctttatgtgtgttacatctattcatatttaccacatcagaaattaaaactgaaaaattgttcatgtattcattgattcattttaaaaaataataaacccaatatatgctaacataaataatatactttcatgaaaaataactatttttctaaaacaataaaaagaatagtgagaagaatggcactgtctatatttctgtaaatctctttggtatctggtataatacagagaatgagattctcatttctgcttcttcaatcaatctattgtaatttcacccatcatatggcctccaggaaactccactgtatatcaagaaggaataatagtgagaagggcacttagtattattataaaaatagttttgacctcacagatcttttgatgaaagggtttcagggatcctccgggggtccctggaccacactttgagaacaactgctctaaactgacatgccacacttttatgaatgtagttcacttaagggttgataaatttcttttgaaactaggatctctaggagcagtgaaatctccctattagaccttagtgtgagtacctttaatcagactgctctgttcctaagatctggtgagcagcagtactgaagaaactgaatgacgtaatttgaagaacatattaccgggagggaggacaggaccgggtaagggcttagtcaggtagcagtgtgaggacactgggccctttgcaataagaaaagaggaagcacagaaaggaggaagaatttgctttgtagtttctcctgtggtcctgatgagcccagtcactcatatgccattggaaagcatcttcccctgtatcctgagctaattgccacattgctgagcctggtgccactgcctgacttaaggcatagcattgcaggagaagtggtagtgatgagacaacaacagggaagaggaagagagagaagagcatcagacggtggagaatagaggagaagacagtgccaacactaaactcagggccatcgatggcctgtctgtcatttgaaagcctgacttaactttcactgccagtaatatcttaaagaggctcaaagttttatttgagtatatttttgttgctttgcattccaagcaactggttagcatttgagaagcctggggttccgagcattggttgaaggaacttgtttaaagtataaaaggatctcaatttcctagtgagatacaaaatccaaatattctggctgccaggtcctacgctaaccaagaaagttacctccctgatattaaagatttatagttattcaaaccgcaagtactctgaaattgcattatttttaaatgattatatctttctcagactatctgaagataagatagcccctctgttttaaacagcaaatgagggaagaaaggaaataggttttgggactttgtatgatagagaccagatctctgtgactatagcaagtcttattagtgactggatatgttagtgggtccaacttatccaaaataggctaagaaatttttacagcatgttcacagttccataaatttttctgctgtcctctttttaagttagtgacattcagaccaacatgcactaatatttggcaatattgctcccatgaatgtgaacagacagtttattgcctcagaattatgccaccctctctacatggtgcattttttatcccaagtcattaaagattcttcatttaaaatctaatagctctagaaagaagacaggataaaggtcattattcccattttacagctgaagaaatttataagggagaaaatctttatcctagaaccagtagggtttcgggcacttgcccagtggctctgaatgcagtccttatgttttaagcagtgaaggactaaggagcagtggcctggcctcctggggatatgtactagcctcttagttgaggaagtcttatcttactagaacaattaaactatttctctacagcgttacccaacagtggcagagtcattttgctggtttaggccctgccatattaataatccattttgaaacaatctggtttgccctctggtgatctaagttgaccacagacatatggccatatcagaaggacagccaatcagtaactcaaaaacaatccatagaccagtttttacattgttgaaaatactccccttatccaaaacagaggtccacaatatacctttaatactaagaccagtatgtgcataagaatttcgactacatgtttgtggagtaagaacatgtacgtggtacagttctttctgagatcattttcagctgggcaacagacttgtgtgataaaggacaattaattagaaggcatgttatttatgtagaatctattttcaattctgttcggatttatccatttgtctcggtccacaatatggaaacacttccccttctgggtctgtccttttcccgactcctccataaaatttgctttctgtctggaagtacaacaagacacccagttagatcaaacttaacacatctccttcacaaagctactgcaagctgccgccgacgattgtcacctgaggggagaccctcctcaccacacacaacctatctgaggagtgcctttttttctatcctcattatttaacagtgtgtgccgattactcaaagcgatatgggcaggccctggtaaatatagcgttgctgtagtgttaactttttataaggtaatgctcaggttgcctgcagtgtctaaaattactctgtggccagggccccctgctttatcgctttctatagttttaaagtagtttgaagcttgaataacataaaataacataatataatgttatttatgttatttcccacgtgaagaacgcctgtaaaccttgcagtattgaaactcagtgaacaaggcatcttagacaagctgaaaaacaaatggtggtacgataagggggaatgtggagccaaggactccgggagtaaggtcagtcgctgaaggtctttttgtactgattagcaatcacattttgacccactgtttattttctaccctaaaacggctttccttcccaacacacactccctgacacagtgggacccctttataacaacagtgctaaaggaataagacaaatgccagcctcagaggcctgccacatgacatcaattgttgactctatagaacagttatgatgattaggaaactcaatctggcctactgcatttccaaagttataaaataatgagctgtgttataagggggttttactgtatttcacatttcaaaagttcaaagagaaaatataataacaataacaacaacaacaaccaaaaaaaagaaagatttatttgtgacagtactttctcttaacctcttacagtgtcagagactttgtagttataaatgcatttggttattaatatattatgtcaatcccatctgaaaacagtcaaacgaataaataacaaagactggtctctgtaagcagaatgattagcctcctgccagctgctgttgtattgagttcagcattaatttggatctcgaatctcattaagtctgtcacacttctctcttccaaaggtgtcatttgaatctctgtacgtaatacttttaaaatttagtcgcatgctccttaaaggtatacatcgttaggataacatcacattgataagcatgaaacactcttccccgcctccttcctgccccccttcgctcccctaagaaagttcttttttagtttcaatttttgcctttcctttttttggactaatatcgtggtatcagttaattcatttcatgaaatgccactcattttccccgtgcaatgaaccattttgctactggttttctacatcccacatcagggaattctataactcttgtgaaacttaaataatacatggaacttgaaactgttcttcttgtcacagcttacatgggttatgtcaaaggacctctccccccattaaatatcatatacatataaaagtctaatggcagaggaagggttaccagaaattggtctatttcccaatggactgtggaacatccttgcagatagcctcaccagtctccttaaagagataatccaatatttcatatgtgacagaaattattactacttgtctagctgtcattcatcctaaaagagtgactatttgcaaggttgttgtgaatatgaggcattcccacaccccgtttctgaatgcaattcaatttcaattggaccttttattaaagtaaacaagtataggactggcttctatgaaaatgggataagaaggacacggccatattgtctttacttttaattatttaaatgataccaagaccagctgaactagagtgttaagtgtcagcaatggccatcatctgtcactgtgttgtcacttaaataagatgctcaaaattcactggcttaacaatttgggtattccattcaattacattcagcagcaaaatggttacataccctctaaaaagactacaaaatgctattttattttatttctttttcaaagaaagactcctggcccttggtgtgtcctacctcaaggtagggctcaagacaccaacttttttctttccattgttcagcagttcagactttgctttttcatacaggcagatagcttagtcagatttgcacagtttgacctgaaagtcactgaccggcttcctcaatttttcccccttgttacaaagaaagcaaataagtgtaatttttaaaaattattctctacattccctggagtaaaagttaaaaatgagctggatttttaaaaaaatcatcagcctcctggaaaagctttctgatttgtatggagccaatctaggacccgatggatcctctgacactctccttaaactctcaggaaaatggaacggagccaattctttgtgctgtgcccttgttccagcaacacaaagacttgctgccctgattttaactaggatgaagatttagcagccaatctccaaagggagcattttctcagccactaggggaaagaggagagttaaccctttttaagcaaacccttgcaaaataactcctcagagaaaaatagcaggaacctctaatattatcatgtcgtatcttaaagactagtcgttcacaaagtttgtcacagggagagcaagggagaaaggggtgttgcggggcagagaggggaaagagtgcttcaagttcccaaatgaaaagagtgttacatttatagagattatgtcaccgctcaactctggccaatggtgtttatcaaggctggcagaggaataaattatgcttgtgtttactcttttgttcccatggccaagtgctgttttattaattgttgaacaccattttgaggcactaaggaacgtaaggagtcaagatgaaaggacatttaggtgaggatcaagactgttaacagaggcacaatctaccgtcttgctggtcattgcaaaacattagccagttgccagaattgagtcataacacttacatcaatgtttagttattttacaatttagaactcccctgtactgttgtaatatattataatgttccattgcctttgttttccccaagatctaatcacgttgttcatttctcttaggacaagaccagcgctctgagcctgagcaatgtggcaggcgttttctatatacttgtcggaggtctggggctggccatgatggtggctttgatagaattctgttacaaatcacgggcagagtccaaacgcatgaaactcacaaagaacacccaaaactttaagcctgctcctgccaccaacactcagaattatgctacatacagagaaggctacaacgtgtatggaacagagagtgttaagatctaggggtacggttaaggtctagtaaactaatcagctttactttactgtatgtcaatctctttttttcttctttttttttttttttagtttggtttattgttcaaagcattgtctctttgcaaccatttgattctttgaaaacaatggttgtgctttcttgtcaggcagtggtgcttttctaatagaatggttgtaattaaattgtggtctgtgacccaaaaggaaatacaattctccagaacatcattgttcaatagaaaatatatgcaagccacatacatgagccacgtgtgcaattttaaatgttctagtagtcatatgttaaaaagtaaaacaagtgaaattaattttaatgatacattttatttaacccaatatatccaaaatatgatcctttcaacatgttatcaatacaaaaaaaagaatgacaaattttacattcttcacgctaatcttgcaaatctggggtatattttatgcttatggtacatcttgactcatactagttacatatcaaatgttcagtagtcacacatggccagtggttattgtattggacaatgcatctctagagaaagcagctgctctggaacagatattaaaattaggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaaattaggtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcctatctgaagtggaacagaacaataagcaacttcataccccttattttaggcaattttgacctcatgagtaaatgtcaatatgctgggatttctacaagtgcatttgtgttttgttgttgttgttgttgttgttttgttttggggtttttttggggggtgttctgttttgttttgtttttgaggcggaatttcactctatcgcccaggctggagtgcagtgacgcgatctcagctcattgcaacctccacatcccgggttcaagcgattctcccgcctcaccctcccaagtagctgggattacaggcacttgccaccatgcccagctaatttttttctatttttagtagagacagagtttcaccatgttggccaggctggtctccaactcttgacttcaagtgatccgcctgcgtcagcctcccaaagtgctgggattacaggcgtgagccaccatgcccggctgcatttgtgttttggccttcttatagttcacactgtggatttacatttagccaatttttaaataatatttcattcaaataaatcatttgtcttggtcatggaaaacataattttgtccagtgaagttgctggttgttccttcttcctgccttttgccacaacatattcagcacactgcaccaatccgctgacagtgttcccattgcattggtggatgtacaatacatggattcatctgtaattgcattgtttgcatgcaagcatttaatgtttcaatgtgcttaaaatgttttactcttgagtaggtgccataggcccattacaatttggggcatatgtttttataggataatattaatacatgattcataatccattttcaaagtgatccactttctttctgtagcctacacatagacaggcttgctggacatgagcaatttcaatctaacttaattatcccaaattttgaggtgctggcctccaaataaataatacacctgaaatttgtgtagcagtcatccaagtgttctcacatctattggctcatttgagataagatggatcaggcaattatcagtaagacccagcccatgaagtgacttactcaaggcaacacagttaggtagtggcagttctgggactagaacccagcccttcttctgcctatagccatatctttgctaaaccatgctacttctaaccacccatggcctgatgtcccccaggaaacttgaaatcctaatgggatcctgtcaaatggagagcagatcttgagtttctgttccacttgtccacaaaaaaagtcttgagaaacttcaccaagcctccatatgccccattccttatgcactccacacaagattgaatattcaatcactcctactttccccagaaagaatctttctgaaacaggattacatcaaggctcagggtcacatgacctccagactctttatcaacgattccatctgagaatttatgtccctactatccaattactatagcctcagactcttattaaagccccagagcagtattcatcaaacattagtgtgcatgcaactcatgtgggaaccttctaaaaatatagatcctgatccagcaggtctgggatggggcctgagggtctagatttctcacaaactcccaggtcatgcagatgctgctggtcccaggagtagaaagattctagagaaaataaactcagagaatgtaacttaagaaaagaaaggaaggaagaaaagagggatagagatacaggaagaaagaggaagaaaggaaggagggaaggaaggaaggatggaggcagggaggcagggaggggggaaaagaaagaaagagggaaggaaggagggaaggaaggaaggaaagaagaaagggagggagggagggagggaggaactgaaaggaaatgaaaggaaagaaactgggatcagcaaacctttgttaggacataatgttgccatccaaaagtggcggcctggaacatcaaacctgaggggaaagtctcagaaactaatatgccacaacttctggctttcctttactcatctgagttgatccacttttgtgaagcaaaattcaggctacttgaggcaacactcacattttaatagactcccatgccagtgtggttatagcccaattacctagcaccttggcaaccatctccagggtgaaagaaaggttgggaagagcatctgcaaacaaatctgtcctccaagcctgtacaaagtctccagacaagaagcaaaagcctcatacgacgccaggaaaacctcacttgtgttagtcaagaggcataaagcaagctgctttgaaacctctctgttgtcctcagccaatttggtgatgtgattaggggaatgttggttaagtgaagagtgagatcttcacccactcatcttttatttcccaagaaggtctggaatatctcctggtgacttctaatttgttacctagttattaggcttccagttctctgagttggcctaaatctgtcaaggtctatccaggggcaccgacatcaagaggtaccctgagattttacttctattactaattatcagagcccaccttgggagtttatagtaccagtaattgttcaggaaaaatgactcagggcaaatcacctgcaaaaatgtgatctagtgaaatctggttaataaaagggcatccttgaaagatgagggagtcgtttctcattttctatgggtgatagtcacatcaggattactgggcttattgtgggaacatgtgcctcggcctcagatcatgtttagctcccactagggagcagaaagcctcttgactacctggtgcctctctgggttactgaccagccactggaagtgtatcctcccaagcatgccttggcaggtgactgcccatcaagtgctccagattcactgcaccctagggttgactgtgctaattgttttaggaagttatttctcatttcctaattgcagttcagaagtacttctggcttctttggtttcttcaaaaatatttttgaaatctctgtcctttacaagacctcaacatgcctgaagttaggggaaaagattttcatttttcttgtaggagttttctgtttagtcatcctaaaaatattagctttgtggatgcagcccattttcaaagtgatccactttccttctgtagcctatgcataggcatgcttactggagacattttgctgctgaaaagaattcacgttatgttaagtatgaaaaaaaaaagcattctggataaccaaggtgatgatgttctttctcccaagggacttttacatcagtgataatagttcatttgaccccatttaaaagtggaaacagaggcactgagaggttgggttcctttcccaaagtcatgccactagttagtgatgtcccatgcccactggggagacagggggagactttattctttctgccagatacaaaacttctccaagcttctgcgatacatatgactcaggacttaggggtgccaaggaagaggtttgtctactttcatgttagtcttattctaccatccttggatgcttttggccttcaggtgcatatttgacattcttcttacagatacttttactacagggccagtggtagatcataattacgtcattcttttgggataaaattcggtgttagcttagaagaaaaggaagtgtttcattagtgcagaatgaaaggataaagagagggatgtaaacttgaagaggaggtaagaaagtgtcctacagtattcagaatcaggggcaaatgaatcccctgcactagttagtgcctccaaaaagaagacactatcagcatttcaatcaggcctatatgtcagggcaaagaccgcattgatgccaagtccccttcatgggtatcactgctctggcctcttcctagaatctgctgtctctttaaagtcccagagctattttcagactttaataactaaggttgtaggtactaagagaaacaattgctcacttttctagcaataagcaaaatattttcttctcacagttaaaatggatttcaattcagtaagccatagaacactgtttaccctctgtcctgggtgaacaatcctttgtcatagtttctgcaatcagaatacactcttttagttcttgtgaatatctgtattaaaatgccatggaaactttctggtatacctacatcataagtgattaaagccttgaattaaacttcctgcaacacctgcatattccttagtacaatacatatagtagagaatgtaaccagacctgtcacctaaagccagtcaaataaatgaggtgcaaccccagaaatgccaatttcagaaaacagccatagttttgtccaagatagactgagccattataaacttctcaattcctaataggaagccccttcaaatttaaatatccccttgcctttgcagatcccttcccactggaggcatgtgatgagaggaaatcaccgaaaacgtggctgcttcaaggatcctgagccagatttcactctccttggtgtcgggcatgacacgaatattgctgatggtgcaatgacctttcaataggaaaaactgatttttttttccttcagtgccttatggaacactctgagactcgcgacaatgcaaaccatcattgaaatctttttgctttgcttgaaaaaaaataattaaaataaaaaccaacaaaaatggacatgcaagattccagtatgcgaaaaaaaatcttattaagtcaattcaacaaaagccattctttgataccactgcagagtatataaacaccatgttctttaatacacacacacacacacacacacacacacacacacacatttaaattccaattcagcaaagaggcccatctaagctaaaaaaattaattcttcctgattaaaaagaaaaaatctgtctcccagtgtttgggaagacggactggcatttcttctaggatctgctgaccagatgtttttggtatttcctgttggtggtgatgttctgtgcactctatttcctttcaatgttgctgaaatgtgtatatctttagaatgtaaatgcaacacttaagaaaattcaaacactttggaaaagggactaaacagtgatttctctgtgttcttgaaatggttttgtgaaaatgctttgataacttcccactcaaagaagagatttacagagctttcgaaattgactttgtgtgtagcaagggacggggcactatcaggatacctcttggtgctttcctaaaatggatcccggggctttccaaggagcctggaatttcagctcacagatctgtttttcttgcttcagtgtgcattttaagtcaatagagctgagtatctagcattgaggtgagggaaatgctgcctatactcccagatgtgtttagaatatctcagaaacaacactgtgtttagctcggctttctctgctaagtatgcctttcaagtgtacaccacggagacaggaccgcgttgcaaggcgggacagcaggttcagaccacagttctcagtctgactttactcttgctaggtctgtcctactagctgttgcctgctaccgcccatggctctccatcggactgcatgtgtccttttctagtttgcaaagactaaaatgcattcccaaacctactgctaatctgagggcctcagcatcacttccagatccttgcttggagcagtctctctattgactctctcagatcgctccactgctccatgggctatcaagtaactaactgcatacctgccgttggcatcatcagaacagtccgaagaaatagtctccactcactaattacctcctatataacgacgtatgcttcctgtagttcagtagtttgctctcatcgataacgtgcattgggaagtttccagactgcaaaaactaggagctcgcattcatttcccaagtgtgacccttagatgcttagttgactcgctgcatatttgctcttgtcttcagaaaagaaaggaagaagtatcgttccaacgaaatgtttccagaaaagtgtactataaactttcattccaaaaatggtgtcataagcaaacaactcacttgtcaaatttcaaatggtattgaacaaaaaaagaaagctgttgtgtttttgttttgttttgttttcatgaaactgtgattttcaacttatgaatgctataatgtcccagcgcgggaagctcacgctgtgtgaacatgaagttgtataaaacaaaccaaccaacctacacacaaatgttttcataggcactgtataaagaaaaatgtatgtttattaactcaaatcagtttttcagagaggaaacgtcactgagatgaagaggcgggtaaattggtttgttattttttaaaaaaaacttgcatgtttaaaaaaaagttgattgcttcaaatttctgctactaacttcaagctatgggagtttggcagtagtcacttgaggattttttttccaattcttttctttttgttgttaaagctgtacttcagtgaacagaaaaattgccaagcaaactaatggctataaaagcgtaatttgcatgtgtgggcataaactacagagcctcattgccatgaggtattgtacaaagttttaatacattttgtaaataaaattgtaaagaaagaattctgtttctgtgctttggctagatgtttaaaatttacttggatgcagatgccaagaagttattcactaactgacttcccctagaagctttgccaatgatgtaacagtcaccttactggtgactttcacaaaggattactcctctccccaccccaactgcaactgtagtcaggcgcagacccctagcttaagcaaaaccatacatccaagaacttagattagtttaactttaggatcttccattcccattctttgtctcctccaccctttgggactcctttccagaggcctgccttggctctaaacttgatcttcaattctcccatctccacaactgacctcccacagaagtacctaaattcaagattattgaccttcaaaaacacttccaattactttcctatgccatcataacatatatgtcctagtactcttaattgcttagctaagttttgtgctgctgcttcaattaccaataataattcctaactggaaaacgtttattccaccaaggatcactaatctagagtgggagaagaaataatgaatttagaactatactgattttagaatagttctgacagagaaatgaaaagctaattatctagtctgatttgtagattctgaacacgtaatacaactttatccaacaaataaagcaagtgtttaaatgtacaccagcttatatcataatcaccttagagaacagaggataatgataggaggaaaggagaggggataatctgcaactgaaccaaaaaagaaggaaagtgcagctgagatgctagagagatcaaggaaaaaagatatctggggttagggagttaggaagcaaggaacgcaagagcttaaagaagaagaaaaatgggagtgggaaaggaagactgagaaaattctgaagtgaaggctgatataatcacactgtggacagcttggcttactgtaggcatcatcataattactaccattttcactgtgctctgaaatgctaaatagctgttaaaccactcacacttcataactcttcaactgctttttaaaattaagacacctgttgcagtcctaccagaagacaattgattctccggagcaagttcagtgactagattagagtgatgaaatcagttcaagtaccaaacaatgtccctggatcctccaaaacaatagatttatgttttaacagccacttcaattccttacccctaaaggagaagctaatctcagttgctgtcacagataatggagcactattttggtgtaggtgggattttggggtttttttctccttggaagaaggaggaaacaaagggggctgcttttagtatttctcaaattggactataagtagttagatattttgcttatacatagagtcaaccttaccaatcaggtcttcaaaaaggccttgtatttcaaatgccacactctccctgtgcacaaaagaagaattcctcttggtctctgcatcagtattcttgccctgttaagactcacatctgatcacactcagtcaacagaacaatcttcaaacaggaaggacaaatgtatttaaggaaaccttagtaagatcatggcagaaatgttgcaggaaatcgtctccctcctgttggatgagggaaagggtcaactgtgacttcagaagatgaacgtagaggagaacaaattgagaagcaagaagcaaaaccattattcctcagaattcagactcaatcaagcaaaagatgcattaatatgctatctcacaagggtcagaaaccatttgtaacacaaacactaccaaaacctactgttactgagagagttactttcaaaacctgagctttttagcgactctgaaccatacccctccccttttgtcctcactctgttggactgaggttcctgggaccaatttattatcagatcacttggcagacatgaaactcagcagctgaggtgtgggagttctgtgcactcccacagctgaattcagattctctcttaggagagaatggtgggttgcactaagaattaatgaaacctgcctccagaactaaaagtgctatgaagtgctaggagacttcctgcacacctaagatcaagaatcatagactagccatttacattcggtgaaaacatggggcactcagattttctcaaaaggtttccagggagagcattgttgtcaggagaagattgagggaggctttagggggttgatcactgtcccaaacctactgccatatactcaacctcctcaatgctgagggttcacaaattcattcaaatgggcaagattccccaagttctctgacagccattgttattgtaaccatatgtcacctgcacaggatggttgtgagagggcatacactctctgcttctctttgccagatgaggaaggagcaatcttggcccctaccctcagagggcttacagtcttggtacaaggtagatgatgactgaaaagaatctgcattcatttatgtatattgctctgctcagagaaaatacttttaaaagcccaaaaggaagactttccctttgccccttcacttggacttgctcttcctaatacaatcgggggtgggggagttgactaaatttttcttcgtgcccaaaagctgtgagcctttgcaattgaggagtcataccgggaccctgaaagcatatagctgctgagaacctcagaatgaccactttcttgccagcctttccaccttctgagcaggaggtatttgcttatttgttgattcacaatgccctagctataaacatgtaaaagaacctacaatgacaacctaagaaaaatcctctccccatgtcagcagctttggaaaacttaccccaggagtggtttcactgagcttcaatcctatagcaaaatggttgatttacaattttcctaataaatattcattaagcctgaacaagtcaattaaagctctggtggcagctcacacgaggcttgaatataagcagacagaaggaaacaacttctataaatattcccaaataacattacagtcttcccccatgagagtgcaagagtttatctgaaagattgaaaaccctctctgaacccagtgaaggcctctaaggtccacatttcctcccatttactgtacagcttcagaaaagcttgttgcatcctcagtctccacttcctcaattattgcaatatggtttctaccaccaccactgtacaggaacttctcttgacaaggtcatcaataaactgcaatccatactttatagcaagggttggcaaactttggcacacaggctaaatccagcccaccactggtttttgttaataaagttttactggaacacagccacagccattcacttatgtattttccgtggcttcattcactctgcagtggcagagttgactagttgcaacagtattgcccaaagtctaaaatatttactaacttgctctttacagaaagtttcccgatcactactttaccctacttgatagccattattttattttatctctttccagaatttgatgccattaacctcctccagtttggaaatctctattatttttacttccatgacagcactctttactgggtttcctcttaccctgctactgataatttttcttctgcttcctggtctcctcttctatctcttaatgtcaatgttctcccaagttctaccacatttccccctttctttacactccatattctcttcttgtgtgctatcccatggtttccatctccacttacattatgatgtgtttcaagtcttcatttctatctcaaaactctctcgtgagctccgaacaagtataattaaatgtctataggagcccccctcacttggattatgctataagcatgtcaaacttgacatctccaacacagaaactattgtgtgttctcttgccctcgccccactgctaaaccagagctacctataagaatccctctcttgatttaaaacaccattgatggggagtcaaattaaatataaaaataaaactaatggactttaaaattggtggatatgacaatctgaaaaaaacagacttgcactcaaaagcagaagccacagtacaatgacaatggaaaagcagatgggttagtttaacaccaacttgtatagctataagatgtagtgaaaagtaagcatatggttctttgtatattttggatcgccaaatcataatatgatttgcactcttgcggaggaaaaccatctagggttatcaccaaggaaggaatgtgcaagccctgagcatgctagccaagggtcccaaatcactccccagaacaaagcaatacaaggaggtggttatggtcactctgagggagatattagatgaaacctgggtggaatcaaaaaaggaacaggtggggagtttgcatgttcagtttatatatacccaagcatatgtatttctgtaagtgttcagagaactctaagcaacccatgttttagatttttttttttttttttaccttttgctatggactgaactgtgtctcctccaaaatttgtatgttgtactctaatccccaatatgactggattggagatagggcttttaggaggtaattaaggtaaaatgaggtcttaagggtggggtaccaatctgataggattggtggccttataagaaaaggaagagacagagatctctcagtccacatgcatgcatggaggaaaggctatgtgagcacacagcaagaaagtggccatctacaagtcaggaagagaaccctcaccagaacttgaccagtctcacaccctgatgttgaacttccagcctccagtactgtgagaaaattaatttctgttgtttaagccactcagtctgtggtattttgttatggtggctagagaagactaaaataccctttccactgtcacagagagttgggtcatacaggcacaatggtgggagaggggatcaatcaccactgtaaatccagtcaccaaattcagaagcctggaaatcaactctgcctgctccctccctcattcttatcttgaatcaagttccaatgattcaatctctctgatatctctgaaatccatctacttatatgagtccctaccttagtttgaacttataacagtttctatgtggcctaatataatatcctcttagctgtccctcttgtttccaggtttttgtccctccaattcatgctccacactgcaaccagagtgacttttcctgatctcatcactcctcagcattagtgggtccctattgctctttggcacaagagtaagctcttttttattattatttatgtgtttaattttggttttagagagacagggtttttctctgttgcccagggtggagtgcaaaggcatcatcatagctcactgtagccttgaactcctgggcccaagcgatcctcccacctcagcctcctgagtaacaaggaccatgcctggctaattttttttaacttttttagttaaaaactaagtcatactatattccccaggctggtcttgaactcttagcctcaagcaatcctcctgctttggcctctcaaattgttaggattacaggcatgagccaccagctctttattttaccataaaagttgcttataatctgccacctgccaatttcttcacccttgttgctattcactaagacctagtcatatgcaactttttatttttattttttgtttcaaactcattttaggttcagggagtacatgtgcggtttttctatgtagttaaattgcatgtcatttttaacattaagggtttggtgtacagattcttttgtcacccacataataagcatagtaagtgatagttttttgaccctgatcctcctcccaccctccaccctcaagtaggacccagtgtctattgttcccttctttgtgtctatgtgtactcaatgtttagctcccttcgtaagtgagaacatatggtatttggttttctattcctgcattaatttgtttagtataacggcatccagctccatccatattgctgtaaaggacatggtctcattattttttataacaccatagtagtattccatggtgtatatgtaacaccattgataaggatttaggttgataccacgtctttgctattgtaaatagtgctgcaatgaacatacacgtgcatgtgtctttatggtagaacactttatattcctttgggtagatgcccaaaaatggaattgctgggtcaaatggtagttccgctttaaattctgcaaactgctttccacagtggctgcaccaatttattttcctatctgcagtgtataagagttcctttcttcctgcaacctcaccagcatctgttattttttgactttttaataatagccattctgactggtgtgagatggtatcttattgtagtttttatttgcatttctctaattatcagtgatgttgagcttttatcatacgcttgtgagccacatgtatgtcttctttggagaagtgtctgttcttgtcttttgctcattttttaatggagttgttttttgcttattgaactgtttaagttctttgtaggttctagatattacatctttgtttgatgcatagtttgtgaatattttctcccattctgtaggttgtctattttattgatagtttattttgttgtgcagaaggtctttagtttaattaggtcccatttgtcaatttttgcttttgttgcaattgcttttggagacattgtcatgaaatctttgccatggcctatgtccaacatggtatttcctaggtttctcctagggtttttatagttttaagttttacctttaaatatttaatccatcttgggttgattttcgtatgtggtgaaaggaaggggtccagtttttaccttctgcatggggctaccaagttatgccagcataattttttgaataggcagtcctttcaccattgtttgttattgtcaactttgttgaagattagatggttgtaggtgtgtggctttgtttgtgagttccctaacctgttccattggtctgtgagtctgctttcttaccagtatcatcatgttttggttactgtagccttgtagtagagtttgaagtcagataatgtgatgcctccagctttgttcttttgcttaggattgctttgtctattcgagctttttgttgttgttgttgttccatatgaattttagaatagttttttctaattctgtggaaaatgtggttggtagtttgataggagtagcattgaatctgcaaattgctttggacagtatggccttttaataatattgattcttccaattcatggaattttttccttttttttatttttttattttttgagatggagtctcgctctgccacccaggctggagtgcactggtgcgatctcggctcactgcaacctccgcctcccgggttcaagcgactctcctgcctcagtctcctgactagctgggactacaggtgcccgccaccacacccagctaattttttgctttttggtagagatggggtttcactgtgttagccaggatggtctagatctcctgacctcgagatctacctgcctcagcctccaaaagtgctgggattacaggtgtgagccactgcgcctggccttttttccattttttttgtatcatctctgatttatctgagcagtgttctgtaattcttattacctccctggttagttgtattcctaggtattttattcttcttgtggcaattgtgaatgagtctgcattcttgatttggctctcagctcagatgttggtgtacagaaatgctactgatttttgtacgttgattttttgtatcttgaaactttgctgaagttgtttatcagatctaggagctttggggcagatactatgaagttttctatgtataaaatcatattttctgtgaagagagatgatagtttgacttctctacctatttggatgccttttatttctttctcttgcctgaatgctctggctaggacttccagtactatgttgaataagagtggtgaaactgggcatccttgtcttattccagttctcaaggggaatacttccatcttttgcctgtgcagtatgatgttggctgtgggtagaaatggtaccagctcttcattatacacctggtagaattcagctgtgaatctgtctggaccagggctttttctgcttggcaggctttttattactgattcaatttaagaactcgttattcatctgttcagcgtttcaatttcttcctgagattctttcctcagcttggtccatgttactgtttgtacttctgattgtattatgaaattcttgtggtgagtttttcagctctatcagattagcgtggttctttttcaaaacggctatttcatcttccatctctagtatcattttattggattcattaaattctttggattgggtttcaattttctcctgaatcttgatgatcttcattactatccagattctgaattctatgtctgtcatttcagccatttcaggctggttcagaaccattgctggggagttagtgtggtcactgaaaggtaataagacactctggtttttggggttgccagagttcttgcactggttctttctcaattgtaagggctgatattcctttaatctttgaatttgctgtccttttaatggagcttttccttttatattctttgatgtccttgagggtttgactgtggtataagttggtttcagttgactggcttcatttctggataatttcaagtggccaaggctcagctcagcacccctgggctgcatgctgtaacagtgggggactaggaccagggccatggctttgttctctggaccctcgagttgagcatctactgtgctggaggggctgaggtgtttccattccactaacaatactccaataggggaggaggatgctggcaaaagcatttcattggggctgtggcaaggggtctatgtgcatgtgctggtggcagcagggcagtagcgcagtgagatctacatgcacgcacatgctccagtagtggcagggtggtggggactgcatgcatgcacttgcatcagcagtggcgatgtggcagggtccacgcatgtgagcactggcagcagcagcacaatggggtccacttgtatgcactggcagcagccacatggtgggatccatgtgcacaagtgcactgccggtggtggtgcagcagagtctacatgcatgcaagtggcgatagggcagcagtgtggcaggacccaccatgggtcagcaatggggcagcagtgcggcagggttcatgtgtgtgcatatgcacaggtggcaggacagtgaggtctgcatgcacatgctcacaccagtggtggtgaggcagtggtggcaaagtccatgggcactggtggcaatggagtgagtagcaaggtccatacgcacacaagctggcaaagcagtgggggtaggctgcaagcaagtgtgtgctggcaaagcaatgaagggaggctatgggttgatgcacgttggcaggggcccatctgctcaaaccctctgatggttagctgggcctgccagtgaaggagctatggcagcagccaccaggaagtgcaccagtttggcatctgaggctgcgctgcaaacaggtgtggccatgcagggatgctgggagatggcagcagacaggagggtgttcagatcagacttgcccattccacaatcaagatagccctgttctgtccaggtccaacagtcaacaaaggccaaagccacctagaggaccgtggcaagcctcaggggatgggcatccctggccatgttccattgcagccattctcaaaccaaaccctcggggctccacacagtctggagtcctgtccctgccacatctccaagtacctatccctgtcagcttaaatatctgttggggtcttgggtctcctgcagctaagattccaatggtcctttatgacagtgggccacttctcacctatttaactcatcctttccccaggagccactgagggccaggaatgagccctgatgtttggcagccctgtgcagggttcccagcttcctcccccttcagcccagggtaggtgtcctccctctgtccactctcaacgtcttccttctgaagattcactcagagtgtgctagtcttcttgatggtctcatctctcagtgggtgatactcttcctggttgtgtcttgttggccatcttggttctcctccatatacaactatttaaaattcctggccttgccatgtcttttcatgttttcatgtttttgcacatgcttctctatttgcttttatgcctgactagtttgtactctgtctttaagactaacttagcattgtttcctctgggaagccttgtctaactgtgttagggactttcctttttgctcccatcacagtagtacttacctacctcattgtgctgtaatgaaatattattttccctactgggtcatgcactgagaccatgggaagagtctcttgtagtcatttacatagctggaacagagttgtaaaggtttgatgggcaaatgaatgaaatgtggaagtggggaaaaaaacaggcataacttaggaagtagtgttgacagagaagaggtgccaccttatatgatacaaaatgcaaaatctcccagactttctgtccaaaaaggcccaacttccacataatcaatcggtcagcaaaagcagttgtccataactggtcatcttttccaggtctctcttctcccaaaagaagctctaccttatctcccaccagccaggcagcctgaccttcagattcccttggatgtggagtatctcttgcaccaccactatggatgccctccctggccaatgccaagctactgcaccgcagctaggtcctaaattgattcataggacactcaggcatgcaaatctaatctcctttgtgaggcttacccactggatagtggaggagaaatagaaattgtagtctaaacgaatagatttagctcatacacagtggtattaagttcagtcaatgtcgaagtcatagtgatccatccctcatattccccttcaatcaatgatttactgcccagctataaggagtgtagttggctgacagctgttagcgtcttcagaatctgccagggatttagaatatggatcatactcttcttgggacatctagcaactaatgactgagcaaagtggtgataagcaaggtcacactccctgggggtgatccccagtgaatgaccaagcaaagcagtggtacaaaagcctagctattcccacccaacatgggacttctctaatgagcaatctttgctccagagagccccctcgggctggcagagactttgtcaagacacaaccaggaagagcaccacccactgcatatcttctgatggctccccctcctcaatccttctttgtctctatttcttcacaggtgttattccctaataaatttttgcactcctaattcctctgaatctgcttccttgagaagccaacctgtaacttttggtgccagaagtggcccaagaaaggaagccgtaagatgctgtgtggatattggattcatcagcacctgtctggcattaaggaccccattcctggtggaaagttatgcacagagagcccctgacacaagacagagtcccaatgtctaaatatttctcctgtggtgtttcaggagaacacaccagtaaggagaattcattagctcatggaatgactcaagcatttcaaatgtatgcgagaaatataagtataaagaaaatggaatcttatacttttatttagttacattgatgccctgctgaagggcaataacaactaaaaactaaatgtgcgaacacaaaatctctttagtagcttacaaagaagacctaatttcatgcaatgggtgagcataaaaagttgaagacaaaacccagaatttgatcattagagtggctgaacttcaaggataactgaatgctcaactgaggcagatatgttatgccaaagtcgaggtcctagttgtgaaaacttaggaccctgacacaggggatggggacatctaagtggatgctcctgaagattttgactccccagccctctcaaaagcttctgagcctgtagaaatgcctcatgcttgcccaataagagctagtacttcttctgtataagaagacactacatagatctttccaccacaaagcagcaggcctatatgcagcaaaacatttccacaatcaagctggacctgactggggaggaaaaggactatatcccaaaggaactgccggcaggtactgagaggaatcaagggaggtcccatgggactatgttctgaaggtgcttgaccaaggagagctttcttgtaagaccggataagggagagtttgttggtttggggccactctcttagaatacaagacttaacaccctaacagagacaccagaagttggtgtaacttgctgctaaggtggctcctataagcctggaaaaaaaaacagcccatactgagagacgttaaaattcctgaattgctgtggcacatgccagagaaagaaattaaaaggctgggagaagcgggcatgttggagtggatatgaagccagaagatccactggaggattatgtcacataggagaacccagaagacacatcattcacctagcccatcaggaatactggtgaaaggggcagcaagatcaccaagaagttcagtggtggctctcctctgcaggccaaagcacatgataagagatgtgattccttgatttgttgatagaaatggaaatgattgccaaacctcccaaccctggcaatagagaccaagtgatagcactccaccaccagaagcccaggggtttgtaattattaaaataacaatacacaattagattggcaaccaagtgggcctgatatgtagagatggttaatagaacactgcatccctaaaggcaaaatagatagcagccaaaagggtattgcttaacatatataattttttaaaagagtaagcataaatgagcaggaactaggtcagtctccccaattaaaacgccataatttctagtttagtttccagacctgagctaattttccatcccagaacacacctattagagacatggcctccagtgggaagatccctgcattacaagtctttccccccagtccttaccaaaaggaccccacagccatctacttggcaaatttactgtacaattattgtacataaggtacatttactgtacactagaaaaagaggcatatccagatattagacctggggtctgagtggacactgatacttgcagacatgaagcatcatcatgtccgcttgttaaaggggggtcatctgggtgtcaagtaataaaaaaaatcctagccaaagcatcacttacaatggagccactgtatctgctgactcacatgatggtcattttcctggtccctgaatgtacagttggaatggacatatttggcagttgaagtagcccccacatcgggtccttggccataatgaaggttaaataggaatttctgaagctgctcctcctcctcctgcaagagactaagataataaaccaaaaccagtatcaaatctgaaggaggattatggaaatttttgccccttgtaaagatttaaacaatgcaagggagagcaagatggccaaatagaagcctttaccaattgtcctcccctacaaaaacaccaacttgaacaactatccacacaataaagcaccttcataataaccaaaaatcaggtgagtgatcaaagtacctggttttaacttcatatcacagaaagaggcactaaagagggtaggaaagacagtcttgaattgctgatgctacccctccccaatccccaggtagcagccaggtagcacggagaaagaatctgtgcccttgggggagggagagcacagtgatttggggacttttcattggaactcagtgctgcctatcacagcagaaagcaacatcaggtagaattcaaccagtgcccacccacagatggagcatttagactagccctatccagaggggaattgcccatcccagcaatcagaacctgagttccagctagcctcactacagcaggtcaaagtgctctgggctcctaaataaactggaaaggcagcctaggccacaaagactgcaattcctagacaagtcctggttccgtgctgggctcagagccagtggattttgggtgtatacaaattaatgagacaccagctggggtagccaaaagagtacttgtgccatccctcccacaaccctcaacggcaaagtcacagctccagaagagactccttccctctgcttgatgacaggagaaggaagagcaaagaggactttgtcttacaacttggataccagctcagccacagtaggatagggcactaggcagagtcctgaagcccccagtccaggccctagctcccagacatttctaggcacgccctggccaagaagggagtcctctgccttgaagtaaaggacccagttctggtagcaagcatgatctgctgactaaagagtccttgcgccctgaataatccgcagtgacaccaggtaatatgtcaagggccttgaatgagcctcagagatgtgctggcttcagttgtgacccaacacattcctagcagtggtggctatggagaccgactcctgcttgagaaaaaaggaaagaagagtaagggaactttgtcttgcagcttagataccagctcagacactgtgatggagaacctaatgggcccttagggtcccccattccaagacatggctcttaggtggcatttctggacctgccctaggcagaagggagcccagttccccgaagggtgagtctcagtacaggcagcagtcaccacaatctgactgaagagccttgagctttaagggaacattggtggcagcctggcagcattccccatggtcctgaggtggcagtgaccatgaggtaaggctcctctgcgtttggtaatggaagcgaagactgagaaggactgtgtcttgtggttcaagttccagctcagccacaatacaatagaataccaggtagacttctaaggttctttactctagtccctgactcccaggcatccatgtgcagaagaatgaaactagacccctatctctcaccaaatacaaaaatcaaatcaaaatggattaaagacttgaatctaagacctctgactataaaattactacaagaaaacattggggaaactcaccaagatattggtctggggaaagacttgaacaatgcagcagagccacaggcaaccaaagcaaaaatggataaaggagatcacttaaaattaaaaagcttctgcacagaaaacgaaaatcaacaaagtgaaaaggcaacccacaggatgggagaaaatatttccaaactacccatctgacaagggattaataacaagaatatataaagcacttgatccaataacaaaaaaaaaaactaatactctaattaaaatatggacaaaagacctgaatagaaatttctcaaaagaaggcatacaaatggccaacaggtatatgaaaaaatgctcaacaacactaatcatcagagaaatgcaaatcaaaactacaatgaaataccatctcaccccacttaaaatggcttatatccaaaagacaggtaataacaaatgctggttaggaattgctgaaaagggaacacttatacactggtggtgggaatgtaaattagtacaatcactatagccaacagtttagaggttcctcagaaaactaaaaatagagctaccatgtaatccagcaatcccactgctgggtatatacccaaaagaaaggaaatcagtatatcaaagaggtgtctacactcctatgtttgttgcagcactgtttacaatagctaagatttggaagcaacataagtgtccatcaacagatgaatggataaagaaaatgtggtacatatacacaatggagtactattcagccataaaaaagaatgcgatcctgtcatttgcaataacatggatggaactagaggtcattatgttaagtgaaataagccaggcacagaaagacaaacatcactgttcccacttatttgtgggagctaaaaatcaaaacaattgaactcatggagctatactgaactcatggagatacagagtaaaataatggtcaccagatgctgagaagggtagtggggtttgggcggtggaaatggagatggttaatgtacacaaaaaaaatagttaggaagaacaaataagagtgttggtggcaaaacagggtgattatattcaataataatttagttgtacattataaaataacttaaaaagcataatttgatcatttgcaacattaaggataaatgctttaggtgatggatatcccatttaccctgatgtggttattacatattgtatgcctgtgaaaaataaagtaaaatagctcatggataggaagaatcaatatcgtgaaaatggccatactccccaaggtaatttatagattcaatgccatccccatcaagctaccaatgactttcttcacagaattggaaaaaactactttaaagttcatatggaaccaaaaaagagcccgcattaccaagacaatcctaagccaaaaaaacaaagctggaggcatcatgctacctgacttcaaactatactacaaggctacagtaaccaaaacagcatggtactggtaccaaaacagagatatagaacaatggaacagaacagaacagaggcctcagaaataataccacacacctaaaaccatctgatctttgacaaacctgacaaaaacaagaaatggggaaaggattccctatttaataaatggtgctgcaaaaactggctagccatatgtagaaagctgaaaacggatcccttccttacaccttatacaaaaattaattcaagatggattaaaaacttaaatgttagacctaaaaccataaaaaccctagaagaaaacctaggcgataccattcaagacataggcatgggcaaggacttcatgactaaaacaccaaacgcaatggcaacaaaagccaaaattgacaaatgggatctaattaaactaaagagcttctgcacagcaaaagaaactaccatcagagtgaacaagcaacctacagaatgggagaaaatttttacagtctacccatctgacaaaggggtaatatccagaatctacaaagaacttaaacaaatttacaggaaaaaatcaaacaaccccatcaaaaagtgggccaaggatatgaacagacacttgagaagacatttatacaaccaacagacacatgaaaaaccacaatgagataccatctcacaccagttagaatggcgatcattaaaaagtcaggaaacaacaggtgctggagaggatgtggagaaataggaacacttttacactgttggtgggtctgtaaactagttcaaccattgtggaagacagtgtggcaattcctcgaggatctagaactagaaatactatttggcccagccatcccattactgggtatatacccaaaggattacaaatcatgctgctatgaagacacatgcacacatatgtttattgcgacactattcacaatagcaaagacttggaaccaacccaaatgtccatcagtgatagactggattaagaaaatgtggcacatatacaccacagaatactatgcagccataaaaaaggatgagttcatgtcctttgtagggacatggatgaagctggaaaccatcattctgagcaaactatcacaaggacagaaaaccaaacaccacatgttctcactcataggtgggaactgaccaatgagaacacttggacacaggatggggaacatcacacactgaggcctgccgtggggtggggggaggggggagggatagcattaggagatatacctaatgtaaatgatgaattaatgggtgcagcacaccaacatggcacatgtatacctatgtaacaaacctgcacattgtgcacatgtaccctagaacttaaagtataataaaataaaaataaaaataaaaaaacaaaaataaagaaaaataaagtaaaatagctaaaagagtataactgaattgtttgtaacacaacaaaatcataaatgcttgaggtgatggataccccatttaccccgatgtgattattacaaattgtatgcctgtaaaaaataaaataactaaaagagtataattgggttgtttgtaacacaaaggaaagataaatgcttgaggtgataacacctcatttaccctgatgtgattattacgcatgtatcaaaatatctcatgcaacccatatatatgtatgtgtgtgtgtgtgtatatatatgtatacatgtgtgtgtgtgtatgtatatatatatatacctactatgtacccacaaaaattaaaaaataaaaaagaaagaataggatgtagctaaataaatacacaaataacacaagggaggcaattcctataatagcttctttaattgaaaaatctggcccttcaacatcagctgacatagggcaggaatgagcctgtcttagtgtctctgccatgcccagtcattggtacatggcttcactgcaaacacagtgatggatttcagagcccagcagctggggcctttggtcagttatgctgtcatggttgaaggtcttccaggccattctcatggcagccataatatatttttgttaagaaattctaccaaagcaaaatatggttgaggtaggtatcaaaaaaaatctgacccctgaagaaactagatagatcttggaaaatgactgttgactagtgcaaactcaatcacaacatagccccatggtttcatgtacatgatatacagctgttggtttggtaaatgccttctttcctatcccagtcaggaaccaagatcagaaatattgaggattcatatggaagagacaacaaatatttatacttttgccttagtactatgttaattcttacacctctgccataatggaatccaaagagatgtggaaatgttaactcttacaccctctgtcataatgaaatccaaagagatgtgggtatccctcagaatactacatcgatcccttacattgattgacaccattatgctgatccaacaggatgagcaagataagactaacataccaaggaggccttgctaagacacatgctccagaaggtagaatataaaccctttaaagattcagggacctgatacttcagtatagctgttaggaagtctattatcaagggcatgcaggaacatctcctcctaagtaaaagacaaatggccaaaccttgtagaccctactataaagaaataaacacaatgcctgatgggtctctttgggttctggaggcaacacatttcatacctaggaatattgctctggcccatatagtgggtaaagcagaaggctaccagttttgagtggggcccagagcaggaaagggctctgcagtagaccaaacctatagtgcaagcaaccttgctacttgggccatacatctggcagaccctatgttcttggagattccggtgttgaaaaaaatatgcaaggtggaatttatgggagagatgtgggagaatcaaagtgcactttgagttgcccctggagttttagggcaaggccatgccaaagaacatacatatcacttgaaaaatagctcctggcaagctattagtccctgatagagacagaacagttaaccacaaaataatgataatgatcatgcatttagaaatgcccactatgagctgtgtcctgttagacccaccaagtcttaacatcaagtaggcctagcagcaatcacaataaatgtggaaatggtacatccagaacctagtgcaagctgaaccagaagacaggcaaactgcatgagaacgtagccccgactgccatatcacccactatagctgctctagtgcccttccctcaactcacactgatgatcatattggagggtcccatatgaccacctggaagagaaagaaaacttccgaatttggtgtgtggatgggttagcttggggtatgggtgcaagccaaaaatgaaaagtggctgccttacagcctcactcaggagcagccttgaaagacagtgttcttcccagtgtagactcaagaaaaagaaagacagtaaagagggaaaaatgtacccagtgggcagaactataggaggtgcacctgatcatctattttgtatgagtggagacatggtccaaggttagaataaatacagacttatagccagtgatgaatggctgggtcaggccccagaaagagaaagattggacactcggagtaaacagcttctaggattattggcatgttgattgacatatagaagtggacacaaattgtgacaatctttgtgtaaaatgttaatgtccatcagaggagatctaccatgaaagagagactaaacatcaaacagtctaaatggttggccagttgatgctaaccagccttcttcatcactcaccccaacactggcaaaacaggttatgaaagaagtagcatggtggtagggacaggggctatgcatgggcccaaagtatatgaacttccactcacttagggtgttctaggtagttttaaatgtctaaaatgccagtaacagtaaccagtgctgaagtcctcatatgacacaattccccaaggagaacaatcagccacttggtagcaagtttactacagtgggctgcatctatcctggaagggccagcagttcatcctcacagggctagatacctattctgggtatgggtttacttttcctgcctgtagaacctcacccagaacctgggaacttatgaaatgcatgatccacaactatggaattccacacagcatggcattcaactaggagacccatgttacagcaaaggagttatgggaatgagcctatgaccatgggatacatcgatcatattgcatactacaccatccagaagtagctgacctcacagaaaactaaaatggcctcctaaaggcacggtctcagaggcaacactcagaaggtatgaattaagtcagagatcaccatatgatactgtgttctctacaggaataataaaaggttcagaaagcaaggagtggaagcaggaatggccctactaagcatcactaccaatgacccactgcagaatcttgtgtttctggtcccttaaactctaagttttatagtgttagaggtcctagttcccaaagggagtgcactcttaccaagggacacaacaggataccactcaactacaaactattactgacaactggacacctgggcttcttgtgaccagcagccaagaagagggctcaccatcctatcaggcgtaattgacactaatcatcaggagaaggtatggataatatttcacaatgagaatagagaggagtaagtgtggagttcagatgacccacctgggtgcctcctggtactcccctaacccattgtaactatgaataaacatatgcagcaaatccagtctgagaagggtatggttaccagggactctgatcttttagtaatgagggtttgagtcagacaccagacaagccaccaacacctgccaagttggtagctgagagtgagaggaatttagaatggatagtggaagagggaggcaatgagtaccagttgaagcccaagaccagctgaggtagggttggagagctgtactttatcccactaacccttctcttctaagaaaggctcacaagagacctgaatgaacttctccatgaacatgtatggagaagcggagcagcatgatacaaggggtggactgcggcagacctacagatgtgtcactcagatccctcttcaagaaaggactcacttcacagctgtaaggagagtaattatttcatagccacctagctgttagcaccttcaggattggcttcagttcttgggccaaggtcatgctcttcttggagcagcccctagtcaatgactgaaaaaggctgtggtgcacagatctagccatttctgtccagtgcagatgcttccaatgggaatctgtttcagaattccccactggactgacagaaactttctcaggtgtgcattgagactgatggtgcctcctgcccaatcctgcttccttttcaatcacaggcgtcactctctaacaaatctcagtgactacttcccagaaaacccatccttcctgcaacagtccgttttaaaataacgtgctccatctttaggaattgtgccccttgcccctactccaaatactggggaaactatgtggcttaagtcaccttgtagtagcagagggtaaacaagactgccaagagtaaaagtgttccttttactcttcactttgcctttgacaaatatcctggtgaaacgccaggcttctctaaaatggctcaggcattgagggtcctaccatgggccttcctttacttccaactcctgccccatacctgaccctcatcagggaccatgccttaatactggtcactttattgtggaaataaaaagccctaaaatcatctgagagaaacagtttgcaagtcttaatgtggctttcctctcttctattttctctggtgggattacttacaggcataaatatgaaaaatacatatcacatgcgatgattcacaattattaaaattaaataagaggaaatctttggcattcacattcattttcttattcggaagagacatcccattctactgattgcaatataaataagtttggaataatgattgtgatattccattaaactaatggattcaatctcataagtcatttttatggataaaatttaacatactgtattaattccaaacagaatacatgtgcagtttgttacaggaaactagattactacatgtaatgtcaacagtcattacttcctggtgttatttacctgatcccaatttcctagctaataccactgtgtgtgtaatgaataatgcactgtggaaatgtacactgtgcaaaaacacactatatatagtacagttattagcgtggacatcacctaataaaatagtttgcatttcttccctgcctcccacccgcttcccactatttttaatgtaatatatacccggaagaaacacttcagaggtggggaaggacgtccaaagtgagcaactttttataactatttatttactattaagatgtaaatgagcagacaagtaataaccacccagatcaagcaagaaatggaaagctttcaacacccccagaaagctctcttgtgccccctcaccatctatacctaggaagtagccactattttaatttgtatcaccacagattcgtttcaaagtgagcaacttttaaaaactgtaaattcggtgcttaaaaatctcctaaagcaaagattgaagttatttgtcactattgcaaaaacaggaaaagtccagcactcagcagtgaggcttaacaacaataactttcagtttttcaggtggctgactggctagttaaaaattatccaaacctggtgttcgcaggcgccgccgcgccgccgtcgctctccaacgccagcgccgcctctcgctcgccgagctccagccgaaggagaaggggggtaagtaaggaggtctctgtaccacggctcctacaaagcggactgcccgcaaaccgaccagtggtaagcacccaggaagcaactggctacaaaagccgctcgcaagagtgcgccctctactggaggggtgaagaaacctcatcgttacaggcctggtactgtggcgctccgtgaaattagacgttcagaagtccactgaacttctgattcgcaaacttcccttccagcgtctggtgcgagaaattgctcaggactttaaaacagatctgcgcttccagagcgcagctatcggtgctttgcaggaggcaagtgaggcctatctggttggcctttttgaagacaccaacctgtgtgctatccatgccaaacgtgtaacaattacgccaaaagacatccagctagcacgccgcatacgtggagaacgtgcttaagaatccactatgatgggaaacatttcattctcaaaaaaaaaaaaaaatatcttcttcctgtcattggtagtactgaacgttagatatttttttccatggggtcaaaaggtacctaagtatatgattgcgagtggaaaaataggggatagaaatcaggtattggctgtttttccattttcatttgtgtgtgaatttttaatataaatgcggagacataaagcattaatgcaagttaaaatgtttcggtgaacaagtttcagcggttcaactttataataattataaataaacctgttaaatttttctggacaatgccagcatttggatttttttaaaacaagtaaatttcttattgacggcacaaaaaaaaattatccaaatctccaaccttacttctccctttagagtgtttaaatcagtaatcagttccttcgcttttttttttttttttaatctctgcccttcctcacccctccattctgcctctctggtcaccacttcctacaccaagtggagttctggcttttgagagttaatcgtacacatctcttctgaactccatattcagtgatgttcaattggtagcttaaaattggtagccatggtggaagtatttacacaacagaaaaaactgcaaatgctatacctctgggccccgctgcccccagtgatgattgctaaatgtttatcaggacaccaccaggccactataatacacacacacagacacacacacacacaatacattcaaattatgccaaatgcctcaaagagctttggggattaaaaatgctatccagtcacacaaagcaaaaccaatcacagaagattagtaggagcaagtttcaactcagccagtcttttcagattcatactagcttgccactggtggtggtttggttttgcatcaaatgtcactttgtgaattggttctacaatatataaatgcatagtaatttcctaattgaggtaaactattgctaacctcacctgaaatatttgcaatagacttagagacacaataatatattgcagaaatagttgaaaattcactgtgtgaaacagaattttaataacttgtctctgtattacaatctctatctgttatttatggcttcaggcatataatactttgtctccgaaccagacagtaagtccattgggatcaaaaatagtgacttcttcttactttaaattcttcacagtgcctagcatagtattaggtttcaagcagatggcaggtagcaatgtattaaattcactgtttcctctcctatttccttctctattccatccccctaatcagttaccctatactttcttagttactccctaccatctctctaatccacccagtcacacaaaacaaaccctaccacaaaaattaagaagagtattataaatattctgtatttcagaaacagagtacattcatttgacaaatatttgaacactaacacgaggggcattgttctaaatattgtaggtacatgcaaagatgatttagacacagacttttactcgaaggagattccaggtgaaaagaatagattatacactgtcttagttcattttctgttacttataacagaatatacgaactggctaatttataaagaaaatgaatctatttcttacagttatggaggctgagaagtccaacgtcaaggggatacatccagtagcttgtggggactctctacagggtatcacatggtaagggggctgagtgtactagcttgggtctctctttttagttttataaagccaatggtcccactcccatgataactcattaatccattaacccattaatcagttaatctatgaacagattaatccattcataagggtggagccctcacaactctatcacttcttaaaagccccacttcttaatactaccacattggggattgaatttcaccatgagttttggaggagacaaacattcaaaccatagcagatacatatttaagaaactctgatacaagtaggaaaataatccagataaaatgccatgggagtgtaaaggagggagaaactactttccactaggatagtttttggacatgccgagttggaagtagaggtagaggagtaaataaccaaagcaggaaagcacaggagcacacaccagaaacagcagtttgtctggagtgtaggatgtggaaggaggaacagcttaaaatgaagttggaaagcggaggtcagattatatagaattatcaatattttactaaagagtttgagctttacctttggtctttgtgttactcaaagtgcgccagattatgttgcagtaaaatccacaaaaccaatgacttaaaacaacaatatttatttcttaatcatgctacatgtacatcatgagtactctgggggcccctctcccttggatccaggccaacagagcagccaccacctggagccagagggacaaagaatggggcaaattgtacacgtgctcttaaagcttctgccccaagatatcacacatcacttctgcccacttttcattcactataacaagtcacatcgttactaaaatatcaaaggtttggtctaggtcccattgctcatagcatggaaaaccaatcactgagatgagtattgccagggaagaaggctttattcaggtgctgcacctgagaagatggaagatcagtgtcaaatccatttccctgaccaactaaaactaggggtttatatagcaggaaagaaatatgaccatgtgtgggaaaacaggaattagagaggggataaagaagaggagttggtcaacaggaagcaggtggttggttaggcaataatgatgggtgagggatctggcatcttattgtccagatgtggtgatctgataaatttcagtttcttgataccatctgaggggcctgatggttggtttcctgagaaaggaactcagataaaacaaatgtaattttctcaagttttaagactgggagggttaatttctacatgtattcaaaagaaaccataaacatcagttctaagggacaattatgccagtttcaacatgaccacacctaacttcaagggagtggggaactgcaatcttaccatgtgcctagtggagtggagagcaagccagacatatttaatagcactaatgactaccagagtctttaagaaggggttggatatggtcatatatagatttcagaaagatcactttagcagtgcatattggaaggacgtgagggatgctaacctggaggaagaaaacctagtcaaaaggctggtgtagtattccaggggcaagatgatggtggtctcctctagagcaaggtggaagaattaaagaaaaaggaacacatgcatgagatattcaatgagatactaaggagaatcaacaggactaagccaacgggccatgaaagtaggaatggggtaaatagaactgctgctgttagaaatgtctgttgggcagagattgtggtggtgcccagggctgttgaggtgtgactggtggtggagcaaggctggcaagtatggttgatggtttttcactattggtggtgagctgtgaatagtggctggtgggtgtgggtggtaaaattcagtataactgaagcatatatgaggtggggagtagtaggaatttagaatggatgggaaggtagccaagagccaaataggaaagtctttgactaccatggtacgtggtttggattttatcataaagacaaaagaaccacctaattattttaaacatatcatcctgatgatgcttcaagtacatggcagttataaaatgagaaaatcatgtggtaaagtaaggccaaggatagctggccaaccagtatatgcatgaatctgacagagttcgagagcagaggggtgggctgtgtaatgtagactgcattgccataattcatatctatctgacatttgataactgtctagacaaaggttaattggaatgcttcttgttttcacaaacaggattttaattttccatttttattttatactcatttttccaattcatttccacttttgagcatgcccacagggacaccaagtttagagcaggctctacttgccagaaacttccttcatgtattaacttcaaaatctggccttagtggaaaaactgagttcagagaaatgacgaacgatttggtgactgctatgaaagaagtctgagaagttagcacatgtttggcagaatggactgaaactctgcagagtgaaaatctcagacctgaagttgtcttcatgaggaatttaaatgctaccatcatctccaatatttatgttaatgcaggcttcattgcacttgaaagttcagaaatttgagcatcaaaatgcaaagataccatagacatgaaataaaaatagtcacaaggatatttatatctaataaagttcaacaaccaagttatcgacacatggcaatccacatattgcagaaattgaagcaaaatgaaacaggtaagaagctgctaactcactacattaacaattttagagccctttatagaaaaaaaatacttaaaatctactactgaaagctaaatattggaaaataaatcagaagatattctatgtggagttcttaatgtagtctaagaggatggggaggaaaaagacagaaaaacattccagttagtaaagaactattgaacataggcaaggcagatacagagaaaagggaacagacacacgagacatttaaactgacccacaaacacagcactaccaatttgtgagtgcttgatgcgggccaggcaccatattatgtaatttgcatacattatttcattaatcctttcagcttcctttgaagtaggaacttacatcagatattgtctatgggtacttgagtccacacctgactttctatctgtaatcttccctgtattgcccaggttgggagccagaaaacctacatttccaagactctcttgccagctagattttggctagcttttgccaatggaaggctctctcacgaggtaattaagtaggagaggagagagaaactattctgcatctggctttggcagtggaagcaccccgtgactgcaggtaattacgggctccagcagcatcagtggagttctaggagccccagcagcactgtcagcagcaagtgcatgctcacagactctaggccaggggtgtccaatcttttggcttccctgagccacattggaaaaagaaaaagtgtcttgggccacacataaaacacacattaataatagctaacgagctaaaaaaaaatcacaaaaatttcataatgttttaagaaagtttacgaatttgtcttgggctgtattcaaagccatcctgggacatatgtggcccatgggccgtgggttggaccagcttgctctagggatattaattttccacatttttgctcctccatccttagagagctgtggttttctatagttactgacatctaggttataccaccctctgccttttgcacctccagcctttccaacacttttgtaatcaatttcctatattaaatctccatctgtttgaagcacctagagagatttctggcttttccattggcaacacatcatatcatttaaccttttcaacaacgctttaggcactattatccttatttcagacataatccaaatatcacctggcctaaacaatcttttagatacaaatgaattcatattaacatctattatccagaatttctttttacatatcttccttccctcttccttgaacccctagaatgtctactacccctctgaaaagctccccccagtattttggggaatttttaaagggaagtattatatgtctttcaaattatttaaggcactaaattgcatgtgacagagacctgcctcaaattagctgaagcaaaaaaagtaatctgattggcccacatgactaggaagtattttgagttagaccagagaattgaaggaagaatgcagaaccagtggccctggctgaaacttaatgccatcagaaatttctctgtcttcattcttctcttatgtctgccgttttctaattggcttcactctttcctattacagattgtccttatctacatggaagggaagagagccactggcagctccaacatcacacccttagagtatggccatagagggtgacccaagaggctagatgacatttcctccatctgcaagtgaagaatttagggcaaggattctgattagccattttagagcatgtactcatgtcagttttattttgtgttgctatttttgttttgttttgtttttttctttattttattttattattattagactttaagttttagggtacatgtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgctatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgagtagtgccgcaataaacatacatgttcatgtgtctttatagtggcatgatttatagtcctttgggtatatacccagtaatgggatggctgggtcaaacggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtgttgatttgcatttctctgatggccagtgatggtgagcattttttcatgtgttttttggctgcataaatgtcaggcattaccattcaggacataggcatgggcaaggacttcatgtctaaaacaccaaaagcaatggcaacaaaagccaaaattgacaaatgggatctaattaaactgaagagcttctgcacagcaaaagaaactaccatcagagtgaaaaggcaacctacaaaatgggagaaaattttcgcaacctactcatctgacaaagggctaatatccagaatctacaatgaactcaaacacatttacaagaaaaaaacaaacaaccccatcaaaaagtgggcaaaggacatgaacagacacttctcaaaagaagacatttgttttgtttttttcttggaagggagagaaaggcacagcatgacacctgaataaggagaatgaaaaaaacctgttaggtgaacagaaacaaaaacaaccacagaccactatagttgtcatccccacccacccatatccccttccaatgctgctctgacttgcaactgtcaatgcccaactgcctgaaaagccagtgtactttccaacttttgttaaacctcaggaaggctaaaaggtgcatgagaacaactgggggcctcacaaccatgtgagttttttcattaggtcatcagtgtcctttctccctagatgtaatctacatcagggcagggatttttttttgtctattttcttttttattattattaacgttggttatttatttatggacctactcattttagcatggtaaaatgtactcaaaataaaatttactattttttcttcaacttttaagttccagggtacatgtgcaggatgcgcaggtttgttacataggtaaatgtgtgccatgctggtttgctgcacagatcaacccatcacctaggtattaagcccagcatccattattcttcatgttgctctctccctccaccccccaccaatgacaggctccagtgtgtattgttcccctcgaagtgtccatgtgttctcatcgttcagctcccagttataagagagaacatttggtgtttggttttctgtttctacgtgagtttgctgaggataacggcttccagcttcatccctgtccctgcaaaggacatgatcttgttcctttcagtgacattaagtacattcacattgctattcaaccatcgtcaccataaatctatcttcagaactttttcatcttccccagctgaaactctacgcccattaaactataattatccatttccctctcccctagtccttgggaaccaccattctactttctgtctctatgaatatgactattataggtacctcatataagtagaatcatatagtatttgtacttttgtggttggcttacttcacttagcataatatcttcaaggtctacccacattgtaggatgtgacagaacttccatcttttttaaggctgaataatattccactataagttgatgccaagttatgtttatacatccattcatcaatgaacatttgggttgtttctgtatcttggctattgtgaataatggtgctattaacatggctttaaaaataccagttcaagtccctgctttcatttatttggggtatatacccagaagtggtattgctagaccacatggtaattctgtatttaattttttgaggaactgccataccgttttgcacagtggctacactattttacactcccaccagcaatgaagaagggttccagtttttccacgtcctcatcaatatttgttattttggttttttttttcataatagacaccctagttggtatgaagtagtatcttattgtggttttgatctgcatttcgctaatgattagtgatgctgattatcttttaatgtgctgattagccgttgatacatcttctttggagatatgtctgcttgactcttttcccattttttaaccaggttgttgtttattgttattgttgttgttgaattgtatgatttctttatatatttggaatatcaatccctaatcagatatatgatttgaaaatattttctcacattccataggttgccttttcactctgttgatagcatcttttgatgcagaaaccttttttattttgatgaggttcaatttatctattttctcttttgttgtctgtgtttttcatgtcatatccaacaaatcattaccaaatctaatatgaggctttttcctatgttttcttctaaaagtttatagttttagctcttatgtttaagtcttcaatccattttgagttaatttctgtatatggtataatgtaaggattcaattcattttcttggatgtggatatccagttttcccaacactatttgtcaaaaagactgtactttccccattgaatgatcttggtactcttgtcaaaactaacttggccatatatgtaaaaatttatttctgatctctatgtttctactctattgttctaaatgtctgtctttatgccagtatcatactggtttgattaccatagcataatgtactgtaagttttgaaattagaaagtatgagacctccaactttgctcgtcttttcagagattttcttggctatttaatgcctcttaaaattacacaagaattttacaatggatttttctatttctgcaaaaagaagaaaacacccatgggtaaacaagataccttggcacatgcctgttgtctcagctactggggagactgaggtggaaggatcacttgagcccaggagtttgagacccctggacaacatagcaagactctgtctctaaaaaaattaaaaatgacaccattgggattttgatagggattgcgttgaatctgtagataactttgggtagaactgacatcttagcaatattacctcttccaacctaggaacacaggacatattttcatttattagtgtcttctttgatttctttcagcagcaatttgtagttttcagtgtacaagtctttcatcgccttggttaagtttatttctaagtattctattctttttgatgctattgtaaatgacactgttttcctaatttccttttaagttaaaactgattttgaaattaaagctaattttgtacactgatgttatagcttgcagctttgctaaattagtgtatctcttcttaacacctagattcctaatgtctatcgcctgtaacatagtgggtactcaataactgtctattgagtaaacaaagaagtctcttgaaagagcctccctcttgctgctgctaatggtgcttctcatgagaatgttcattccaatgatgttatttcactaatgagaaaagccttctcccagatattgtaatactctttgttatcggagccctacagtagtattactcatttctagagtccatagagcctctcagccaggattcaaatgcagctggtatgcaccagtacctgtgtctgttatttaacaacatgcctattgttaaaacattgaaatacttccatacctattgataaataatgacttctttccgtatctcaagtggccccactactagatttatcatgtggtaaattgtttcagtaatgatgtgactgatgaatcacacttgtctatgttctctctcttatgtggttccctcccacattgactctgggcttggccatgtgacttgctttcactaatgggacatcagcaaatgtgatgtgagcagaggcttgaaatggtttgtgtattggagttattcatgggaaactagccaccatgtgaagcagcccaggctattctacataagctatatggcccagacaacagacagaaaccaactataagacatgtgagtgagatcatttttgaccacccagtcccagtaaagctaatagctgactgcagccacatacatgacccctgcaaaataactgctcagcccaaatcactcagacccatagatttgtgagcaaataaaataattacggctttaaaccactaagtattggagcggttgcttatgaaaccaagctaactataaatggacaaaactactccctcaggctccaaagatgtgaaataacaggaagctcacagcatgcaaatgctggttactccatacctgagagaatagcgttcacttttaggaaaaatatacagaaacagctcccaactaattgaaaatatattctgcctatttgaaaaatttcaatcaactactaataccacctggtactaaccaggtggtagatttttttccccttgaaagagatgagaagttatcttcaaagactttcactttatgatttattgcttcaatctcctttagaagaccaaaaaatatttaattctaacaggagcttaattctttttgcagtttcacctcctatcttctcaattataaagagaagtaaatcttacttgctaaagaattacatctctaaggtcaccgtttaaacttccagctaaaataatttgccctctacttctttcatgtttaaagggtgcacatttctgtgtcttcaagggggtgacacagctaatgtttcttaaatccacaattctgctttcatgaaatcaacaaaggtcttctgtgactttctatgaagacaaaagattcaatttctagccacctaaagaaaggatagcttttctgtgccagagagattcagaattccttgaatcaagtgtcatgatgtctggcaacttttcaacaaccttgcttttctttgctcaagaaaatctaaagctctaatagaccagtcaagtgaaatttcccatagaatacaatctttagagaccatagaatcaagttagaatgacaaaaatgtgacttttctcttctatgtctaggatcttttatcagaattgaaaccggttttgcttcaccattatttttcaacaaaacaacgtgtcatactctcaggtttattatttattttgcctgggatcattaactcaattggcttgtgcttattgttaatgaggctgtgatcttcatgtactcagtcccactatgggccagttggctttccatagaaatggattgcacccttggcttcagtgccaatctcaccccgacctcagccagatcaccttgcactcaagaaggacaagtcatattacagctacatatgtgtgaacattcctatcatgagaacaattcaatctttgtttaggggtgtaatgaggtttgccatcacttgaacaagatttaactggaaaaaaaaggttctaacttgaatttggggctctggtatgagtccacatagagcacatttacggtgttttagagcaatgatgagctgctataacaaacaatactaaaaatacaatgattttattttccttgtaataaacatttttaaaaaccactttgttgaggtataattggcatgtaaaaaactgtacttatttaatgtatacaactcgataagtttggagataagtatacacctgtgaaaccaccacgaccatcaaggccatattcctatccattatctcatgaagtttcctcctgcccctttatcgtgtgtgtgtgtgtgagaatgtgtgtgtaggaacacttaatatctactctcaaaaaattttaagtatacaatattgttagctataggcactatgtgtatagtagatcttgggaactatttatcttgcgtaactaaaattttgtaccctttggtcatcatctcccagtttccctctatgccagcccctgacaaccaccattctactctctgcttctgtgagtttgaataatatatattccacatataaatgagatcatacagtatttgtctctgtgtttggcttatttcacttagcatgatgtcctacaggtccatctatgttgtctcagatggcaggatttcctttctttctaaggctgcagagtatcacattttctctatccattcatccatcaatggataccatatcttggctattgtgaaaaatgctgacattaacatgagagtgcaggtactgctttgagatccagatttccattcctttggataaatacccaaaagtaggattgctgaatcatacggcagtactatttttaattttttgaggaacctccatactgttttccataatggctgtaccaattaacattcctgccaacagtttgccagagttcccttttctctacatcttcaccaacacttatctttttttttaataagagccattctaacaggtataaggtgatattttattatggtttttatttacattttcctaatgattagtgatgttgagcatctattcatatgcctgtggccatgtgcatgtcttctttggaggaatgtccattcaggtcatttggccatttttattataaattgacagttatagttgtatatatttatgatatataaagtgatgtttataaatgaaatgtggaatcaaattaattaactctccattgccttaaatacttaccttttttgtgaccagaacatttgaaatttacccttgtagagattttaaaatgtgtaatacactattattaactatactcaccattctgtgcaatagataacaataaaaaattttattccttctgtctaactgaagctttgtaccctttaactatcactctccttttccccaccctctagcctctggtaaccaccattctactctctgcatctatgagtttaattgttttagattccacatataagtgagaacatgcagtatgtgtcttcctgtgcctggtttatttcacttagcataattctctctaattccatccatgttgttgaaaatgacagaatttttttctttttaaggctgaatagtatttcattgtacatatatatcccaagttttcctttccaattcatctgttcatggaaacttaggttgattctataacttggctattgtaaataatgctgcaatgaatatgggagtacagatatctttttgacatactgattccaattcccttgaatatatacacagtactgggattgctggatcatatggtagttctacttttagtttcttcttagcaaccttcatatggctttcaataatatctatactaatttacattaccactaacagtgaacaagggttcccttttctcaacatcctcactgacactcgtttagctttcagtcttttttttctataacttttattttaagttcccaggtacatgtgcaggatgtgcaggtttgttacataggtaaatgtgtgtcatggtggtttgctgcacagatcagcccatcacctatgtattaagctcagcatcgattagctgttcttcctgatgctttctcaccccccaacccccatgacaggccccagtgtgtgttgttccctgcaatgtgtccacgtattctcatcgttcagcccccgcatttaagtgagaacatgcagtgtttggttttctgttcctgagttagtttgctgaggataatggcttccagctctatctatgtccctgcaagggacatgatccccatccttttaatggctgcatagtattccatgatacatatgtaccacgctttctttatccagtctatcattgatgggcacttaggttgattccatatctttgcaattgtgaatagtgctgcaatgaacagtcacgtgcatgtgtctttataatggaatgatttatattcctttgggtatatacccagtaatgagattgctgggtcaggtggtgtttctgcctctatatctttgaggaataaccacactgtttttcacaatggttaaactaatttacactcccaccaacagtgtaaaagtgttcttttgtctccacagccttgtcagcatctattatttcttgcctttattatgaataataattgtcattctgactgccatgagatggtatctcattgtggttttgatttgcatttctctaatgatcagagatgttgaatttttattcaaatatttcttggctgcatgaatgtcttcttttgagaagtgtcagttcctgtcctttgcccactttttaattgagttgtttttttcttgtaaatttgtttaagttccttgtagactctggatattagacctttgtcagatgcacagtttgcaaaaatgttctcccattctttaggttgtctgtttactctgttgatagtttcttttgctgtgcagaagctctttagtttaattagatcccatttgtcaattcttgcttttgctgcaattgcttttggtgttttcatcatgaaatctttgcccgtgcctatatcctgaatggtattgccaagattttcttatagggtttttatagttttgggttttacatttaagtcgttaatccatcttgagttaatttttgtataaggtgtaaggaaggggtccagtttcaattttctgcatatggctagccagttctcccaccatcatttactaaatagggaatcttttccgcattgcttatctttatcaggtttgtcaaagaccagatgattgtaggtgtgtggtcttatttctgagttctctattctgttccattggtctatgtgtctgtgtttttaccagtaccatggcatttcggttactgtagccttgtgtagtttgaagttgggtatcatgatgcctccagctttgttcttttttgattaggattgtcttggttatccaggctctttttttggttccacattaattttaacatagctttttctaattctgtgaagaatgtcaagggtagtttaatgggattagctctgaatctataaattactttgggcagtatggccattttcatgatactgactcttcctatccatgagctggaatgtttttccatttgtttgtgtcctctctgaattccttgagcagtggtttgtagttctctttgaagaggtcctttacttccctttgtagctgtattcctagatattttattctctttgtagcaactgtgaatgggaatttattcatgatttggctctctgcttgcctcttgttggtgtatagaaatgctagcaatttttgcacaccgattttgtatcctgagactttgctgaagttgtttatcagcccaagaagcttttgggctgagacaatggggttttctagatatgagatcatgtcagctgcaaacaaagataatttgacttcctcttttcctatttgaatacactatatttctttcttttgcctgattgccctggccagaacttccaatcctatgttgaataggagtggtgagagagggcacacttgtcttgtgccagttttcaaggggaatgctttcagcttttgtgcctttagtatgatattggctataggtttgtcatagatggcttttttattattttgaggtatgttccttcaatagctaatttattgagagtttctaacatgaaggaatgttgaattctatcaaaggccttttctgtgtccattgagctaatcttgtgttttttgtctttagttctgttcatgtgatgaatttcatttattaatttgaatatgttggaccaaccatgcatcctggggatgaaacctacttgatcatggtggataagctttttgatgtgctgctgtattcggtttgccagtattttgttgagggtttttgcatcgatgtttgtcaaggatattggcctgaagttttctctgccaggttttgatatcaggatgatgctagcctcataaaataagttatggaggagtccctccttttcaattgactggaatagtttcagtagaaatgataccatctcttctttgtacctctggtagaattcagctgtgaatccgtctggtcctgagatttttttggttggtaggttatttattactgcctcaatttcagaactcactgttggtctattcagggattcactttcttactggttcagtcttgggagggtgtatgtgcccaggaatgtatccacttcttctaggttttctagcttatatgcatagaggtgtttatagtattcactgatggtttgtatgtctgtggagttagtggtgatatctcccttatcatttctgattgtgtctattttattcttctctcttttcttctttattaatctagctagcagtctatctattttattttattttttcaaaaataacagctcctggatttgttgatttttcaaagggtttttcatgtctctatctcctttagttactctgatgttggttatttcttttcttctagcttcggggtttgtttgctcttggttctatagtcttctttgttctgatgactggttgttaatttgagatcttctagctttttgatgtgggcatttactgctataaatttccctcttaacactgctttagctgcatcccagagattctggtacattgtctcttatttctccttagtttcaaataacttcttgatttcggccttaatttcattatttacccaagtgtcattcaggaacaggttgtttaatttccatgtagttgtgtgatttttagtaaatttcttagtcttgagctgtaatttgattgtactgtggtatgagagactgtttgttatgatttcagctattttgcatttgctgaggagtgttttatttcagattttgtgatcaattttagagtaagtgccatgtagcaatgagaagaatgtatattctgttgtttttgcatggagagttctgtagatatctattaagtttacttgatccagagctgagttcaggtcctgtatatctttgttaatttttttgtctcaataatctgtctaatattgtcagtggggtgttataatctcccaggattatcatgtgggagtctaagtctctttgtaggtctctaaaaacttgctttatgaatctgggtactcctgtattgggtacatatatatttaggatagttagctcttcttgtcaaattgaactctttaccattacgtaacgcccttcttcttttttgatctttgttgttttaaagtctgttttgtcagaaactaggattgcaatccctgcttttttctgttttccatttccttggtaaatttccctccatctctttattttgtgtcgtgtgtgtctttgcacatgagatgggtctcttgaagacagcatgctgatgggtcttgactctatccaacttgtcattctgtgccttttaactggggcatttagcccatttacatttgatgttaatattgttatgtgtaaatttgatcctgtcatgatg
